US010260073B2

(12) United States Patent
Adato et al.

(10) Patent No.: US 10,260,073 B2
(45) Date of Patent: Apr. 16, 2019

(54) ISOLATED POLYNUCLEOTIDES AND POLYPEPTIDES, AND METHODS OF USING SAME FOR INCREASING YIELD OF PLANTS

(71) Applicant: Evogene Ltd., Rechovot (IL)

(72) Inventors: Avital Adato, Ramat Gan (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 1150 days.

(21) Appl. No.: 14/368,556

(22) PCT Filed: Dec. 26, 2012

(86) PCT No.: PCT/IL2012/050554
§ 371 (c)(1),
(2) Date: Jun. 25, 2014

(87) PCT Pub. No.: WO2013/098819
PCT Pub. Date: Jul. 4, 2013

(65) Prior Publication Data
US 2015/0082486 A1    Mar. 19, 2015

Related U.S. Application Data

(60) Provisional application No. 61/603,322, filed on Feb. 26, 2012, provisional application No. 61/580,674, filed on Dec. 28, 2011.

(51) Int. Cl.
*C12N 15/29* (2006.01)
*C12N 15/82* (2006.01)
*C07K 14/415* (2006.01)

(52) U.S. Cl.
CPC .......... *C12N 15/827* (2013.01); *C07K 14/415* (2013.01); *C12N 15/8247* (2013.01); *C12N 15/8261* (2013.01); *C12N 15/8271* (2013.01); *Y02A 40/146* (2018.01)

(58) Field of Classification Search
None
See application file for complete search history.

(56) References Cited

U.S. PATENT DOCUMENTS

| 6,084,153 | A | 7/2000 | Good et al. |
| 7,238,862 | B2 | 7/2007 | Allison et al. |
| 2002/0046419 | A1 | 4/2002 | Choo et al. |
| 2004/0214272 | A1 | 10/2004 | La Rosa et al. |
| 2005/0108791 | A1 | 5/2005 | Edgerton |
| 2006/0111848 | A1 | 5/2006 | Carlow et al. |
| 2006/0179511 | A1 | 8/2006 | Chomet et al. |
| 2009/0070897 | A1* | 3/2009 | Goldman ............ C07K 14/415 800/281 |
| 2011/0214205 | A1 | 9/2011 | Dietrich et al. |

FOREIGN PATENT DOCUMENTS

| WO | WO 2004/081173 | 9/2004 |
| WO | WO 2004/104162 | 12/2004 |
| WO | WO 2004/111183 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/039375 | 3/2013 |
| WO | WO 2013/078153 | 5/2013 |
| WO | WO 2013/098819 | 7/2013 |
| WO | WO 2013/128448 | 9/2013 |
| WO | WO 2013/179211 | 12/2013 |

(Continued)

OTHER PUBLICATIONS

GenBank Accession XM_002465058, Submitted Sep. 27, 2009.*
GenBank Accession EU964077, Submitted Aug. 4, 2008.*
Deng et al. Agricultural Sciences in China 8.7 (2009): 767-776.*
Grana, et al. Journal of Biological Chemistry 267.18 (1992): 12797-12803.*
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Examination Report dated Dec. 19, 2016 From the Instituto Mexicano de la Propiedad Industrial Re. Application No. MX/a/2014/008027 and Its Translation Into English. (11 Pages).

(Continued)

*Primary Examiner* — Mykola V. Kovalenko
*Assistant Examiner* — Charles Logsdon

(57) ABSTRACT

Provided are isolated polynucleotides and nucleic acid constructs which comprise a nucleic acid sequence at least 80% identical to a nucleic acid sequence selected form the group consisting of SEQ ID NOs: 1-219, 367-5628, 9688-9700, and 9709-9752; and isolated polypeptides which comprise an amino acid sequence at least 80% homologous to an amino acid sequence selected from the group consisting of SEQ ID NOs: 220-366, 5629-9400, 9701-9708, and 9753-9796. Also provided are transgenic cells and plants expressing same and methods of using same for increasing yield, growth rate, biomass, vigor, oil content, seed yield, fiber yield, fiber quality, nitrogen use efficiency, and/or abiotic stress of a plant.

6 Claims, 8 Drawing Sheets

Specification includes a Sequence Listing.

(56) References Cited

FOREIGN PATENT DOCUMENTS

| WO | WO 2014/033714 | 3/2014 |
|---|---|---|
| WO | WO 2014/102773 | 7/2014 |
| WO | WO 2014/102774 | 7/2014 |
| WO | WO 2014/188428 | 11/2014 |
| WO | WO 2015/029031 | 3/2015 |
| WO | WO 2015/181823 | 12/2015 |
| WO | WO 2016/030885 | 3/2016 |

OTHER PUBLICATIONS

Examination Report dated May 13, 2016 From the Instituto Mexicano de la Propiedad Industrial Re. Application No. MX/a/2014/008027 and Its Translation Into English.
Patent Examination Report dated Feb. 25, 2015 From the Australian Government, IP Australia Re. Application No. 2014202590.
Restriction Official Action dated Mar. 19, 2015 From the US Patent and Trademark Office Re. U.S. Appl. No. 14/580,020.
Completion Requirement Letter dated Dec. 9, 2014 From the Canadian Intellectual Property Office Re. Application No. 2,865,483.
International Preliminary Report on Patentability dated Jul. 10, 2014 From the International Bureau of WIPO Re. Application No. PCT/IL2012/050554.
International Search Report and the Written Opinion dated Apr. 18, 2013 From the International Searching Authority Re. Application No. PCT/IL2012/050554.
Invitation to Pay Additional Fees dated Feb. 10, 2013 From the International Searching Authority Re. Application No. PCT/IL2012/050554.
Alexandrov et al. "Hypothetical Protein [Zea Mays]", Database NCBI [Online], GenBank: ACG39383.1, Database Accession No. ACG39383, Dec. 10, 2008.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Examination Report dated Jul. 28, 2017 From the Australian Government, IP Australia Re. Application No. 2012359983. (3 Pages).
Examination Report dated Jan. 29, 2018 From the Australian Government IP Australia Re. Application No. 2012359983. (8 Pages).
Alexandrov et al. "2,3-Bisphosphoglycerate-Independent Phosphoglycerate Mutase [Zea Mays]", Database NCBI [Online], GenBank: ACG36195.1, Database Accession No. ACG36195, 2 Pages, Dec. 10, 2008.
Alexandrov et al. "Zea Mays Clone 377519 mRNA Sequence", Database NCBI [Online], GenBank: EU972212.1, Database Accession No. EU972212, 1 Page, Dec. 5, 2008.
Gardiner et al. "Zea Mays PC0072546 mRNA Sequence", Database NCBI [Online], GenBank: AY103600.1, Database Accession No. AY103600, 2 Pages, May 13, 2008.
Grana et al. "Zea Mays Cofactor-Independent Phosphoglycerate Mutase mRNA, Complete Cds", Database NCBI [Online], GenBank: M80912.1, Database Accession No. M80912, 2 Pages, Apr. 27, 1993.
Ossa et al. "Phosphoglycerate Mutase [Zea Mays]", Database Zea Mays [Online], GenBank: CAA83914.1, Database Accession No. CAA83914. 1 Page, Nov. 14, 2006.
Soderlund et al. "Unknown [Zea Mays]", Database NCBI [Online], GenBank: ACL54555.1, Database Accession No. ACL54555, 1 Page, Jan. 10, 2009.
Soderlund et al. "Zea Mays Full-Length cDNA Clone ZM_BFb0196A09 mRNA, Complete Cds", GenBank: BT061898.1, Database Accession No. BT061898, 2 Pages, Feb. 21, 2009.
Soderlund et al. "Zea Mays Full-Length cDNA Clone ZM_BFc0060K05 mRNA, Complete Cds", GenBank: BT055948.1, Database Accession No. BT055948, 2 Pages, Jan. 10, 2009.
Requisition by the Examiner dated Aug. 13, 2018 From the Canadian Intellectual Property Office Re. Application No. 2,570,195. (3 pages).
Examination Report dated Aug. 7, 2017 From the Instituto Mexicano de la Propiedad Industrial, IMPI, Direccion Divisional de Patentes Re. Application No. MX/a/2014/008027. (4 Pages).
Translation of Examination Report dated Aug. 7, 2017 From the Instituto Mexicano de la Propiedad Industrial, IMPI, Direccion Divisional de Patentes Re. Application No. MX/a/2014/008027. (5 Pages).

* cited by examiner pQFN, pQFNc

Normal conditions

Osmotic stress (15% PEG)

Nitrogen limiting conditions

ISOLATED POLYNUCLEOTIDES AND POLYPEPTIDES, AND METHODS OF USING SAME FOR INCREASING YIELD OF PLANTS

RELATED APPLCATIONS

This application is a National Phase of PCT Patent Application No. PCT/IL2012/050554 having International filing date of Dec. 26, 2012, which claims the benefit of priority under 35 USC § 119(e) of U.S. Provisional Patent Application Nos. 61/603,322 filed on Feb. 26, 2012 and 61/580,674 filed on Dec. 28, 2011 . The contents of the above applications are all incorporated by reference as if fully set forth herein in their entirety.

SEQUENCE LISTING STATEMENT

The ASCII file, entitled 59365SequenceListing.txt, created on May. 8, 2014, comprising 17,223,239 bytes, submitted concurrently with the filing of this application is incorporated herein by reference.

FIELD AND BACKGROUND OF THE INVENTION

The present invention, in some embodiments thereof, relates to novel polynucleotides and polypeptides which can be used to increase yield (e.g., seed/grain yield, oil yield), nitrogen use efficiency, fertilizer use efficiency, growth rate, vigor, biomass, oil content, fiber yield, fiber quality and/or length, abiotic stress tolerance and/or water use efficiency of a plant and to generate transgenic plants with increased yield, nitrogen use efficiency, growth rate, vigor, biomass, oil content, fiber yield, fiber quality and/or length, abiotic stress tolerance and/or water use efficiency as compared to wild type or non-transformed plants.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen usually needs to be replenished every year, particularly for cereals, which comprise more than half of the cultivated areas worldwide. For example, inorganic nitrogenous fertilizers such as ammonium nitrate, potassium nitrate, or urea, typically accounts for 40% of the costs associated with crops such as corn and wheat.

Nitrogen is an essential macronutrient for the plant, responsible for biosynthesis of amino and nucleic acids, prosthetic groups, plant hormones, plant chemical defenses, etc. In addition, nitrogen is often the rate-limiting element in plant growth and all field crops have a fundamental dependence on inorganic nitrogen. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. No. 20020046419 to Choo, et al.; U.S. Pat. Appl. No. 2005010879 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

The ever-increasing world population and the decreasing availability in arable land for agriculture affect the yield of plants and plant-related products. The global shortage of water supply, desertification, abiotic stress (ABS) conditions (e.g., salinity, drought, flood, suboptimal temperature and toxic chemical pollution), and/or limited nitrogen and fertilizer sources cause substantial damage to agricultural plants such as major alterations in the plant metabolism, cell death, and decreases in plant growth and crop productivity.

Drought is a gradual phenomenon, which involves periods of abnormally dry weather that persists long enough to produce serious hydrologic imbalances such as crop damage, water supply shortage and increased susceptibility to various diseases.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Thus, salination of soils that are used for agricultural production is a significant and increasing problem in regions that rely heavily on agriculture, and is worsen by over-utilization, over-fertilization and water shortage, typically caused by climatic change and the demands of increasing population.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

Wheat (*Triticum* spp) is the most widely grown crop and provides one-fifth of the total calories of the world's population. Future wheat improvement is expected to meet the considerable challenge of increasing production to feed an estimated world population of 9 billion by 2050 coupled with the threat of climate change to crop productivity. Since the 1960s, increases in productivity have been achieved as a result of wide-scale adoption of Green Revolution technologies). These had principally been attained by diverting assimilates previously used for long stem growth to increased size of the grain bearing ears. Thus, post green-revolution wheat lines have shorter stature that is associated with higher harvest index. However, the wheat harvest index is now approaching a plateau and further large increases in harvest index are unlikely to be achieved based only on the breeding approach. Biotechnology tools such as genetic engineering aimed at the introduction of novel genetic variance into wheat might offer an alternative solution. Furthermore, biotechnological approaches have the potential to complement breeding by reducing the time taken to produce cultivars with improved characteristics. However, despite the tremendous potential for wheat improvement through biotechnology approaches, the size and complexity of the wheat genome are challenging obstacles on the way to commercial track of transgenic wheat.

U.S. Pat. No. 7,238,862 (Allison et al.) discloses an improved transformation and regeneration system for wheat, for efficient and reliable for production of fertile plants with improved agronomic qualities.

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

SUMMARY OF THE INVENTION

According to an aspect of some embodiments of the present invention there is provided a method of increasing yield, growth rate, biomass, vigor, oil content, seed yield, fiber yield, fiber quality, nitrogen use efficiency, and/or abiotic stress of a plant, comprising expressing within the plant an exogenous polynucleotide comprising a nucleic acid sequence encoding a polypeptide at least 80% identical to SEQ ID NO: 220-366, 5629-9399, 9400, 9701-9708, 9753-9795 or 9796, thereby increasing the yield, growth rate, biomass, vigor, oil content, seed yield, fiber yield, fiber quality, nitrogen use efficiency, and/or abiotic stress of the plant.

According to an aspect of some embodiments of the present invention there is provided a method of increasing yield, growth rate, biomass, vigor, oil content, seed yield, fiber yield, fiber quality, nitrogen use efficiency, and/or abiotic stress of a plant, comprising expressing within the plant an exogenous polynucleotide comprising a nucleic acid sequence encoding a polypeptide selected from the group consisting of SEQ ID NOs: 220-366, 5629-9399, 9400, 9701-9708, 9753-9795 and 9796, thereby increasing the yield, growth rate, biomass, vigor, oil content, seed yield, fiber yield, fiber quality, nitrogen use efficiency, and/or abiotic stress of the plant.

According to an aspect of some embodiments of the present invention there is provided a method of producing a crop comprising growing a crop of a plant expressing an exogenous polynucleotide comprising a nucleic acid sequence encoding a polypeptide at least 80% homologous to the amino acid sequence selected from the group consisting of SEQ ID NOs: 273, 220-272, 274-366, 5629-9400, 9701-9708, 9753-9795 and 9796, wherein said plant is derived from a plant selected for increased yield, increased growth rate, increased biomass, increased vigor, increased oil content, increased seed yield, increased fiber yield, increased fiber quality, increased nitrogen use efficiency, and/or increased abiotic stress tolerance as compared to a control plant, thereby producing the crop.

According to an aspect of some embodiments of the present invention there is provided a method of increasing yield, growth rate, biomass, vigor, oil content, seed yield, fiber yield, fiber quality, nitrogen use efficiency, and/or abiotic stress of a plant, comprising expressing within the plant an exogenous polynucleotide comprising a nucleic acid sequence at least 80% identical to SEQ ID NO: 1-219, 367-5627, 5628, 9688-9700, 9709-9751 or 9752, thereby increasing the yield, growth rate, biomass, vigor, oil content, seed yield, fiber yield, fiber quality, nitrogen use efficiency, and/or abiotic stress of the plant.

According to an aspect of some embodiments of the present invention there is provided a method of increasing yield, growth rate, biomass, vigor, oil content, seed yield, fiber yield, fiber quality, nitrogen use efficiency, and/or abiotic stress of a plant, comprising expressing within the plant an exogenous polynucleotide comprising the nucleic acid sequence selected from the group consisting of SEQ ID NOs: 1-219, 367-5627, 5628, 9688-9700, 9709-9751 and 9752, thereby increasing the yield, growth rate, biomass, vigor, oil content, seed yield, fiber yield, fiber quality, nitrogen use efficiency, and/or abiotic stress of the plant.

According to an aspect of some embodiments of the present invention there is provided a method of producing a crop comprising growing a crop of a plant expressing an exogenous polynucleotide which comprises a nucleic acid sequence which is at least 80% identical to the nucleic acid sequence selected from the group consisting of SEQ ID NOs:176, 1-175, 177-219, 367-5628, 9688-9700, 9709-9751 and 9752, wherein said plant is derived from a plant selected for increased yield, increased growth rate, increased biomass, increased vigor, increased oil content, increased seed yield, increased fiber yield, increased fiber quality, increased nitrogen use efficiency, and/or increased abiotic stress tolerance as compared to a control plant, thereby producing the crop According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 220-366, 5629-9399, 9400, 9701-9708, 9753-9795 or 9796, wherein the amino acid sequence is capable of increasing yield, growth rate, biomass, vigor, oil content, seed yield, fiber yield, fiber quality, nitrogen use efficiency, and/or abiotic stress of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 220-366, 5629-9399, 9400, 9701-9708, 9753-9795 and 9796.

According to an aspect of some embodiments of the present invention there is provided an isolated polynucleotide comprising a nucleic acid sequence at least 80% identical to SEQ ID NOs: 1-219, 367-5627, 5628, 9688-9700, 9709-9751 and 9752, wherein the nucleic acid sequence is capable of increasing yield, growth rate, biomass, vigor, oil content, seed yield, fiber yield, fiber quality, nitrogen use efficiency, and/or abiotic stress of a plant.

According to an aspect of some embodiments of the present invention there is provided an isolated polynucleotide comprising the nucleic acid sequence selected from the group consisting of SEQ ID NOs: 1-219, 367-5627, 5628, 9688-9700, 9709-9751 and 9752.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 220-366, 5629-9399, 9400, 9701-9708, 9753-9795 or 9796, wherein the amino acid sequence is capable of increasing yield, growth rate, biomass, vigor, oil content, seed yield, fiber yield, fiber quality, nitrogen use efficiency, and/or abiotic stress of a plant.

According to an aspect of some embodiments of the present invention there is provided an isolated polypeptide comprising the amino acid sequence selected from the group consisting of SEQ ID NOs: 220-366, 5629-9399, 9400, 9701-9708, 9753-9795 and 9796.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to an aspect of some embodiments of the present invention there is provided a transgenic plant comprising the nucleic acid construct of some embodiments of the invention or the plant cell of some embodiments of the invention.

According to some embodiments of the invention, the nucleic acid sequence encodes an amino acid sequence selected from the group consisting of SEQ ID NOs: 220-366, 5629-9399, 9400, 9701-9708, 9753-9795 and 9796.

According to some embodiments of the invention, the nucleic acid sequence is selected from the group consisting of SEQ ID NOs: 1-219, 367-5627, 5628, 9688-9700, 9709-9751 and 9752.

According to some embodiments of the invention, the polynucleotide consists of the nucleic acid sequence selected from the group consisting of SEQ ID NOs: 1-219, 367-5627, 5628, 9688-9700, 9709-9751 and 9752.

According to some embodiments of the invention, the nucleic acid sequence encodes the amino acid sequence selected from the group consisting of SEQ ID NOs: 220-366, 5629-9399, 9400, 9701-9708, 9753-9795 and 9796.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, osmotic stress, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

According to some embodiments of the invention, the method further comprising growing the plant expressing the exogenous polynucleotide under nitrogen-limiting conditions.

According to some embodiments of the invention, the promoter is heterologous to the isolated polynucleotide and/or to the host cell.

According to some embodiments of the invention, the plant is wheat.

According to some embodiments of the invention, expressing the exogenous polynucleotide is performed using a wheat promoter.

According to some embodiments of the invention, the promoter is suitable for expression in a wheat plant.

According to some embodiments of the invention, the wheat promoter comprises the nucleic acid sequence selected from the group consisting of SEQ ID NOs: 9811, 9806, 9807, 9804, 9805, 9812, 9813, 9809, 9810, 9406, 9409, 9407, 9408, 9797, 9418, 9799, 9800, 9801, 9808, and 9803.

According to an aspect of some embodiments of the present invention there is provided a method of growing a crop, the method comprising seeding seeds and/or planting plantlets of a plant transformed with the isolated polynucleotide of some embodiments of the invention, or the nucleic acid construct of some embodiments of the invention, wherein the plant is derived from plants selected for at least one trait selected from the group consisting of: increased nitrogen use efficiency, increased abiotic stress tolerance, increased biomass, increased growth rate, increased vigor, increased yield and increased fiber yield or quality, and increased oil content as compared to a non-transformed plant, thereby growing the crop.

According to some embodiments of the invention, the non-transformed plant is a wild type plant of an identical genetic background.

According to some embodiments of the invention, the non-transformed plant is a wild type plant of the same species.

According to some embodiments of the invention, the non-transformed plant is grown under identical growth conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
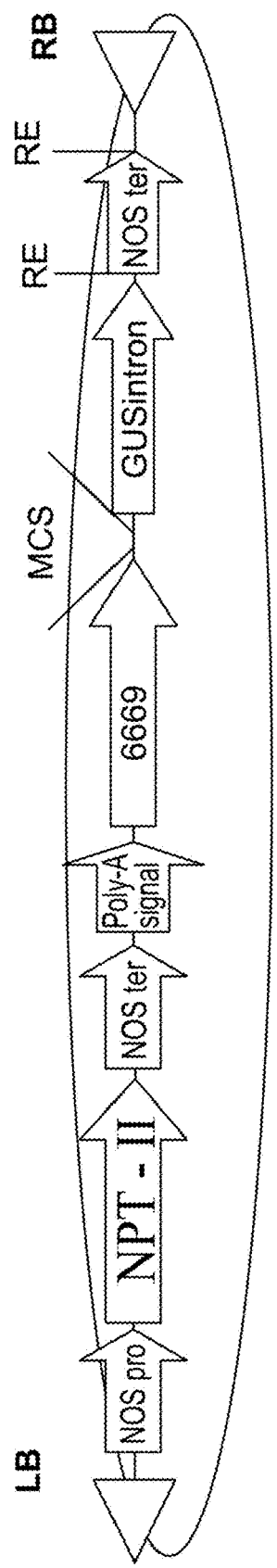
FIG. 1 is a schematic illustration of the modified pGI binary plasmid containing the new At6669 promoter (SEQ ID NO: 9405) and the GUSintron (pQYN_6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron).

The present invention, in some embodiments thereof, relates to methods of increasing yield, biomass, vigor, growth rate, oil content, abiotic stress tolerance, fertilizer use efficiency (e.g., nitrogen use efficiency), water use efficiency fiber yield and/or quality of a plant, such as a wheat plant and to transgenic plants with increased yield, biomass, vigor, growth rate, oil content, abiotic stress tolerance, fertilizer use efficiency (e.g., nitrogen use efficiency), water use efficiency fiber yield and/or quality as compared to non-transformed plants.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to increase yield, growth rate, biomass, oil content, vigor, fiber yield, fiber quality, fertilizer use efficiency (e.g., nitrogen use efficiency) and/or abiotic stress tolerance of a plant.

Thus, as shown in the Examples section which follows, the present inventors have utilized bioinformatics tools to identify polynucleotides which enhance yield (e.g., seed yield, oil yield, oil content), growth rate, biomass, vigor, fiber yield, fiber quality, fertilizer use efficiency (e.g., nitrogen use efficiency) and/or abiotic stress tolerance of a plant. Genes which affect the trait-of-interest were identified based on expression profiles of genes of several *Sorghum*, Maize, Barley, *Brachypodium*, Foxtail Millet, and Soybean accessions, varieties and tissues, homology with genes known to affect the trait-of-interest and using digital expression profile in specific tissues and conditions (Tables 1-52, Examples 1-11). Homologous polypeptides and polynucleotides (e.g., orthologous) having the same function were also identified (Table 53, Example 12). The identified genes were cloned (Example 13, Table 54) and transformed into *agrobacterium* (Example 14) for the generation of transgenic plants (e.g., transgenic *Arabidopsis, Brachypodium* or wheat plants) transformed with the identified genes and with their homologues (Examples 15-17). Transgenic plants over-expressing the identified polynucleotides were evaluated for plant performance in greenhouse (Examples 18 and 19) and tissue culture (Example 20) experiments. Altogether, these results suggest the use of the novel polynucleotides and polypeptides of the invention for increasing yield (including oil yield, seed yield and oil content), growth rate, biomass, vigor, fiber yield and/or quality, fertilizer use efficiency (e.g., nitrogen use efficiency) and/or abiotic stress tolerance of a plant.

Thus, according to an aspect of some embodiments of the invention, there is provided method of increasing yield, growth rate, biomass, vigor, oil content, seed yield, fertilizer use efficiency (e.g., nitrogen use efficiency), fiber yield, fiber quality, and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 220-366, 5629-9399, 9400, 9701-9708, 9753-9795 and 9796, thereby increasing the yield, growth rate, biomass, vigor, oil content, seed yield, fiber yield, fiber quality, fertilizer use efficiency (e.g., nitrogen use efficiency) and/or abiotic stress of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in an improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigor. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (Zea mays L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (*Kapok, Ceiba pentandra*), desert willow, creosote bush, winterfat, balsa, kenaf, roselle, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow.

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in yield, growth rate, biomass, vigor, oil content, seed yield, fiber yield, fiber quality, nitrogen use efficiency, and/or abiotic stress of a plant as compared to a native plant or a wild type plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant (e.g., a nucleic acid sequence from a different species, e.g., a different plant species) or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 220-366, 5629-9399, 9400, 9701-9708, 9753-9795 and 9796.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

Homology (e.g., percent homology, identity+similarity) can be determined using any homology comparison software computing a pairwise sequence alignment.

Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., an homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from http://emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS- 6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S, and Gill-More, R. (1999)-FramePlus: aligning DNA to protein sequences. Bioinformatics, 15, 867-873) (available from http://www(dot)biocceleration(dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from http://emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cut-off—60% Identity on a span of 60% of the sequences lengths because it is used only as a filter for the global alignment stage. In this specific embodiment (when the local identity is used), the default filtering of the Blast package is not utilized (by setting the parameter "—F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the Blastp Filter): EMBOSS-6.0.1 Needleman-Wunsch algorithm with the following modified parameters: gapopen=8 gapextend=2. The rest of the parameters are unchanged from the default options listed here:

Standard (Mandatory) Qualifiers:
[-asequence] sequence Sequence filename and optional format, or reference (input USA)
[-bsequence] seqall Sequence(s) filename and optional format, or reference (input USA)
-gapopen float [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)
-gapextend float [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)
[-outfile] align [*.needle] Output alignment file name
Additional (Optional) Qualifiers:
-datafile matrixf [EBLOSUM62 for protein, EDNAFULL for DNA]. This is the scoring matrix file used when comparing sequences. By default it is the file 'EBLOSUM62' (for proteins) or the file 'EDNAFULL' (for nucleic sequences). These files are found in the 'data' directory of the EMBOSS installation.
Advanced (Unprompted) Qualifiers:
-[no]brief boolean [Y] Brief identity and similarity
Associated Qualifiers:
"-asequence" associated qualifiers
-sbegin1 integer Start of the sequence to be used
-send1 integer End of the sequence to be used
-sreverse1 boolean Reverse (if DNA)
-sask1 boolean Ask for begin/end/reverse
-snucleotide1 boolean Sequence is nucleotide
-sprotein1 boolean Sequence is protein
-slower1 boolean Make lower case
-supper1 boolean Make upper case
-sformat1 string Input sequence format
-sdbname1 string Database name
-sid1 string Entryname
-ufo1 string UFO features
-fformat1 string Features format
-fopenfile1 string Features file name
"-bsequence" associated qualifiers
-sbegin2 integer Start of each sequence to be used
-send2 integer End of each sequence to be used
-sreverse2 boolean Reverse (if DNA)
-sask2 boolean Ask for begin/end/reverse
-snucleotide2 boolean Sequence is nucleotide
-sprotein2 boolean Sequence is protein
-slower2 boolean Make lower case -supper2 boolean Make upper case
-sformat2 string Input sequence format
-sdbname2 string Database name
-sid2 string Entryname
-ufo2 string UFO features
-fformat2 string Features format
-fopenfile2 string Features file name
"-outfile" associated qualifiers
-aformat3 string Alignment format
-aextension3 string File name extension
-adirectory3 string Output directory
-aname3 string Base file name
-awidth3 integer Alignment width
-aaccshow3 boolean Show accession number in the header
-adesshow3 boolean Show description in the header
-ausashow3 boolean Show the full USA in the alignment
-aglobal3 boolean Show the full sequence in alignment
General Qualifiers:
-auto boolean Turn off prompts
-stdout boolean Write first file to standard output
-filter boolean Read first file from standard input, write first file to standard output
-options boolean Prompt for standard and additional values
-debug boolean Write debug output to program.dbg
-verbose boolean Report some/full command line options
-help boolean Report command line options. More information on associated and general qualifiers can be found with -help -verbose
-warning boolean Report warnings
-error boolean Report errors
-fatal boolean Report fatal errors
-die boolean Report dying program messages 2. Between a Protein Sequence and a Nucleotide Sequence (Following the tblastn Filter): GenCore 6.0 OneModel application utilizing the Frame+algorithm with the following parameters: model=frame+_p2n.model mode=qglobal -q=protein.sequence -db=nucleotide.sequence. The rest of the parameters are unchanged from the default options:

Usage:
om -model=<model_fname>[-q=]query [-db=]database [options]
-model=<model_fname> Specifies the model that you want to run. All models supplied by Compugen are located in the directory $CGNROOT/models/.

Valid Command Line Parameters:
-dev=<dev_name> Selects the device to be used by the application.
  Valid devices are:
  bic—Bioccelerator (valid for SW, XSW, FRAME N2P, and FRAME_P2N models).
  xlg—BioXL/G (valid for all models except XSW).
  xlp—BioXL/P (valid for SW, FRAME+_N2P, and FRAME_P2N models).
  xlh—BioXL/H (valid for SW, FRAME+_N2P, and FRAME_P2N models).
  soft—Software device (for all models).
-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.
-db=<database name> Chooses the database set. The database set can be a sequence file or a database reference. The database format is detected automatically. However, you may specify a format using -dfmt parameter.
-qacc Add this parameter to the command line if you specify query using accession numbers.
-dacc Add this parameter to the command line if you specify a database using accession numbers.
-dfmt/-qfmt=<format type> Chooses the database/query format type. Possible formats are:
  fasta—fasta with seq type auto-detected.
  fastap—fasta protein seq.
  fastan—fasta nucleic seq.
  gcg—gcg format, type is auto-detected.
  gcg9seq—gcg9 format, type is auto-detected.
  gcg9seqp—gcg9 format protein seq.
  gcg9seqn—gcg9 format nucleic seq.
  nbrf—nbrf seq, type is auto-detected.
  nbrfp—nbrf protein seq.
  nbrfn—nbrf nucleic seq.
  embl—embl and swissprot format.
  genbank—genbank format (nucleic).
  blast—blast format.
  nbrf_gcg—nbrf-gcg seq, type is auto-detected.
  nbrf_gcgp—nbrf-gcg protein seq.
  nbrf_gcgn—nbrf-gcg nucleic seq.
  raw—raw ascii sequence, type is auto-detected.
  rawp—raw ascii protein sequence.
  rawn—raw ascii nucleic sequence.
  pir—pir codata format, type is auto-detected.
  profile—gcg profile (valid only for -qfmt in SW, XSW, FRAME_P2N, and FRAME+_P2N).
-out=<out fname> The name of the output file.
-suffix=<name> The output file name suffix.
-gapop=<n> Gap open penalty. This parameter is not valid for FRAME+. For FrameSearch the default is 12.0. For other searches the default is 10.0.
-gapext=<n> Gap extend penalty. This parameter is not valid for FRAME+. For FrameSearch the default is 4.0. For other models: the default for protein searches is 0.05, and the default for nucleic searches is 1.0.
-qgapop=<n> The penalty for opening a gap in the query sequence. The default is 10.0. Valid for XSW.
-qgapext=<n> The penalty for extending a gap in the query sequence. The default is 0.05. Valid for XSW.
-start=<n> The position in the query sequence to begin the search.
-end=<n> The position in the query sequence to stop the search.
-qtrans Performs a translated search, relevant for a nucleic query against a protein database. The nucleic query is translated to six reading frames and a result is given for each frame.
  Valid for SW and XSW.
-dtrans Performs a translated search, relevant for a protein query against a DNA database. Each database entry is translated to six reading frames and a result is given for each frame.
  Valid for SW and XSW.
Note: "-qtrans" and "-dtrans" options are mutually exclusive.
-matrix=<matrix_file> Specifies the comparison matrix to be used in the search. The matrix must be in the BLAST format. If the matrix file is not located in $CGNROOT/tables/matrix, specify the full path as the value of the -matrix parameter.

-trans=<transtab_name> Translation table. The default location for the table is $CGNROOT/tables/trans.
-onestrand Restricts the search to just the top strand of the query/database nucleic sequence.
-list=<n> The maximum size of the output hit list. The default is 50.
-docalign=<n> The number of documentation lines preceding each alignment. The default is 10.
-thr_score=<score_name> The score that places limits on the display of results. Scores that are smaller than -thr_min value or larger than -thr_max value are not shown. Valid options are: quality.
 zscore.
 escore.
-thr_max=<n> The score upper threshold. Results that are larger than -thr_max value are not shown.
-thr_min=<n> The score lower threshold. Results that are lower than -thr_min value are not shown.
-align=<n> The number of alignments reported in the output file.
-noalign Do not display alignment.
Note: "-align" and "-noalign" parameters are mutually exclusive.
-outfmt=<format_name> Specifies the output format type. The default format is PFS. Possible values are:
 PFS—PFS text format
 FASTA—FASTA text format
 BLAST—BLAST text format
-nonorm Do not perform score normalization.
-norm=<norm name> Specifies the normalization method. Valid options are:
 log—logarithm normalization.
 std—standard normalization.
 stat—Pearson statistical method.
Note: "-nonorm" and "-norm" parameters cannot be used together.
Note: Parameters -xgapop, -xgapext, -fgapop, -fgapext, -ygapop, -ygapext, -delop, and -delext apply only to FRAME+.
-xgapop=<n> The penalty for opening a gap when inserting a codon (triplet). The default is 12.0.
-xgapext=<n> The penalty for extending a gap when inserting a codon (triplet). The default is 4.0.
-ygapop=<n> The penalty for opening a gap when deleting an amino acid. The default is 12.0.
-ygapext=<n> The penalty for extending a gap when deleting an amino acid. The default is 4.0.
-fgapop=<n> The penalty for opening a gap when inserting a DNA base. The default is 6.0.
-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.
Note:"-batch" and "-wait" parameters are mutually exclusive.
-version Prints the software version number.
-help Displays this help message. To get more specific help type:
 "om-model=<model_fname>-help".
According to some embodiments the homology is a local homology or a local identity.

Local alignments tools include, but are not limited to the BlastP, BlastN, BlastX or TBLASTN software of the National Center of Biotechnology Information (NCBI), FASTA, and the Smith-Waterman algorithm.

A tblastn search allows the comparison between a protein sequence and the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.

Default parameters for blastp include: Max target sequences: 100; Expected threshold: $e^{-5}$; Word size: 3; Max matches in a query range: 0; Scoring parameters: Matrix—BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 220-366, 5629-9399, 9400, 9701-9708, 9753-9795 and 9796.

According to some embodiments of the invention, the method of increasing yield, growth rate, biomass, vigor, oil content, seed yield, fiber yield, fiber quality, fertilizer use efficiency (e.g., nitrogen use efficiency) and/or abiotic stress of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 220-366, 5629-9399, 9400, 9701-9708, 9753-9795 and 9796, thereby increasing the yield, growth rate, biomass, vigor, oil content, seed yield, fiber yield, fiber quality, fertilizer use efficiency (e.g., nitrogen use efficiency) and/or abiotic stress of the plant.

According to some embodiments of the invention, the exogenous polynucleotide encodes a polypeptide consisting of the amino acid sequence set forth by SEQ ID NO: 220-366, 5629-9399, 9400, 9701-9708, 9753-9795 or 9796.

According to an aspect of some embodiments of the invention, the method of increasing yield, growth rate, biomass, vigor, oil content, seed yield, fiber yield, fiber quality, nitrogen use efficiency, and/or abiotic stress of a plant, is effected by expressing within the plant an exogenous polynucleotide comprising a nucleic acid sequence encoding a polypeptide comprising an amino acid sequence selected from the group consisting of SEQ ID NOs:220-366, 5629-9399, 9400, 9701-9708, 9753-9795 and 9796, thereby increasing the yield, growth rate, biomass, vigor, oil content, seed yield, fiber yield, fiber quality, nitrogen use efficiency, and/or abiotic stress of the plant.

According to an aspect of some embodiments of the invention, there is provided a method of increasing yield, growth rate, biomass, vigor, oil content, seed yield, fiber yield, fiber quality, fertilizer use efficiency (e.g., nitrogen use efficiency) and/or abiotic stress of a plant, comprising expressing within the plant an exogenous polynucleotide comprising a nucleic acid sequence encoding a polypeptide selected from the group consisting of SEQ ID NOs: 220-366, 5629-9399, 9400, 9701-9708, 9753-9795 and 9796, thereby increasing the yield, growth rate, biomass, vigor, oil content, seed yield, fiber yield, fiber quality, fertilizer use efficiency (e.g., nitrogen use efficiency) and/or abiotic stress of the plant.

According to some embodiments of the invention, the exogenous polynucleotide encodes a polypeptide consisting of the amino acid sequence set forth by SEQ ID NO: 220-366, 5629-9399, 9400, 9701-9708, 9753-9795 or 9796.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-219, 367-5627, 5628, 9688-9700, 9709-9751 and 9752.

According to an aspect of some embodiments of the invention, there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-219, 367-5627, 5628, 9688-9700, 9709-9751 and 9752, thereby increasing the yield, biomass, growth rate, vigor, oil content, fiber yield, fiber quality, abiotic stress tolerance, and/or nitrogen use efficiency of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-219, 367-5627, 5628, 9688-9700, 9709-9751 and 9752.

According to some embodiments of the invention the exogenous polynucleotide is set forth by SEQ ID NO:1-219, 367-5627, 5628, 9688-9700, 9709-9751 or 9752.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment, e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [($X_n$−$Y_n$)/$Y_n$]2/N, where $X_n$ refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively affect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 921, 1425, 1938, 1939, 2110, 2208, 2257, 2296, 2297, 2309, 2445, 2729, 2844, 2918, 3306, 3310-3312, 3414, 3655-3657, 3834-3835, 3841, 3849, 3880-3881, 3892, 3902, 5070 and 5493.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-219, 367-5627, 5628, 9688-9700, 9709-9751 and 9752.

According to an aspect of some embodiments of the invention, there is provided a method of increasing yield, growth rate, biomass, vigor, oil content, seed yield, fiber yield, fiber quality, fertilizer use efficiency (e.g., nitrogen use efficiency), and/or abiotic stress of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-219, 367-5627, 5628, 9688-9700, 9709-9751 and 9752, thereby increasing the yield, growth rate, biomass, vigor, oil content, seed yield, fiber yield, fiber quality, fertilizer use efficiency (e.g., nitrogen use efficiency), and/or abiotic stress of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-219, 367-5627, 5628, 9688-9700, 9709-9751 and 9752.

According to some embodiments of the invention the exogenous polynucleotide is set forth by SEQ ID NOs: 1-219, 367-5627, 5628, 9688-9700, 9709-9751 and 9752.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-219, 367-5627, 5628, 9688-9700, 9709-9751 and 9752.

According to some embodiments of the invention the nucleic acid sequence is capable of increasing yield, seed yield, growth rate, vigor, biomass, oil content, nitrogen use efficiency, fertilizer use efficiency, fiber yield, fiber quality, abiotic stress tolerance and/or water use efficiency of a plant.

According to some embodiments of the invention the isolated polynucleotide comprising the nucleic acid sequence selected from the group consisting of SEQ ID NOs: 1-219, 367-5627, 5628, 9688-9700, 9709-9751 and 9752.

According to some embodiments of the invention the isolated polynucleotide is set forth by SEQ ID NOs: 1-219, 367-5627, 5628, 9688-9700, 9709-9751 and 9752.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 220-366, 5629-9399, 9400, 9701-9708, 9753-9795 and 9796.

According to some embodiments of the invention the amino acid sequence is capable of increasing yield, growth rate, biomass, vigor, oil content, seed yield, fiber yield, fiber quality, fertilizer use efficiency (e.g., nitrogen use efficiency), abiotic stress and/or water use efficiency of a plant.

The invention provides an isolated polynucleotide comprising a nucleic acid sequence encoding a polypeptide which comprises the amino acid sequence selected from the group consisting of SEQ ID NOs: 220-366, 5629-9399, 9400, 9701-9708, 9753-9795 and 9796.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NO: 220-366, 5629-9399, 9400, 9701-9708, 9753-9795 or 9796.

According to some embodiments of the invention, the polypeptide comprising an amino acid sequence selected from the group consisting of SEQ ID NOs: 220-366, 5629-9399, 9400, 9701-9708, 9753-9795 and 9796.

According to some embodiments of the invention, the polypeptide is set forth by SEQ ID NOs: 220-366, 5629-9399, 9400, 9701-9708, 9753-9795 and 9796.

The invention also encompasses fragments of the above described polypeptides and polypeptides having mutations, such as deletions, insertions or substitutions of one or more amino acids, either naturally occurring or man induced, either randomly or in a targeted fashion.

The term "'plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cyclonia oblonga*, *Cryptomeria japonica*, *Cymbopogon* spp., *Cynthea dealbata*, *Cyclonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifolium* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention, the plant used by the method of the invention is wheat.

Non-limiting examples of wheat species which can be used according to some embodiments of the invention include Faller, Bobwhite, Mc Neal, Anshlag, KWS Aurum, KWS Scirocco and Azhurnaya.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

According to some embodiments of the invention, the promoter is a wheat promoter (i.e., a promoter which is suitable for expression in wheat plants).

Suitable promoters for expression in wheat include, but are not limited to, Wheat SPA promoter (SEQ ID NO: 9811; Albanietal, Plant Cell, 9: 171-184, 1997, which is fully incorporated herein by reference), wheat LMW [SEQ ID NO: 9806 (longer LMW promoter), and SEQ ID NO: 9807 (LMW promoter)] and HMW glutenin-1 [SEQ ID NO: 9804 (Wheat HMW glutenin-1 longer promoter); and SEQ ID NO: 9805 (Wheat HMW glutenin-1 Promoter); Thomas and Flavell, The Plant Cell 2:1171-1180; Furtado et al., 2009 Plant Biotechnology Journal 7:240-253, each of which is fully incorporated herein by reference], wheat alpha, beta and gamma gliadins [e.g., SEQ ID NO: 9812 (wheat alpha gliadin, B genome, promoter); SEQ ID NO: 9813 (wheat gamma gliadin promoter); EMBO 3:1409-15, 1984, which is fully incorporated herein by reference], wheat TdPR60 [SEQ ID NO:9809 (wheat TdPR60 longer promoter) or SEQ ID NO:9810 (wheat TdPR60 promoter); Kovalchuk et al., Plant Mol Biol 71:81-98, 2009, which is fully incorporated herein by reference], maize Ub1 Promoter [cultivar Nongda 105 (SEQ ID NO:9406); GenBank: DQ141598.1; Taylor et al., Plant Cell Rep 1993 12: 491-495, which is fully incorporated herein by reference; and cultivar B73 (SEQ ID NO:9409); Christensen, A H, et al. Plant Mol. Biol. 18 (4), 675-689 (1992), which is fully incorporated herein by reference]; rice actin 1 (SEQ ID NO:9407; Mc Elroy et al. 1990, The Plant Cell, Vol. 2, 163-171, which is fully incorporated herein by reference), rice GOS2 [SEQ ID NO: 9408 (rice GOS2 longer promoter) and SEQ ID NO: 9797 (rice GOS2 Promoter); De Pater et al. Plant J. 1992; 2: 837-44, which is fully incorporated herein by reference], *arabidopsis* Pho1 [SEQ ID NO: 9418 (arabidopsis Pho1 Promoter); Hamburger et al., Plant Cell. 2002; 14: 889-902, which is fully incorporated herein by reference], ExpansinB promoters, e.g., rice ExpB5 [SEQ ID NO:9799 (rice ExpB5 longer promoter) and SEQ ID NO: 9800 (rice ExpB5 promoter)] and Barley ExpB1 [SEQ ID NO: 9801 (barley ExpB1 Promoter), Won et al. Mol Cells. 2010; 30:369-76, which is fully incorporated herein by reference], barley SS2 (sucrose synthase 2) [(SEQ ID NO: 9808), Guerin and Carbonero, Plant Physiology May 1997 vol. 114 no. 1 55-62, which is fully incorporated herein by reference], and rice PG5a [SEQ ID NO:9803, U.S. Pat. No. 7,700,835, Nakase et al., Plant Mol. Biol. 32:621-30, 1996, each of which is fully incorporated herein by reference].

Suitable constitutive promoters include, for example, CaMV 35S promoter [SEQ ID NO: 9401 (CaMV 35S (QFNC) Promoter); SEQ ID NO: 9402 (PJJ 35S from *Brachypodium*); SEQ ID NO: 9403 (CaMV 35S (OLD) Promoter) (Odell et al., Nature 313:810-812, 1985)], *Arabidopsis* At6669 promoter (SEQ ID NO: 9404 (*Arabidopsis* At6669 (OLD) Promoter); see PCT Publication No. WO04081173A2 or the new At6669 promoter (SEQ ID NO: 9405 (Arabidopsis At6669 (NEW) Promoter)); maize Ub1 Promoter [cultivar Nongda 105 (SEQ ID NO:9406); GenBank: DQ141598.1; Taylor et al., Plant Cell Rep 1993 12: 491-495, which is fully incorporated herein by reference; and cultivar B73 (SEQ ID NO:9409); Christensen, A H, et al. Plant Mol. Biol. 18 (4), 675-689 (1992), which is fully incorporated herein by reference]; rice actin 1 (SEQ ID NO: 9407, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); rice GOS2 [SEQ ID NO: 9408 (rice GOS2 longer Promoter) and SEQ ID NO: 9797 (rice GOS2 Promoter), de Pater et al, Plant J November; 2(6):837-44, 1992]; RBCS promoter (SEQ ID NO:9410); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608, 149; 5,608,144; 5,604,121; 5,569,597: 5,466,785; 5,399, 680; 5,268,463; and 5,608,142.

Suitable tissue-specific promoters include, but not limited to, leaf-specific promoters [e.g., AT5G06690 (Thioredoxin) (high expression, SEQ ID NO: 9411), AT5G61520 (At-STP3) (low expression, SEQ ID NO: 9412) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO: 9413 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (SEQ ID NO: 9803; U.S. Pat. No. 7,700, 835), early seed development *Arabidopsis* BAN (AT1G61720) (SEQ ID NO: 9414, US 2009/0031450 A1), late seed development *Arabidopsis* ABI3 (AT3G24650) (SEQ ID NOs: 9415 (Arabidopsis ABI3 (AT3G24650) longer Promoter) or 9802 (Arabidopsis ABI3 (AT3G24650) Promoter)) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (SEQ ID NO:9811; Albanietal, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 9806 (Wheat LMW Longer Promoter), and SEQ ID NO: 9807 (Wheat LMW Promoter) and HMW glutenin-1 [(SEQ ID NO: 9804 (Wheat HMW glutenin-1 longer Promoter)); and SEQ ID NO: 9805 (Wheat HMW glutenin-1 Promoter), Thomas and Flavell, The Plant Cell 2:1171-1180, 1990; Mol Gen Genet 216:81-90, 1989; NAR 17:461-2), wheat alpha, beta and gamma gliadins (SEQ ID NO: 9812 (wheat alpha gliadin (B genome) promoter); SEQ ID NO: 9813 (wheat gamma gliadin promoter); EMBO 3:1409-15, 1984), Barley ltr1 promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (SEQ ID NO: 9808 (Barley SS2 Promoter); Guerin and Carbonero Plant Physiology 114: 1 55-62, 1997), wheat TdPR60 [SEQ ID NO:9809 (wheat TdPR60 longer promoter) or SEQ ID NO:9810 (wheat TdPR60 promoter); Kovalchuk et al., Plant Mol Biol 71:81-98, 2009, which is fully incorporated herein by reference], barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma of al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217:240-245; 1989), *Arabidopsis* apetala-3 (Tilly et al., Development. 125:1647-57, 1998), *Arabidopsis* APETALA 1 (AT1G69120, AP1) (SEQ ID NO: 9416 (Arabidopsis (AT1G69120) APETALA 1)) (Hempel et al., Development 124:3845-3853, 1997)], and root promoters [e.g., the ROOTP promoter [SEQ ID NO: 9417]; rice ExpB5 (SEQ ID NO:9800 (rice ExpB5 Promoter); or SEQ ID NO: 9799 (rice ExpB5 longer Promoter)) and barley ExpB1 promoters (SEQ ID NO:9801) (Won et al. Mol. Cells. 30: 369-376, 2010); arabidopsis ATTPS-CIN (AT3G25820) promoter (SEQ ID NO: 9798; Chen et al., Plant Phys 135:1956-66, 2004); arabidopsis Pho 1 promoter (SEQ ID NO: 9418, Hamburger et al., Plant Cell. 14: 889-902, 2002), which is also slightly induced by stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which encapsidates the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase yield, seed yield, fiber yield, fiber quality, fiber length, growth rate, biomass, vigor, nitrogen use efficiency, fertilizer use efficiency, oil content, and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on oil content, yield, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, osmotic stress, drought, water deprivation, excess of water (e.g., flood, waterlogging), etiolation, low temperature, high temperature, heavy metal toxicity, anaerobiosis, nutrient deficiency, nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention; and (b) evaluating a trait of a plant as compared to a wild type plant of the same type (e.g., a plant not transformed with the claimed biomolecules); thereby evaluating the trait of the plant.

According to an aspect of some embodiments of the invention there is provided a method of producing a crop comprising growing a crop of a plant expressing an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 220-366, 5629-9399, 9400, 9701-9708, 9753-9795 and 9796, wherein said plant is derived from a plant selected for increased fertilizer use efficiency (e.g., nitrogen use efficiency), increased oil content, increased yield, increased growth rate, increased biomass, increased vigor, increased fiber yield, increased fiber quality, and/or increased abiotic stress tolerance as compared to a control plant, thereby producing the crop.

According to an aspect of some embodiments of the invention there is provided a method of producing a crop comprising growing a crop of a plant expressing an exogenous polynucleotide which comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-219, 367-5627, 5628, 9688-9700, 9709-9751 and 9752, wherein said plant is derived from a plant selected for increased fertilizer use efficiency (e.g., nitrogen use efficiency), increased oil content, increased yield, increased growth rate, increased biomass, increased vigor, increased fiber yield, increased fiber quality, and/or increased abiotic stress tolerance as compared to a control plant, thereby producing the crop.

According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants selected for at least one trait selected from the group consisting of increased abiotic stress tolerance, increased nitrogen use efficiency, increased biomass, increased growth rate, increased vigor, increased yield and increased fiber yield or quality as compared to a non-transformed plant.

According to some embodiments of the invention the method of growing a crop comprising seeding seeds and/or planting plantlets of a plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 220-366, 5629-9399, 9400, 9701-9708, 9753-9795 or 9796, wherein the plant is derived from plants selected for at least one trait selected from the group consisting of increased abiotic stress tolerance, increased nitrogen use efficiency, increased biomass, increased growth rate, increased vigor, increased yield, increased fiber yield or quality, and increased oil content as compared to a non-transformed plant, thereby growing the crop.

According to some embodiments of the invention the method of growing a crop comprising seeding seeds and/or planting plantlets of a plant transformed with an exogenous polynucleotide comprising the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 1-219, 367-5627, 5628, 9688-9700, 9709-9751 or 9752, wherein the plant is derived from plants selected for at least one trait selected from the group consisting of increased abiotic stress tolerance, increased nitrogen use efficiency, increased biomass, increased growth rate, increased vigor, increased yield, increased fiber yield or quality, and increased oil content as compared to a non-transformed plant, thereby growing the crop.

The effect of the transgene (the exogenous polynucleotide encoding the polypeptide) on abiotic stress tolerance can be determined using known methods such as detailed below and in the Examples section which follows.

Abiotic Stress Tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity Tolerance Assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic Tolerance Test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought Tolerance Assay/Osmoticum Assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control Arabidopsis plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold Stress Tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat Stress Tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water Use Efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \quad \text{Formula I}$$

Fertilizer Use Efficiency—To analyze whether the transgenic plants are more responsive to fertilizers, plants are grown in agar plates or pots with a limited amount of fertilizer, as described, for example, Yanagisawa et al (Proc Natl Acad Sci USA. 2004; 101:7833-8), which is fully incorporated herein by reference in its entirety. The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen Use Efficiency—To analyze whether the transgenic plants (e.g., Arabidopsis plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use Efficiency Assay Using Plantlets—The assay is done according to Yanagisawa-S. et al. with minor modifications ("Metabolic engineering with Dof1 transcription factor in plants: Improved nitrogen assimilation and growth under low-nitrogen conditions" Proc. Natl. Acad. Sci. USA 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen Determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination Tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497 which is fully incorporated herein by reference).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant Vigor—The plant vigor can be calculated by the increase in growth parameters such as leaf area, fiber length, rosette diameter, plant fresh weight and the like per time.

Growth Rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Area Growth Rate can be calculated using Formula II.

Area Growth Rate=Regression coefficient of area along time course         Formula II:

Thus, the area growth rate units are $cm^2$/day and the length and diameter growth rate units are cm/day.

Seed Yield—Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

1000 Seed Weight=number of seed in sample/sample weight×1000         Formula III:

The Harvest Index can be calculated using Formula IV.

Harvest Index=Average seed yield per plant/Average dry weight         Formula IV:

Grain Protein Concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber Length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol:// World Wide Web (dot) cottoninc (dot) com/Classification-ofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil Content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods. According to some embodiments of the invention, the oil comprises a seed oil.

According to some embodiments of the invention, the oil comprises a vegetative portion oil (oil of the vegetative portion of the plant).

According to some embodiments of the invention, the plant cell forms a part of a plant.

According to another embodiment of the present invention, there is provided a food or feed comprising the plants or a portion thereof of the present invention.

As used herein the term "about" refers to ±10%.

The terms "comprises", "comprising", "includes", "including", "having" and their conjugates mean "including but not limited to".

The term "consisting of means including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experiments support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W.H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA Extraction—Tissues growing at various growth conditions (as described below) were sampled and RNA was extracted using TRIzol Reagent from Invitrogen [Hypertext Transfer Protocol://World Wide Web (dot) invitrogen (dot) com/content (dot)cfm?pageid=469]. Approximately 30-50 mg of tissue was taken from samples. The weighed tissues were ground using pestle and mortar in liquid nitrogen and resuspended in 500 μl of TRIzol Reagent. To the homogenized lysate, 100 μl of chloroform was added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol (QIAGEN Inc, CA USA). For convenience, each microarray expression information tissue type has received an expression Set ID.

Correlation Analysis—was performed for selected genes according to some embodiments of the invention, in which the characterized parameters (measured parameters according to the correlation IDs) were used as "x axis" for correlation with the tissue transcriptome which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved nitrogen use efficiency, abiotic stress tolerance, yield, growth rate and the like).

Example 1

Bio-Informatics Tools for Identification of Genes which Increase Abiotic Stress Tolerance, Yield and Agronomical Important Traits in Plants The present inventors have identified polynucleotides which expression thereof in plants can increase abiotic stress tolerance (ABST), water use efficiency (WUE), yield, fiber yield, fiber quality, oil content, growth rate, vigor, biomass, nitrogen use efficiency (NUE), and fertilizer use efficiency (FUE) such as nitrogen use efficiency (NUE), water use efficiency (WUE) of a plant.

All nucleotide sequence datasets used here were originated from publicly available databases or from performing sequencing using the Solexa technology (e.g. Barley and *Sorghum*). Sequence data from 100 different plant species was introduced into a single, comprehensive database. Other information on gene expression, protein annotation, enzymes and pathways were also incorporated. Major databases used include:

Genomes

*Arabidopsis* genome [TAIR genome version 6 (Hypertext Transfer Protocol://World Wide Web (dot) *arabidopsis* (dot) org/)]

Rice genome [IRGSP build 4.0 (Hypertext Transfer Protocol://rgp (dot) dna (dot) affrc (dot) go (dot) jp/IRGSP/)].

Poplar [*Populus trichocarpa* release 1.1 from JGI (assembly release v1.0) (Hypertext Transfer Protocol://World Wide Web (dot) genome (dot) jgi-psf (dot) org/)]

*Brachypodium* [JGI 4× assembly, Hypertext Transfer Protocol://World Wide Web (dot) brachypodium (dot) org)]

Soybean [DOE-JGI SCP, version GlymaO (Hypertext Transfer Protocol://World Wide Web (dot) phytozome (dot) net/)]

Grape [French-Italian Public Consortium for Grapevine Genome Characterization grapevine genome (Hypertext Transfer Protocol://World Wide Web (dot) genoscope (dot) cns (dot) fr/)]

Castorbean [TIGR/J Craig Venter Institute 4× assembly [(Hypertext Transfer Protocol://msc (dot) jcvi (dot) org/r_communis]

*Sorghum* [DOE-JGI SCP, version Sbi1 [Hypertext Transfer Protocol://World Wide Web (dot) phytozome (dot) net/)].

Partially assembled genome of Maize [Hypertext Transfer Protocol://maizesequence (dot) org/]

Expressed EST and mRNA sequences were extracted from the following databases:

GenBank versions 154, 157, 160, 161, 164, 165, 166 and 168 (Hypertext Transfer Protocol://World Wide Web (dot) ncbi (dot) nlm (dot) nih (dot) gov/dbEST/)

RefSeq (Hypertext Transfer Protocol://World Wide Web (dot) ncbi (dot) nlm (dot) nih (dot) gov/RefSeq/).

TAIR (Hypertext Transfer Protocol://World Wide Web (dot) *arabidopsis* (dot) org/).

Protein and pathway databases

Uniprot [Hypertext Transfer Protocol://World Wide Web (dot) uniprot (dot) org/].

AraCyc [Hypertext Transfer Protocol://World Wide Web (dot) *arabidopsis* (dot) org/biocyc/index (dot) jsp].

ENZYME [Hypertext Transfer Protocol://expasy (dot) org/enzyme/].

Microarray datasets were downloaded from:
GEO (Hypertext Transfer Protocol://World Wide Web.ncbi.nlm.nih.gov/geo/)
TAIR (Hypertext Transfer Protocol://World Wide Web.arabidopsis.org/).
Proprietary microarray data (WO2008/122980 and the Examples section below).
QTL and SNPs information
Gramene [Hypertext Transfer Protocol://World Wide Web (dot) gramene (dot) org/qtl/].
Panzea [Hypertext Transfer Protocol://World Wide Web (dot) panzea (dot) org/index (dot) html].

Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST Clustering and Gene Assembly—For gene clustering and assembly of organisms with available genome sequence data (arabidopsis, rice, castorbean, grape, *brachypodium*, poplar, soybean, *sorghum*) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene Annotation—Predicted genes and proteins were annotated as follows:
Blast search [Hypertext Transfer Protocol://blast (dot) ncbi (dot) nlm (dot) nih (dot) gov/Blast (dot) cgi] against all plant UniProt [Hypertext Transfer Protocol://World Wide Web (dot) uniprot (dot) org/] sequences was performed. Open reading frames of each putative transcript were analyzed and longest ORF with higher number of homologues was selected as predicted protein of the transcript. The predicted proteins were analyzed by InterPro [Hypertext Transfer Protocol://World Wide Web (dot) ebi (dot) ac (dot) uk/interpro/].

Blast against proteins from AraCyc and ENZYME databases was used to map the predicted transcripts to AraCyc pathways.

Predicted proteins from different species were compared using blast algorithm [Hypertext Transfer Protocol://World Wide Web (dot) ncbi (dot) nlm (dot) nih (dot) gov/Blast (dot) cgi] to validate the accuracy of the predicted protein sequence, and for efficient detection of orthologs.

Gene Expression Profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAR and NCBI GEO sites, renormalized, and integrated into the database. Expression profiling is one of the most important resource data for identifying genes important for ABST, increased yield, growth rate, vigor, biomass, oil content, WUE, NUE and FUE of a plant.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

Example 2

Production of *Sorghum* Transcriptome and High Throughput Correlation Analysis with Yield, Nue, and Abst Related Parameters Measured in Fields Using 44K Sorguhm Oligonucleotide Micro-Arrays In order to produce a high throughput correlation analysis between plant phenotype and gene expression level, the present inventors utilized a *sorghum* oligonucleotide microarray, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 44,000 *sorghum* genes and transcripts. In order to define correlations between the levels of RNA expression with ABST, yield and NUE components or vigor related parameters, various plant characteristics of 17 different sorghum hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

I. Correlation of Sorghum Varieties Grown Under Regular Growth Conditions, Severe Drought Conditions and Low Nitrogen Conditions Experimental Procedures 17 Sorghum varieties were grown in 3 repetitive plots, in field. Briefly, the growing protocol was as follows:

1. Regular growth conditions: sorghum plants were grown in the field using commercial fertilization and irrigation protocols, which include 370 m$^3$ water per dunam (i.e., 1000 m$^2$) per entire growth period and fertilization of 14 units of URAN® 21% (Nitrogen Fertilizer Solution; PCS Sales, Northbrook, Ill., USA) (normal growth conditions).

2. Drought conditions: sorghum seeds were sown in soil and grown under normal condition until around 35 days from sowing, around stage V8 (eight green leaves are fully expanded, booting not started yet). At this point, irrigation was stopped, and severe drought stress was developed.

3. Low Nitrogen fertilization conditions: sorghum plants were fertilized with 50% less amount of nitrogen in the field than the amount of nitrogen applied in the regular growth treatment. All the fertilizer was applied before flowering.

Analyzed Sorghum Tissues—All 10 selected Sorghum hybrids were sampled per each treatment. Tissues [Flag leaf, Flower meristem and Flower] from plants growing under normal conditions, severe drought stress and low nitrogen conditions were sampled and RNA was extracted as described above. Each micro-array expression information tissue type has received a Set ID as summarized in Table 1 below.

TABLE 1

Sorghum transcriptome expression sets in field experiments

| Expression Set | Set ID |
| --- | --- |
| Sorghum Field/Flag Leaf Drought | 1 |
| Sorghum Field/Flag Leaf NUE | 2 |
| Sorghum Field/Flag Leaf Normal | 3 |
| Sorghum Field/Flower Meristem Drought | 4 |
| Sorghum Field/Flower Meristem NUE | 5 |
| Sorghum Field/Flower Meristem Normal | 6 |
| Sorghum Field/Flower Drought | 7 |
| Sorghum Field/Flower NUE | 8 |
| Sorghum Field/Flower Normal | 9 |

Table 1: Provided are the sorghum transcriptome expression set 1-9.

The following parameters were collected using digital imaging system:

Average Grain Area (cm$^2$)—At the end of the growing period the grains were separated from the Plant 'Head'. Samples of ~200 grains each were weighted, photographed and images were processed using the below described image processing system. The grain area was measured from those images and was divided by the number of grains.

Average Grain Length (cm)—At the end of the growing period the grains were separated from the Plant 'Head'. A sample of ~200 grains were weighted, photographed and images were processed using the below described image processing system. The sum of grain lengths (longest axis) was measured from those images and was divided by the number of grains.

Head Average Area (cm$^2$)—At the end of the growing period 5 'Heads' were, photographed and images were processed using the below described image processing system. The 'Head' area was measured from those images and was divided by the number of 'Heads'.

Head Average Length (cm)—At the end of the growing period 5 'Heads' were, photographed and images were processed using the below described image processing system. The 'Head' length (longest axis) was measured from those images and was divided by the number of 'Heads'.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Seed Weight Per Head (gr.)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head Per Plant Gram—At the end of the experiment (when heads were harvested) total heads and 5 selected heads per plots within blocks A-C were collected separately. The heads (total and 5) were weighted (gr.) separately, and the average fresh weight per plant was calculated for total (FW Head/Plant gr. based on plot) and for 5 (FW Head/Plant gr. based on 5 plants) heads.

Plant Height—Plants were characterized for height during growing period at 5 time points. In each measure, plants were measured for their height using a measuring tape. Height was measured from ground level to top of the longest leaf.

Plant Leaf Number—Plants were characterized for leaf number during growing period at 5 time points. In each measure, plants were measured for their leaf number by counting all the leaves of 3 selected plants per plot.

Growth Rate—was calculated using Formulas V and VI.

Growth rate of plant height=Regression coefficient of plant height along time course.     Formula V Growth rate of plant leaf number=Regression coefficient of plant leaf number along time course.     Formula VI SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative Dry Weight and Heads—At the end of the experiment (when inflorescence were dry) all inflorescence and vegetative material from plots within blocks A-C were collected. The biomass and heads weight of each plot was separated, measured and divided by the number of heads.

Dry weight=total weight of the vegetative portion above ground (excluding roots) after drying at 70° C. in oven for 48 hours;

Harvest Index (HI) (Sorghum)—The harvest index was calculated using Formula VII.

Harvest Index=Average grain dry weight per Head/ (Average vegetative dry weight per Head+Average Head dry weight)    Formula VII Harvest Index for Sorghum* (* when the plants were not dried) was calculated using Formula VIII as follows:

Harvest Index for Sorghum*=FW(fresh weight) Heads/(FW Heads+FW Plants)    Formula VIII The total fresh weight of heads and their respective plant biomass was measured at the harvest day. The heads weight was divided by the sum of weights of heads and plants.

Data parameters collected are summarized in Table 2, herein below

TABLE 2

| Sorghum correlated parameters (vectors) | |
|---|---|
| Correlated parameter with | Correlation ID |
| Average Grain Area (cm$^2$), Drought | 1 |
| Average Grain Area (cm$^2$), Low N | 2 |
| Average Grain Area (cm$^2$), Normal | 3 |
| FW-Head/Plant gr. (based on plot), Drought | 4 |
| FW-Head/Plant gr. (based on plot), Low N | 5 |
| FW-Head/Plant gr. (based on plot), Normal | 6 |
| FW-Head/Plant gr. (based on 5 plants), Low N | 7 |
| FW-Head/Plant gr. (based on 5 plants), Normal | 8 |
| FW Heads/(FW Heads + FW Plants)(all plot), Drought | 9 |
| FW Heads/(FW Heads + FW Plants)(all plot), Low N | 10 |
| FW Heads/(FW Heads + FW Plants)(all plot), Normal | 11 |
| FW/Plant gr. (based on plot), Drought | 12 |
| FW/Plant gr. (based on plot), Low N | 13 |
| FW/Plant gr. (based on plot), Normal | 14 |
| Final Plant Height (cm), Drought | 15 |
| Final Plant Height (cm), Low N | 16 |
| Final Plant Height (cm), Normal | 17 |
| Head Average Area (cm$^2$), Drought | 18 |
| Head Average Area (cm$^2$), Low N | 19 |
| Head Average Area (cm$^2$), Normal | 20 |
| Head Average Length (cm), Drought | 21 |
| Head Average Length (cm), Low N | 22 |
| Head Average Length (cm), Normal | 23 |

TABLE 2-continued

| Sorghum correlated parameters (vectors) | |
|---|---|
| Correlated parameter with | Correlation ID |
| Head Average Perimeter (cm), Drought | 24 |
| Head Average Perimeter (cm), Low N | 25 |
| Head Average Perimeter (cm), Normal | 26 |
| Head Average Width (cm), Drought | 27 |
| Head Average Width (cm), Low N | 28 |
| Head Average Width (cm), Normal | 29 |
| Leaf SPAD 64 DPS (Days Post Sowing), Drought | 30 |
| Leaf SPAD 64 DPS (Days Post Sowing), Low N | 31 |
| Leaf SPAD 64 DPS (Days Post Sowing), Normal | 32 |
| Lower Ratio Average Grain Area, Low N | 33 |
| Lower Ratio Average Grain Area, Normal | 34 |
| Lower Ratio Average Grain Length, Low N | 35 |
| Lower Ratio Average Grain Length, Normal | 36 |
| Lower Ratio Average Grain Perimeter, Low N | 37 |
| Lower Ratio Average Grain Perimeter, Normal | 38 |
| Lower Ratio Average Grain Width, Low N | 39 |
| Lower Ratio Average Grain Width, Normal | 40 |
| Total grain weight/Head (based on plot) gr., Low N | 41 |
| Total grain weight/Head gr. (based on 5 heads), Low N | 42 |
| Total grain weight/Head gr. (based on 5 heads), Normal | 43 |
| Total grain weight/Head gr. (based on plot), Normal | 44 |
| Total grain weight/Head gr.,(based on plot) Drought | 45 |
| Upper Ratio Average Grain Area, Drought | 46 |
| Upper Ratio Average Grain Area, Low N | 47 |
| Upper Ratio Average Grain Area, Normal | 48 |
| [Grain Yield + plant biomass/SPAD 64 DPS], Normal | 49 |
| [Grain Yield + plant biomass/SPAD 64 DPS], Low N | 50 |
| [Grain yield/SPAD 64 DPS], Low N | 51 |
| [Grain yield/SPAD 64 DPS], Normal | 52 |
| [Plant biomass (FW)/SPAD 64 DPS], Drought | 53 |
| [Plant biomass (FW)/SPAD 64 DPS], Low N | 54 |
| [Plant biomass (FW)/SPAD 64 DPS], Normal | 55 |

Table 2. Provided are the Sorghum correlated parameters (vectors).
"DW" = Dry Weight;
"(5I)" = Average of five Inflorescences;
"FW" = Fresh Weight;
"gr." = grams;
"cm" = centimeter;
"SPAD" = chlorophyll levels.

Experimental Results

Normal Growth Condition (for Parameters 1-55)

16 different sorghum varieties were grown and characterized for 55 parameters as described above. The average for each of the measured parameter was calculated using the JMP software and values are summarized in Tables 3-8 below. Subsequent correlation analysis between the various transcriptome sets (Table 1) and the average parameters, was conducted. Follow, results were integrated to the database.

TABLE 3

| Sorghum accessions, measured parameters under normal growth conditions | | | | | | | | |
|---|---|---|---|---|---|---|---|---|
| Ecotype/ Treatment | Line-1 | Line-2 | Line-3 | Line-4 | Line-5 | Line-6 | Line-7 | Line-8 |
| 1 | 0.10 | 0.11 | 0.11 | 0.09 | 0.09 | 0.11 | | |
| 2 | 0.11 | 0.11 | 0.14 | 0.12 | 0.14 | 0.13 | 0.12 | 0.12 |
| 3 | 0.10 | 0.11 | 0.13 | 0.13 | 0.14 | 0.14 | 0.11 | 0.11 |
| 4 | 154.90 | 122.02 | 130.51 | 241.11 | 69.03 | 186.41 | 62.11 | 39.02 |
| 5 | 214.78 | 205.05 | 73.49 | 122.96 | 153.07 | 93.23 | 134.11 | 77.43 |
| 6 | 175.15 | 223.49 | 56.40 | 111.62 | 67.34 | 66.90 | 126.18 | 107.74 |
| 7 | 388.00 | 428.67 | 297.67 | 280.00 | 208.33 | 303.67 | 436.00 | 376.33 |
| 8 | 406.50 | 518.00 | 148.00 | 423.00 | 92.00 | 101.33 | 423.50 | 386.50 |
| 9 | 0.42 | 0.47 | 0.42 | 0.37 | 0.23 | 0.31 | 0.41 | 0.44 |
| 10 | 0.51 | 0.51 | 0.17 | 0.39 | 0.21 | 0.19 | 0.48 | 0.37 |
| 11 | 0.51 | 0.51 | 0.12 | 0.26 | 0.12 | 0.18 | 0.46 | 0.43 |
| 12 | 207.99 | 138.02 | 255.41 | 402.22 | 233.55 | 391.75 | 89.31 | 50.61 |
| 13 | 204.78 | 199.64 | 340.51 | 240.60 | 537.78 | 359.40 | 149.20 | 129.06 |
| 14 | 162.56 | 212.59 | 334.83 | 313.46 | 462.28 | 318.26 | 151.13 | 137.60 |
| 15 | 89.40 | 75.73 | 92.10 | 94.30 | 150.80 | 110.73 | 99.20 | 84.00 |
| 16 | 104.00 | 80.93 | 204.73 | 125.40 | 225.40 | 208.07 | 121.40 | 100.27 |

TABLE 3-continued

Sorghum accessions, measured parameters under normal growth conditions

| Ecotype/ Treatment | Line-1 | Line-2 | Line-3 | Line-4 | Line-5 | Line-6 | Line-7 | Line-8 |
|---|---|---|---|---|---|---|---|---|
| 17 | 95.25 | 79.20 | 197.85 | 234.20 | 189.40 | 194.67 | 117.25 | 92.80 |
| 18 | 83.14 | 107.79 | 88.68 | 135.91 | 90.76 | 123.95 | 86.06 | 85.20 |
| 19 | 96.24 | 214.72 | 98.59 | 182.83 | 119.64 | 110.19 | 172.36 | 84.81 |
| 20 | 120.14 | 167.60 | 85.14 | 157.26 | 104.00 | 102.48 | 168.54 | 109.32 |
| 21 | 21.63 | 21.94 | 21.57 | 22.01 | 20.99 | 28.60 | 21.35 | 20.81 |
| 22 | 23.22 | 25.58 | 20.93 | 28.43 | 24.32 | 22.63 | 32.11 | 20.38 |
| 23 | 25.58 | 26.84 | 21.02 | 26.84 | 23.14 | 21.82 | 31.33 | 23.18 |
| 24 | 52.78 | 64.49 | 56.59 | 64.37 | 53.21 | 71.66 | 55.61 | 52.96 |
| 25 | 56.32 | 79.20 | 53.25 | 76.21 | 67.27 | 59.49 | 79.28 | 51.52 |
| 26 | 61.22 | 67.90 | 56.26 | 65.38 | 67.46 | 67.46 | 74.35 | 56.16 |
| 27 | 4.83 | 6.31 | 5.16 | 7.78 | 5.28 | 5.49 | 5.04 | 5.07 |
| 28 | 5.26 | 10.41 | 5.93 | 8.25 | 6.19 | 6.12 | 6.80 | 5.25 |
| 29 | 5.97 | 7.92 | 4.87 | 7.43 | 5.58 | 5.88 | 6.78 | 5.99 |
| 30 | 40.58 | 40.88 | 45.01 | 42.30 | 45.24 | 40.56 | 44.80 | 45.07 |
| 31 | 38.33 | 38.98 | 42.33 | 40.90 | 43.15 | 39.85 | 42.68 | 43.31 |
| 32 | 43.01 | . | 43.26 | 44.74 | 45.76 | 41.61 | 45.21 | 45.14 |
| 33 | 0.82 | 0.77 | 0.81 | 0.79 | 0.78 | 0.80 | 0.83 | 0.79 |
| 34 | 0.83 | 0.74 | 0.78 | 0.80 | 0.70 | 0.70 | 0.83 | 0.81 |
| 35 | 0.91 | 0.90 | 0.92 | 0.90 | 0.91 | 0.93 | 0.92 | 0.89 |
| 36 | 0.91 | 0.88 | 0.92 | 0.91 | 0.89 | 0.88 | 0.91 | 0.90 |
| 37 | 0.90 | 0.88 | 0.92 | 0.90 | 0.92 | 0.92 | 0.92 | 0.89 |
| 38 | 0.91 | 0.87 | 0.91 | 0.95 | 0.90 | 0.91 | 0.91 | 0.91 |
| 39 | 0.90 | 0.85 | 0.89 | 0.88 | 0.86 | 0.87 | 0.91 | 0.89 |
| 40 | 0.91 | 0.83 | 0.85 | 0.87 | 0.79 | 0.80 | 0.90 | 0.89 |
| 41 | 25.95 | 30.57 | 19.37 | 35.62 | 25.18 | 22.18 | 49.96 | 27.48 |
| 42 | 50.27 | 50.93 | 36.13 | 73.10 | 37.87 | 36.40 | 71.67 | 35.00 |
| 43 | 47.40 | 46.30 | 28.37 | 70.40 | 32.15 | 49.23 | 63.45 | 44.45 |
| 44 | 31.12 | 26.35 | 18.72 | 38.38 | 26.67 | 28.84 | 47.67 | 31.00 |
| 45 | 22.11 | 16.77 | 9.19 | 104.44 | 3.24 | 22.00 | 9.97 | 18.58 |
| 46 | 1.31 | 1.19 | 1.29 | 1.46 | 1.21 | 1.21 | | |
| 47 | 1.18 | 1.31 | 1.11 | 1.21 | 1.19 | 1.18 | 1.16 | 1.23 |
| 48 | 1.22 | 1.30 | 1.13 | 1.14 | 1.16 | 1.15 | 1.19 | 1.23 |
| 49 | 4.50 | 8.17 | 7.87 | 10.68 | 8.34 | 4.40 | 3.74 | 4.83 |
| 50 | 6.02 | 5.91 | 8.50 | 6.75 | 13.05 | 9.58 | 4.67 | 3.61 |
| 51 | 0.68 | 0.78 | 0.46 | 0.87 | 0.58 | 0.56 | 1.17 | 0.63 |
| 52 | 3.78 | 7.74 | 7.01 | 10.10 | 7.65 | 3.34 | 3.05 | 3.90 |
| 53 | 5.13 | 3.38 | 5.67 | 9.51 | 5.16 | 9.66 | 1.99 | 1.12 |
| 54 | 5.34 | 5.12 | 8.05 | 5.88 | 12.46 | 9.02 | 3.50 | 2.98 |
| 55 | 0.72 | 0.43 | 0.86 | 0.58 | 0.69 | 1.05 | 0.69 | 0.93 |

Table 3: Provided are the measured parameters under 50% irrigation conditions of Sorghum accessions (Seed ID) according to the Correlation (Corr.) ID numbers (described in Table 2 above).

TABLE 4

Sorghum accessions, addition measured parameters under normal growth conditions

| Ecotype/ Treatment | Line-9 | Line-10 | Line-11 | Line-12 | Line-13 | Line-14 | Line-15 | Line-16 | Line-17 |
|---|---|---|---|---|---|---|---|---|---|
| 2 | 0.12 | 0.13 | 0.13 | 0.12 | 0.12 | 0.11 | 0.11 | 0.12 | 0.11 |
| 3 | 0.10 | 0.12 | 0.12 | 0.11 | 0.12 | 0.11 | 0.10 | 0.11 | 0.11 |
| 4 | 58.94 | 76.37 | 33.47 | 42.20 | 41.53 | 131.67 | 60.84 | 44.33 | 185.44 |
| 5 | 129.63 | 99.83 | 76.95 | 84.25 | 92.24 | 138.83 | 113.32 | 95.50 | 129.49 |
| 6 | 123.86 | 102.75 | 82.33 | 77.59 | 91.17 | 150.44 | 109.10 | 107.58 | 130.88 |
| 7 | 474.67 | 437.67 | 383.00 | 375.00 | 425.00 | 434.00 | 408.67 | 378.50 | 432.00 |
| 8 | 409.67 | 328.95 | 391.00 | 435.75 | 429.50 | 441.00 | 415.75 | 429.50 | 428.50 |
| 9 | 0.40 | 0.44 | 0.47 | 0.47 | 0.48 | 0.35 | 0.35 | 0.23 | 0.33 |
| 10 | 0.42 | 0.44 | 0.43 | 0.39 | 0.44 | 0.44 | 0.44 | 0.43 | 0.42 |
| 11 | 0.42 | 0.44 | 0.46 | 0.45 | 0.45 | 0.51 | 0.46 | 0.44 | 0.39 |
| 12 | 87.02 | 120.43 | 37.21 | 48.18 | 44.20 | 231.60 | 116.01 | 123.08 | 342.50 |
| 13 | 178.71 | 124.27 | 101.33 | 132.12 | 117.90 | 176.99 | 143.67 | 126.98 | 180.45 |
| 14 | 167.98 | 128.97 | 97.62 | 99.32 | 112.24 | 157.42 | 130.55 | 135.66 | 209.21 |
| 15 | 99.00 | 92.20 | 81.93 | 98.80 | 86.47 | 99.60 | 83.00 | 83.53 | 92.30 |
| 16 | 121.13 | 94.53 | 110.00 | 115.07 | 104.73 | 173.67 | 115.60 | 138.80 | 144.40 |
| 17 | 112.65 | 97.50 | 98.00 | 100.00 | 105.60 | 151.15 | 117.10 | 124.45 | 126.50 |
| 18 | 113.10 | 100.79 | 80.41 | 126.89 | 86.41 | 92.29 | 77.89 | 76.93 | |
| 19 | 156.25 | 136.71 | 137.70 | 96.54 | 158.19 | 163.95 | 138.39 | 135.46 | 165.64 |
| 20 | 135.13 | 169.03 | 156.10 | 112.14 | 154.74 | 171.70 | 168.51 | 162.51 | 170.46 |
| 21 | 24.68 | 24.28 | 21.95 | 24.98 | 19.49 | 20.42 | 16.81 | 18.88 | |
| 22 | 26.69 | 26.31 | 25.43 | 23.11 | 27.87 | 28.88 | 27.64 | 25.52 | 30.33 |
| 23 | 25.70 | 28.82 | 28.13 | 22.97 | 28.09 | 30.00 | 30.54 | 27.17 | 29.26 |
| 24 | 69.83 | 65.14 | 55.27 | 69.06 | 53.32 | 56.29 | 49.12 | 51.88 | |
| 25 | 69.88 | 66.17 | 67.37 | 57.90 | 70.61 | 73.76 | 66.87 | 65.40 | 75.97 |

TABLE 4-continued

Sorghum accessions, addition measured parameters under normal growth conditions

| Ecotype/Treatment | Line-9 | Line-10 | Line-11 | Line-12 | Line-13 | Line-14 | Line-15 | Line-16 | Line-17 |
|---|---|---|---|---|---|---|---|---|---|
| 26 | 61.64 | 71.40 | 68.56 | 56.44 | 67.79 | 71.54 | 78.94 | 67.03 | 74.11 |
| 27 | 5.77 | 5.37 | 4.66 | 6.35 | 5.58 | 5.76 | 5.86 | 5.10 | |
| 28 | 7.52 | 6.59 | 6.85 | 5.32 | 7.25 | 7.19 | 6.27 | 6.57 | 6.82 |
| 29 | 6.62 | 7.42 | 6.98 | 6.19 | 7.02 | 7.18 | 7.00 | 7.39 | 7.35 |
| 30 | 40.65 | 45.43 | 42.58 | 44.18 | 44.60 | 42.41 | 43.25 | 40.30 | 40.75 |
| 31 | 39.01 | 42.71 | 40.08 | 43.98 | 45.44 | 44.75 | 42.58 | 43.81 | 46.73 |
| 32 | 43.03 | 45.59 | 44.83 | 45.33 | 46.54 | 43.99 | 45.09 | 45.14 | 43.13 |
| 33 | 0.81 | 0.77 | 0.74 | 0.80 | 0.79 | 0.82 | 0.80 | 0.81 | 0.81 |
| 34 | 0.84 | 0.79 | 0.77 | 0.80 | 0.81 | 0.82 | 0.81 | 0.82 | 0.82 |
| 35 | 0.90 | 0.91 | 0.89 | 0.90 | 0.89 | 0.91 | 0.89 | 0.89 | 0.90 |
| 36 | 0.92 | 0.92 | 0.89 | 0.91 | 0.91 | 0.91 | 0.90 | 0.90 | 0.91 |
| 37 | 0.90 | 0.91 | 0.89 | 0.90 | 0.90 | 0.91 | 0.89 | 0.90 | 0.90 |
| 38 | 0.92 | 0.93 | 0.91 | 0.92 | 0.90 | 0.91 | 0.90 | 0.91 | 0.91 |
| 39 | 0.90 | 0.86 | 0.84 | 0.90 | 0.89 | 0.91 | 0.90 | 0.90 | 0.90 |
| 40 | 0.91 | 0.85 | 0.86 | 0.88 | 0.90 | 0.90 | 0.91 | 0.90 | 0.90 |
| 41 | 51.12 | 36.84 | 29.45 | 26.70 | 29.42 | 51.12 | 37.04 | 39.85 | 41.78 |
| 42 | 76.73 | 57.58 | 42.93 | 36.47 | 68.60 | 71.80 | 49.27 | 43.87 | 52.07 |
| 43 | 56.65 | 60.00 | 45.45 | 58.19 | 70.60 | 70.10 | 53.95 | 59.87 | 52.65 |
| 44 | 39.99 | 38.36 | 32.10 | 32.69 | 32.79 | 51.53 | 35.71 | 38.31 | 42.44 |
| 45 | 29.27 | 10.45 | 14.77 | 12.86 | 18.24 | 11.60 | 18.65 | 16.36 | |
| 47 | 1.17 | 1.22 | 1.24 | 1.19 | 1.23 | 1.16 | 1.34 | 1.21 | 1.21 |
| 48 | 1.25 | 1.24 | 1.32 | 1.22 | 1.18 | 1.18 | 1.22 | 1.25 | 1.22 |
| 49 | 3.67 | 2.89 | 2.91 | 3.12 | 4.75 | 3.69 | 3.85 | 5.84 | |
| 50 | 5.89 | 3.77 | 3.26 | 3.61 | 3.24 | 5.10 | 4.25 | 3.81 | 4.76 |
| 51 | 1.31 | 0.86 | 0.73 | 0.61 | 0.65 | 1.14 | 0.87 | 0.91 | 0.89 |
| 52 | 2.83 | 2.18 | 2.19 | 2.41 | 3.58 | 2.90 | 3.01 | 4.85 | |
| 53 | 2.14 | 2.65 | 0.87 | 1.09 | 0.99 | 5.46 | 2.68 | 3.05 | 8.40 |
| 54 | 4.58 | 2.91 | 2.53 | 3.00 | 2.60 | 3.96 | 3.38 | 2.90 | 3.86 |
| 55 | 0.84 | 0.72 | 0.72 | 0.70 | 1.17 | 0.79 | 0.85 | 0.98 | |

Table 4: Provided are the measured parameters under normal growth conditions of Sorghum accessions (Seed ID) according to the Correlation (Corr.) ID numbers (described in Table 2 above).

TABLE 5

Correlation between the expression level of selected genes of some embodiments of the invention in various tissues and the phenotypic performance of maintenance of performance under drought conditions across sorghum varieties

| Gene Name | R | P value | Exp. set | Corr. Set ID | Gene Name | R | P value | Exp. set | Corr. Set ID |
|---|---|---|---|---|---|---|---|---|---|
| LYM208_H8 | 0.90 | 3.78E−04 | 6 | 17 | LYM208_H8 | 0.91 | 2.36E−04 | 6 | 44 |
| LYM208_H8 | 0.94 | 7.14E−05 | 4 | 53 | LYM208_H8 | 0.85 | 1.92E−03 | 4 | 4 |
| LYM208_H8 | 0.94 | 4.98E−05 | 4 | 12 | WYM72 | 0.76 | 1.12E−02 | 3 | 17 |
| WYM72 | 0.81 | 4.58E−03 | 3 | 44 | WYM74 | 0.92 | 1.95E−04 | 6 | 52 |
| WYM74 | 0.70 | 2.37E−02 | 6 | 14 | WYM74 | 0.90 | 4.28E−04 | 6 | 49 |
| WYM74 | 0.86 | 1.58E−03 | 3 | 3 | WYM76 | 0.76 | 1.12E−02 | 9 | 23 |
| WYM76 | 0.80 | 5.51E−03 | 9 | 44 | WYM77 | 0.83 | 3.19E−03 | 6 | 3 |
| WYM77 | 0.75 | 1.20E−02 | 9 | 44 | WYM77 | 0.76 | 1.15E−02 | 9 | 43 |
| WYM77 | 0.74 | 1.44E−02 | 8 | 41 | WYM77 | 0.83 | 3.10E−03 | 8 | 35 |
| WYM77 | 0.74 | 1.38E−02 | 8 | 42 | WYM77 | 0.78 | 7.20E−03 | 8 | 51 |
| WYM77 | 0.88 | 7.07E−04 | 8 | 37 | WYM77 | 0.72 | 1.92E−02 | 5 | 2 |
| WYM77 | 0.78 | 8.44E−03 | 3 | 32 | WYM77 | 0.78 | 8.15E−03 | 3 | 40 |
| WYM77 | 0.84 | 4.46E−03 | 3 | 55 | WYM77 | 0.70 | 2.41E−02 | 3 | 34 |
| WYM77 | 0.80 | 5.42E−03 | 7 | 15 | WYM79 | 0.86 | 1.24E−03 | 6 | 48 |
| WYM79 | 0.75 | 1.29E−02 | 9 | 3 | WYM79 | 0.78 | 8.15E−03 | 3 | 17 |
| WYM79 | 0.78 | 7.44E−03 | 3 | 44 | WYM79 | 0.75 | 1.28E−02 | 3 | 43 |
| WYM80 | 0.76 | 1.06E−02 | 9 | 17 | WYM80 | 0.74 | 1.49E−02 | 9 | 40 |
| WYM80 | 0.84 | 2.35E−03 | 9 | 44 | WYM80 | 0.81 | 4.72E−03 | 9 | 36 |
| WYM80 | 0.79 | 6.65E−03 | 9 | 34 | WYM80 | 0.72 | 2.00E−02 | 2 | 7 |
| WYM80 | 0.79 | 7.07E−03 | 2 | 41 | WYM80 | 0.80 | 4.98E−03 | 2 | 35 |
| WYM80 | 0.79 | 6.12E−03 | 2 | 42 | WYM80 | 0.83 | 3.12E−03 | 2 | 51 |
| WYM80 | 0.78 | 7.62E−03 | 2 | 37 | WYM80 | 0.84 | 2.61E−03 | 4 | 53 |
| WYM80 | 0.72 | 2.00E−02 | 4 | 4 | WYM80 | 0.84 | 2.40E−03 | 4 | 12 |
| WYM80 | 0.84 | 2.48E−03 | 8 | 33 | WYM80 | 0.71 | 2.18E−02 | 8 | 50 |
| WYM80 | 0.71 | 2.25E−02 | 8 | 39 | WYM80 | 0.91 | 2.17E−04 | 8 | 35 |
| WYM80 | 0.71 | 2.26E−02 | 5 | 19 | WYM80 | 0.77 | 9.78E−03 | 5 | 28 |
| WYM80 | 0.75 | 2.09E−02 | 7 | 18 | WYM80 | 0.82 | 6.38E−03 | 7 | 27 |
| WYM81 | 0.72 | 1.95E−02 | 4 | 30 | WYM81 | 0.78 | 7.16E−03 | 8 | 16 |
| WYM81 | 0.77 | 9.25E−03 | 3 | 17 | WYM81 | 0.75 | 1.28E−02 | 3 | 43 |
| WYM83 | 0.75 | 1.17E−02 | 9 | 43 | WYM83 | 0.77 | 9.91E−03 | 2 | 31 |

TABLE 5-continued

Correlation between the expression level of selected genes of some embodiments of the invention in various tissues and the phenotypic performance of maintenance of performance under drought conditions across sorghum varieties

| Gene Name | R | P value | Exp. set | Corr. Set ID | Gene Name | R | P value | Exp. set | Corr. Set ID |
|---|---|---|---|---|---|---|---|---|---|
| WYM83 | 0.72 | 1.81E−02 | 2 | 16 | WYM83 | 0.78 | 7.80E−03 | 8 | 33 |
| WYM83 | 0.94 | 5.34E−05 | 8 | 35 | WYM83 | 0.73 | 1.56E−02 | 8 | 42 |
| WYM83 | 0.86 | 1.25E−03 | 8 | 37 | WYM83 | 0.71 | 2.11E−02 | 3 | 17 |
| WYM83 | 0.74 | 1.37E−02 | 44 | | | | | | |

Table 5: Correlations (R) between the expression level of the genes in various tissues and the phenotypic performance. "Corr. ID"—correlation set ID according to the correlated parameters Table 2 above. "Exp. Set"—Expression set. "R" = Pearson correlation coefficient; "P" = p value.

Example 3

Production of Maize Transcriptome and High Throughput Correlation Analysis with Yield and Nue Related Parameters Using 44K Maize Oligonucleotide Micro-Arrays In order to produce a high throughput correlation analysis between plant phenotype and gene expression level, the present inventors utilized a maize oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 44,000 maize genes and transcripts. In order to define correlations between the levels of RNA expression with yield and NUE components or vigor related parameters, various plant characteristics of 12 different maize hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Maize Hybrids Across Ecotypes Grown Under Regular Growth Conditions Experimental Procedures 12 Maize hybrids were grown in 3 repetitive plots, in field. Maize seeds were planted and plants were grown in the field using commercial fertilization and irrigation protocols. In order to define correlations between the levels of RNA expression with NUE and yield components or vigor related parameters, the 12 different maize hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Analyzed Maize Tissues All 10 selected maize hybrids were sample per each treatment. Plant tissues [Flag leaf, Flower meristem, Grain, Cobs, Internodes] growing under Normal conditions were sampled and RNA was extracted as described above. Each micro-array expression information tissue type has received a Set ID as summarized in Table 6 below.

TABLE 6

Maize transcriptome expression sets

| Expression Set | Set ID |
|---|---|
| Maize field/Normal/Leaf | 1 |
| Maize field/Normal/Grain | 2 |
| Maize field/Normal/Grain distal | 3 |
| Maize field/Normal/Grain basal | 4 |
| Maize field/Normal/Internode lower | 5 |
| Maize field/Normal/Internode upper | 6 |

Table 6: Provided are the maize transcriptome expression sets.

The following parameters were collected using digital imaging system:

Grain Area ($cm^2$)—At the end of the growing period the grains were separated from the ear. A sample of ~200 grains were weight, photographed and images were processed using the below described image processing system. The grain area was measured from those images and was divided by the number of grains.

Grain Length and Grain Width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 5 ears were, photographed and images were processed using the below described image processing system. The Ear area was measured from those images and was divided by the number of Ears.

Ear Length and Ear Width (cm)—At the end of the growing period 5 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight Per Plant (gr.)—At the end of the experiment all ears from plots within blocks A-C were collected. 6 ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant Height and Ear Height—Plants were characterized for height at harvesting. In each measure, 6 plants were measured for their height using a measuring tape. Height was measured from ground level to top of the plant below the tassel. Ear height was measured from the ground level to the place were the main ear is located Leaf Number Per Plant—

Plants were characterized for leaf number during growing period at 5 time points. In each measure, plants were measured for their leaf number by counting all the leaves of 3 selected plants per plot.

The growth rate of leaf number was calculated using Formula VI as indicated above (Growth rate of plant leaf number=Regression coefficient of plant leaf number along time course).

Vegetative area growth rate=Regression coefficient of vegetative area along time course. Formula IX— Growth Rate of vegetative area SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS)

Dry Weight Per Plant—At the end of the experiment (when inflorescence were dry) all vegetative material from plots within blocks A-C were collected.

Dry weight=total weight of the vegetative portion above ground (excluding roots) after drying at 70° C. in oven for 48 hours;

Harvest Index (HI) (Maize)—The harvest index was calculated using Formula X.

Harvest Index=Average grain dry weight per Ear/ (Average vegetative dry weight per Ear+Average Ear dry weight). Formula X:

Percent Filled Ear [%]—it was calculated as the percentage of the Ear area with grains out of the total ear.

Cob Diameter [cm]—The diameter of the cob without grains was measured using a ruler.

Kernel Row Number per Ear—

The number of rows in each ear was counted.

Experimental Results 12 different maize hybrids were grown and characterized for different parameters (Table 7). The average for each of the measured parameter was calculated using the JMP software (Tables 8-9) and a subsequent correlation analysis was performed. Results were then integrated to the database.

TABLE 7

Maize correlated parameters (vectors)

| Correlated parameter with | Correlation ID |
|---|---|
| Cob Diameter-mm | 1 |
| Ear FW per Plant-gr-based on 6 | 2 |
| Ear Length-cm | 3 |
| FW per Plant-gr | 4 |
| Filled Ears per Plant | 5 |
| Growth Rate Leaf Num | 6 |
| Kernel Row Number per Ear | 7 |
| LAI | 8 |
| Normalized Grain Weight per plant-gr-based on all | 9 |
| Percent Filled Ear Length | 10 |
| Plant Height 31DPS-cm | 11 |
| Stalk Diameter Below Ear-mm | 12 |
| Stalk Diameter Lowest Internode-mm | 13 |
| Stalk Width 40DPS-mm | 14 |
| Tillers Num per Plant | 15 |

Table 7. Provided are the maize correlated parameters (vectors).

"FW" = Fresh Weight;

"gr." = grams;

"LAI" = leaf area index;

"cm" = centimeter;

"SPAD" = chlorophyll levels.

Experimental Results

Six maize accessions were grown, and characterized for parameters, as described above. The average for each parameter was calculated using the JMP software, and values are summarized in Table 8 below. Subsequent correlation between the various transcriptome sets for all or sub set of lines was done by the bioinformatics unit and results were integrated into the database.

TABLE 8

Measured parameters in Maize accessions under normal conditions

| Ecotype/Treatment | Line-1 | Line-2 | Line-3 | Line-4 | Line-5 | Line-6 |
|---|---|---|---|---|---|---|
| 1 | 26.02 | 25.47 | 25.86 | 25.28 | 24.88 | 27.44 |
| 2 | 256.21 | 251.92 | 275.11 | 226.24 | 198.30 | 344.76 |
| 3 | 22.50 | 21.21 | 22.33 | 20.78 | 19.90 | 23.39 |
| 4 | 421.94 | 258.75 | 342.50 | 326.66 | 223.06 | 560.83 |
| 5 | 1.06 | 1.11 | 1.11 | 1.00 | 1.00 | 1.56 |
| 6 | 0.16 | 0.20 | 0.22 | 0.20 | 0.21 | 0.18 |
| 7 | 15.03 | 15.06 | 14.95 | 14.42 | 14.72 | 15.25 |
| 8 | 78.96 | 90.84 | 96.42 | 124.43 | 140.71 | 42.82 |
| 9 | 156.07 | 181.81 | 166.84 | 104.15 | 86.27 | 222.40 |
| 10 | 89.19 | 89.80 | 91.09 | 87.83 | 84.58 | 91.93 |
| 11 | 162.72 | 170.78 | 168.33 | 171.25 | 165.11 | 145.11 |
| 12 | 18.42 | 18.76 | 17.84 | 16.28 | 14.14 | 19.98 |
| 13 | 26.45 | 18.71 | 25.09 | 22.75 | 19.38 | 28.37 |
| 14 | 2.68 | 2.53 | 2.18 | 2.30 | 2.18 | 2.96 |
| 15 | 0.50 | 0.58 | 0.36 | 0.06 | 0.00 | 2.00 |

Table 8. Provided are the values of each of the parameters (as described above) measured in maize accessions (Seed ID) under regular growth conditions. Growth conditions are specified in the experimental procedure section.

TABLE 9

Correlation between the expression level of selected genes of some embodiments of the invention in various tissues and the phenotypic performance of maintenance of performance under drought conditions across maize lines

| Gene Name | R | P value | Exp. set | Corr. Set ID | Gene Name | R | P value | Exp. set | Corr. Set ID |
|---|---|---|---|---|---|---|---|---|---|
| LAB278_H0 | 0.76 | 8.03E−02 | 4 | 8 | LAB278_H0 | 0.82 | 4.54E−02 | 1 | 14 |
| LAB278_H0 | 0.72 | 1.08E−01 | 1 | 15 | LAB278_H0 | 0.77 | 7.19E−02 | 1 | 7 |
| LAB278_H0 | 0.84 | 3.49E−02 | 1 | 1 | LAB278_H0 | 0.78 | 6.69E−02 | 1 | 2 |
| LAB278_H0 | 0.84 | 3.62E−02 | 1 | 13 | LAB278_H0 | 0.77 | 7.58E−02 | 1 | 9 |
| LAB278_H0 | 0.72 | 1.08E−01 | 1 | 10 | LAB278_H0 | 0.82 | 4.60E−02 | 1 | 12 |
| LAB278_H0 | 0.86 | 2.67E−02 | 1 | 4 | LAB278_H0 | 0.93 | 7.94E−03 | 1 | 3 |
| LNU74_H109 | 0.84 | 3.76E−02 | 2 | 7 | LNU74_H109 | 0.79 | 6.24E−02 | 2 | 1 |
| LNU74_H109 | 0.72 | 1.05E−01 | 2 | 2 | LNU74_H109 | 0.87 | 2.44E−02 | 2 | 13 |
| LNU74_H109 | 0.81 | 4.97E−02 | 2 | 4 | LNU74_H109 | 0.90 | 1.41E−01 | 2 | 3 |
| LNU74_H109 | 0.90 | 1.55E−02 | 1 | 8 | LNU74_H109 | 0.70 | 1.20E−01 | 5 | 2 |
| LNU74_H109 | 0.76 | 7.93E−02 | 5 | 10 | LNU74_H109 | 0.73 | 1.01E−01 | 5 | 4 |
| LYM350 | 0.71 | 1.15E−01 | 4 | 7 | LYM350 | 0.75 | 8.38E−02 | 1 | 14 |
| LYM350 | 0.77 | 7.58E−02 | 1 | 7 | LYM350 | 0.85 | 3.25E−02 | 1 | 1 |
| LYM350 | 0.80 | 5.67E−02 | 1 | 2 | LYM350 | 0.87 | 2.42E−02 | 1 | 13 |
| LYM350 | 0.79 | 6.33E−02 | 1 | 9 | LYM350 | 0.82 | 4.64E−02 | 1 | 10 |
| LYM350 | 0.84 | 3.60E−02 | 1 | 12 | LYM350 | 0.86 | 2.74E−02 | 1 | 4 |
| LYM350 | 0.95 | 3.31E−03 | 1 | 3 | LYM350 | 0.73 | 9.73E−02 | 5 | 6 |
| LYM490_H1 | 0.73 | 9.97E−02 | 5 | 10 | LYM490_H1 | 0.72 | 1.08E−01 | 5 | 3 |
| WYM104 | 0.70 | 1.18E−01 | 2 | 8 | WYM104 | 0.77 | 7.08E−02 | 1 | 8 |
| WYM105 | 0.76 | 8.19E−02 | 5 | 10 | WYM106 | 0.92 | 8.99E−03 | 2 | 13 |
| WYM106 | 0.78 | 6.67E−02 | 2 | 4 | WYM106 | 0.72 | 1.06E−01 | 2 | 3 |
| WYM106 | 0.83 | 4.18E−02 | 1 | 14 | WYM106 | 0.74 | 8.96E−02 | 1 | 15 |
| WYM107 | 0.76 | 7.91E−02 | 4 | 13 | WYM107 | 0.74 | 9.30E−02 | 4 | 3 |
| WYM107 | 0.86 | 2.87E−02 | 5 | 13 | WYM107 | 0.74 | 9.56E−02 | 5 | 10 |
| WYM107 | 0.83 | 3.97E−02 | 5 | 3 | WYM108 | 0.71 | 1.10E−01 | 2 | 14 |
| WYM108 | 0.75 | 8.84E−02 | 2 | 15 | WYM108 | 0.77 | 7.24E−02 | 2 | 1 |
| WYM108 | 0.97 | 1.14E−03 | 2 | 13 | WYM108 | 0.90 | 1.32E−02 | 2 | 4 |
| WYM108 | 0.75 | 8.66E−02 | 2 | 5 | WYM108 | 0.87 | 2.29E−02 | 2 | 3 |
| WYM108 | 0.96 | 2.85E−03 | 4 | 14 | WYM108 | 0.71 | 1.13E−01 | 4 | 15 |
| WYM108 | 0.74 | 8.94E−02 | 4 | 1 | WYM108 | 0.84 | 3.86E−02 | 4 | 13 |
| WYM108 | 0.75 | 8.65E−02 | 4 | 12 | WYM108 | 0.88 | 2.16E−02 | 4 | 4 |
| WYM108 | 0.84 | 3.60E−02 | 1 | 11 | WYM108 | 0.98 | 6.53E−04 | 1 | 8 |
| WYM108 | 0.73 | 1.01E−01 | 5 | 14 | WYM108 | 0.77 | 7.39E−02 | 5 | 13 |
| WYM108 | 0.76 | 8.21E−02 | 5 | 4 | WYM42 | 0.75 | 8.30E−02 | 4 | 15 |
| WYM42 | 0.81 | 5.10E−02 | 4 | 2 | WYM42 | 0.83 | 4.22E−02 | 4 | 9 |
| WYM42 | 0.82 | 4.65E−02 | 4 | 10 | WYM42 | 0.76 | 8.21E−02 | 4 | 12 |
| WYM42 | 0.78 | 6.62E−02 | 4 | 5 | WYM42 | 0.74 | 9.51E−02 | 5 | 10 |
| WYM42 | 0.80 | 5.77E−02 | 5 | 12 | WYM43 | 0.79 | 6.26E−02 | 2 | 11 |
| WYM43 | 0.89 | 1.79E−02 | 2 | 8 | WYM44 | 0.75 | 8.72E−02 | 1 | 8 |
| WYM44 | 0.74 | 9.07E−02 | 5 | 14 | WYM46 | 0.72 | 1.08E−01 | 4 | 9 |
| WYM46 | 0.80 | 5.41E−02 | 4 | 12 | WYM46 | 0.80 | 5.47E−02 | 1 | 8 |
| WYM47 | 0.74 | 8.96E−02 | 2 | 1 | WYM47 | 0.81 | 5.09E−02 | 2 | 2 |
| WYM47 | 0.86 | 2.73E−02 | 2 | 13 | WYM47 | 0.74 | 9.51E−02 | 2 | 9 |
| WYM47 | 0.86 | 2.99E−02 | 2 | 10 | WYM47 | 0.88 | 2.01E−02 | 2 | 3 |
| WYM47 | 0.94 | 6.10E−03 | 4 | 11 | WYM47 | 0.79 | 6.34E−02 | 4 | 8 |
| WYM47 | 0.92 | 8.73E−03 | 1 | 8 | WYM47 | 0.78 | 6.55E−02 | 5 | 6 |
| WYM48 | 0.89 | 1.72E−02 | 4 | 14 | WYM48 | 0.79 | 6.00E−02 | 4 | 15 |
| WYM48 | 0.83 | 4.27E−02 | 4 | 1 | WYM48 | 0.76 | 8.23E−02 | 4 | 13 |
| WYM48 | 0.73 | 9.69E−02 | 4 | 9 | WYM48 | 0.73 | 1.01E−01 | 4 | 12 |
| WYM48 | 0.88 | 2.02E−02 | 4 | 4 | WYM48 | 0.73 | 1.01E−01 | 4 | 5 |
| WYM48 | 0.71 | 1.14E−01 | 4 | 3 | WYM48 | 0.70 | 1.19E−01 | 5 | 14 |
| WYM48 | 0.73 | 1.01E−01 | 5 | 15 | WYM48 | 0.80 | 5.64E−02 | 5 | 7 |
| WYM48 | 0.73 | 1.03E−01 | 5 | 9 | WYM51 | 0.73 | 1.01E−01 | 2 | 13 |
| WYM51 | 0.76 | 7.92E−02 | 2 | 3 | WYM51 | 0.80 | 5.80E−02 | 4 | 13 |
| WYM51 | 0.71 | 1.10E−01 | 1 | 8 | WYM51 | 0.74 | 9.33E−02 | 5 | 14 |
| WYM51 | 0.81 | 5.10E−02 | 5 | 1 | WYM51 | 0.85 | 3.02E−02 | 5 | 2 |
| WYM51 | 0.81 | 4.98E−02 | 5 | 13 | WYM51 | 0.70 | 1.19E−01 | 5 | 9 |
| WYM51 | 0.88 | 2.19E−02 | 5 | 10 | WYM51 | 0.74 | 9.14E−02 | 5 | 12 |
| WYM51 | 0.81 | 4.82E−02 | 5 | 4 | WYM51 | 0.84 | 3.68E−02 | 5 | 3 |
| WYM52 | 0.81 | 5.32E−02 | 1 | 15 | WYM52 | 0.76 | 8.23E−02 | 1 | 1 |
| WYM52 | 0.72 | 1.10E−01 | 1 | 4 | WYM52 | 0.82 | 4.75E−02 | 1 | 5 |
| WYM55 | 0.75 | 8.69E−02 | 2 | 14 | WYM55 | 0.72 | 1.04E−01 | 2 | 13 |
| WYM55 | 0.81 | 5.13E−02 | 2 | 4 | WYM55 | 0.73 | 9.72E−02 | 4 | 1 |
| WYM55 | 0.78 | 6.90E−02 | 4 | 13 | WYM55 | 0.85 | 3.02E−02 | 4 | 4 |
| WYM55 | 0.91 | 1.13E−02 | 5 | 14 | WYM55 | 0.95 | 3.79E−03 | 5 | 15 |
| WYM55 | 0.93 | 7.25E−03 | 5 | 1 | WYM55 | 0.90 | 1.53E−02 | 5 | 2 |
| WYM55 | 0.87 | 2.58E−02 | 5 | 13 | WYM55 | 0.80 | 5.48E−02 | 5 | 9 |
| WYM55 | 0.74 | 9.06E−02 | 5 | 10 | WYM55 | 0.81 | 5.28E−02 | 5 | 12 |
| WYM55 | 0.90 | 1.50E−02 | 5 | 4 | WYM55 | 0.91 | 1.07E−02 | 5 | 5 |
| WYM55 | 0.79 | 6.04E−02 | 5 | 3 | WYM56 | 0.79 | 6.26E−02 | 1 | 8 |
| WYM56 | 0.72 | 1.09E−01 | 5 | 7 | WYM56 | 0.71 | 1.14E−01 | 5 | 9 |
| WYM57 | 0.75 | 8.34E−02 | 2 | 8 | WYM57 | 0.72 | 1.04E−01 | 4 | 11 |
| WYM57 | 0.75 | 8.77E−02 | 4 | 6 | WYM57 | 0.88 | 2.07E−02 | 1 | 8 |

TABLE 9-continued

Correlation between the expression level of selected genes of some embodiments of the invention in various tissues and the phenotypic performance of maintenance of performance under drought conditions across maize lines

| Gene Name | R | P value | Exp. set | Corr. Set ID | Gene Name | R | P value | Exp. set | Corr. Set ID |
|---|---|---|---|---|---|---|---|---|---|
| WYM57 | 0.80 | 5.54E−02 | 5 | 8 | WYM58 | 0.78 | 6.80E−02 | 4 | 15 |
| WYM58 | 0.76 | 8.01E−02 | 4 | 1 | WYM58 | 0.78 | 6.65E−02 | 4 | 4 |
| WYM58 | 0.82 | 4.62E−02 | 4 | 5 | WYM58 | 0.71 | 1.13E−01 | 1 | 9 |
| WYM58 | 0.73 | 9.73E−02 | 1 | 10 | WYM58 | 0.74 | 9.07E−02 | 1 | 12 |
| WYM58 | 0.85 | 3.38E−02 | 5 | 8 | WYM59 | 0.84 | 3.64E−02 | 2 | 1 |
| WYM59 | 0.78 | 6.84E−02 | 2 | 2 | WYM59 | 0.95 | 3.51E−03 | 2 | 13 |
| WYM59 | 0.91 | 1.26E−02 | 2 | 4 | WYM59 | 0.72 | 1.07E−01 | 2 | 5 |
| WYM59 | 0.80 | 5.71E−02 | 2 | 3 | WYM60 | 0.72 | 1.08E−01 | 4 | 10 |
| WYM60 | 0.94 | 4.67E−03 | 1 | 14 | WYM60 | 0.96 | 2.41E−03 | 1 | 15 |
| WYM60 | 0.84 | 3.65E−02 | 1 | 7 | WYM60 | 0.99 | 2.79E−04 | 1 | 1 |
| WYM60 | 0.98 | 9.07E−04 | 1 | 2 | WYM60 | 0.77 | 7.26E−02 | 1 | 13 |
| WYM60 | 0.92 | 9.66E−03 | 1 | 9 | WYM60 | 0.82 | 4.37E−02 | 1 | 10 |
| WYM60 | 0.87 | 2.40E−02 | 1 | 12 | WYM60 | 0.92 | 8.62E−03 | 1 | 4 |
| WYM60 | 0.93 | 7.16E−03 | 1 | 5 | WYM60 | 0.93 | 7.76E−03 | 1 | 3 |
| WYM61 | 0.97 | 1.27E−03 | 1 | 14 | WYM61 | 0.84 | 3.79E−02 | 1 | 15 |
| WYM61 | 0.79 | 5.91E−02 | 1 | 1 | WYM61 | 0.82 | 4.69E−02 | 1 | 4 |
| WYM61 | 0.75 | 8.30E−02 | 1 | 5 | WYM61 | 0.96 | 2.90E−03 | 5 | 14 |
| WYM61 | 0.85 | 3.04E−02 | 5 | 15 | WYM61 | 0.71 | 1.10E−01 | 5 | 7 |
| WYM61 | 0.91 | 1.11E−02 | 5 | 1 | WYM61 | 0.83 | 4.06E−02 | 5 | 2 |
| WYM61 | 0.80 | 5.41E−02 | 5 | 13 | WYM61 | 0.77 | 7.23E−02 | 5 | 9 |
| WYM61 | 0.82 | 4.58E−02 | 5 | 12 | WYM61 | 0.93 | 6.82E−03 | 5 | 4 |
| WYM61 | 0.77 | 7.24E−02 | 5 | 5 | WYM61 | 0.88 | 2.19E−02 | 5 | 3 |
| WYM62 | 0.71 | 1.13E−01 | 4 | 9 | WYM62 | 0.91 | 1.15E−02 | 5 | 14 |
| WYM62 | 0.84 | 3.73E−02 | 5 | 15 | WYM62 | 0.81 | 5.05E−02 | 5 | 7 |
| WYM62 | 0.92 | 9.43E−03 | 5 | 1 | WYM62 | 0.85 | 3.29E−02 | 5 | 2 |
| WYM62 | 0.83 | 3.86E−02 | 5 | 13 | WYM62 | 0.83 | 3.87E−02 | 5 | 9 |
| WYM62 | 0.76 | 8.20E−02 | 5 | 10 | WYM62 | 0.87 | 2.29E−02 | 5 | 12 |
| WYM62 | 0.93 | 7.66E−03 | 5 | 4 | WYM62 | 0.76 | 8.00E−02 | 5 | 5 |
| WYM62 | 0.93 | 6.96E−03 | 5 | 3 | WYM63 | 0.73 | 9.91E−02 | 2 | 14 |
| WYM63 | 0.81 | 4.94E−02 | 2 | 15 | WYM63 | 0.80 | 5.62E−02 | 2 | 7 |
| WYM63 | 0.87 | 2.40E−02 | 2 | 1 | WYM63 | 0.93 | 6.48E−03 | 2 | 2 |
| WYM63 | 0.97 | 9.98E−04 | 2 | 9 | WYM63 | 0.98 | 8.42E−04 | 2 | 10 |
| WYM63 | 0.98 | 7.24E−04 | 2 | 12 | WYM63 | 0.77 | 7.59E−02 | 2 | 4 |
| WYM63 | 0.77 | 7.34E−02 | 2 | 5 | WYM63 | 0.93 | 7.59E−03 | 2 | 3 |
| WYM63 | 0.71 | 1.14E−01 | 4 | 13 | WYM63 | 0.72 | 1.04E−01 | 1 | 10 |
| WYM64 | 0.73 | 9.94E−02 | 2 | 8 | WYM65 | 0.86 | 2.69E−02 | 4 | 14 |
| WYM65 | 0.79 | 6.15E−02 | 4 | 9 | WYM65 | 0.89 | 1.77E−02 | 4 | 12 |
| WYM65 | 0.95 | 3.57E−03 | 1 | 14 | WYM65 | 0.80 | 5.45E−02 | 1 | 15 |
| WYM65 | 0.85 | 3.37E−02 | 1 | 7 | WYM65 | 0.79 | 5.88E−02 | 1 | 1 |
| WYM65 | 0.72 | 1.05E−01 | 1 | 2 | WYM65 | 0.78 | 6.67E−02 | 1 | 9 |
| WYM65 | 0.81 | 5.33E−02 | 1 | 12 | WYM65 | 0.81 | 5.30E−02 | 1 | 4 |
| WYM65 | 0.71 | 1.12E−01 | 1 | 5 | WYM65 | 0.78 | 6.69E−02 | 1 | 3 |
| WYM65 | 0.90 | 1.39E−02 | 5 | 14 | WYM65 | 0.97 | 1.40E−03 | 5 | 15 |
| WYM65 | 0.83 | 4.25E−02 | 5 | 7 | WYM65 | 0.99 | 1.29E−04 | 5 | 1 |
| WYM65 | 0.99 | 2.82E−04 | 5 | 2 | WYM65 | 0.84 | 3.52E−02 | 5 | 13 |
| WYM65 | 0.94 | 5.10E−03 | 5 | 9 | WYM65 | 0.89 | 1.75E−02 | 5 | 10 |
| WYM65 | 0.91 | 1.21E−02 | 5 | 12 | WYM65 | 0.94 | 5.74E−03 | 5 | 4 |
| WYM65 | 0.93 | 6.24E−03 | 5 | 5 | WYM65 | 0.97 | 1.66E−03 | 5 | 3 |
| WYM66 | 0.76 | 7.82E−02 | 4 | 12 | WYM66 | 0.89 | 1.73E−02 | 1 | 8 |
| WYM67 | 0.76 | 8.19E−02 | 4 | 14 | WYM67 | 0.92 | 9.94E−03 | 4 | 15 |
| WYM67 | 0.94 | 6.11E−03 | 4 | 1 | WYM67 | 0.89 | 1.87E−02 | 4 | 2 |
| WYM67 | 0.79 | 6.29E−02 | 4 | 13 | WYM67 | 0.92 | 8.36E−03 | 4 | 4 |
| WYM67 | 0.94 | 5.61E−03 | 4 | 5 | WYM67 | 0.76 | 7.92E−02 | 4 | 3 |
| WYM67 | 0.72 | 1.08E−01 | 1 | 8 | WYM67 | 0.70 | 1.20E−01 | 5 | 10 |
| WYM69 | 0.86 | 2.68E−02 | 4 | 14 | WYM69 | 0.71 | 1.16E−01 | 4 | 7 |
| WYM69 | 0.72 | 1.08E−01 | 4 | 9 | WYM69 | 0.75 | 8.28E−02 | 4 | 12 |
| WYM69 | 0.93 | 7.43E−03 | 1 | 8 | WYM69 | 0.81 | 5.30E−02 | 5 | 10 |
| WYM98 | 0.77 | 7.43E−02 | 2 | 7 | WYM98 | 0.76 | 8.12E−02 | 5 | 14 |
| WYM98 | 0.86 | 2.98E−02 | 5 | 15 | WYM98 | 0.85 | 3.25E−02 | 5 | 1 |
| WYM98 | 0.82 | 4.46E−02 | 5 | 2 | WYM98 | 0.78 | 6.57E−02 | 5 | 13 |
| WYM98 | 0.77 | 7.61E−02 | 5 | 10 | WYM98 | 0.78 | 6.88E−02 | 5 | 12 |
| WYM98 | 0.90 | 1.51E−02 | 5 | 4 | WYM98 | 0.89 | 1.85E−02 | 5 | 5 |
| WYM98 | 0.77 | 7.11E−02 | 5 | 3 | | | | | |

Table 9. Correlations (R) between the genes expression levels in various tissues and the phenotypic performance. "Corr. ID"—correlation set ID according to the correlated parameters Table 7 above. "Exp. Set"—Expression set. "R" = Pearson correlation coefficient; "P" = p value.

Example 4

Production of Maize Transcriptome and High Throughput Correlation Analysis Using 60K Maize Oligonucleotide Micro-Array To produce a high throuhput correlation analysis, the present inventors utilized a Maize oligonucleotide microarray, produced by Agilent Technologies [Hypertxt Transfer Protocol://World Wide Web (dot) chem. (dot) agilent (dot) com/Scripts/PDS (dot) asp?1Page=50879]. The array oligonucleotide represents about 60K Maize genes and transcripts designed based on data from Public databases (Example 1). To define correlations between the levels of RNA expression and yield, biomass components or vigor related parameters, various plant characteristics of 12 different Maize hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

12 Hybrid plants were grown in the field under normal growth conditions. Five tissues at different developmental stages including Ear (flowering—R1), leaf (flowering—R1), Leaf Grain from the basal ear part, Grain from the distal ear, representing different plant characteristics, were sampled and RNA was extracted as described in "GENERAL EXPERIMENTAL AND BIOINFORMATICS METHODS". For convenience, each micro-array expression information tissue type has received a Set ID as summarized in Table 10 below.

TABLE 10

Tissues used for Maize transcriptome expression sets

| Expression Set | Set ID |
| --- | --- |
| Ear normal Flowering-R1 | 1 |
| Ear normal R2-R3 | 2 |
| Internode normal V6 | 3 |
| Internode normal Flowering-R1 | 4 |
| Internode normal R2-R3 | 5 |
| Leaf normal V6 | 6 |
| Leaf normal Flowering-R1 | 7 |
| Distal grain normal R3-R5 | 8 |

Table 10: Provided are the identification (ID) letters of each of the Maize expression sets (1-8).

The following parameters were collected:

Grain Area ($cm^2$)—At the end of the growing period the grains were separated from the ear. A sample of ~200 grains were weight, photographed and images were processed using the below described image processing system. The grain area was measured from those images and was divided by the number of grains.

Grain Length and Grain Width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 6 ears were, photographed and images were processed using the below described image processing system. The Ear area was measured from those images and was divided by the number of Ears.

Ear Length and Ear Width (cm)—At the end of the growing period 6 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight Per Plant (gr.)—At the end of the experiment all ears from plots within blocks A-C were collected. 6 ears were separately threshed and grains were weighted, all additional ears were threshed together and weighted as well. The grain weight was normalized using the relative humidity to be 0%. The normalized average grain weight per ear was calculated by dividing the total normalized grain weight by the total number of ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant Height and Ear Height—Plants were characterized for height at harvesting. In each measure, 6 plants were measured for their height using a measuring tape. Height was measured from ground level to top of the plant below the tassel. Ear height was measured from the ground level to the place were the main ear is located Leaf Number Per Plant—Plants were characterized for leaf number during growing period at 5 time points. In each measure, plants were measured for their leaf number by counting all the leaves of 3 selected plants per plot.

Growth Rate was calculated using regression coefficient of leaf number change a long time course.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Dry Weight Per Plant—At the end of the experiment when all vegetative material from plots within blocks A-C were collected, weighted and divided by the number of plants.

Ear Diameter [cm]—The diameter of the ear at the mid of the ear was measured using a ruler.

Cob Diameter [cm]—The diameter of the cob without grains was measured using a ruler.

Kernel Row Number per Ear—The number of rows in each ear was counted. The average of 6 ears per plot was calculated.

TABLE 11

Maize correlated parameters (vectors)

| Correlated parameter with | Correlation ID |
|---|---|
| Cob Diameter mm | 1 |
| DW per Plant based on 6 gr. | 2 |
| Ear Area cm$^2$ | 3 |
| Ear FW per Plant based on 6 gr. | 4 |
| Ear Height cm | 5 |
| Ear Length cm | 6 |
| Ear Width cm | 7 |
| Ears FW per plant based on all gr. | 8 |
| Filled per Whole Ear | 9 |
| Grain Area cm$^2$ | 10 |
| Grain Length cm | 11 |
| Grain Width cm | 12 |
| Growth Rate Leaf Num | 13 |
| Kernel Row Number per Ear | 14 |
| Leaf Number per Plant | 15 |
| Normalized Grain Weight per Plant based on all gr. | 16 |
| Normalized Grain Weight per plant based on 6 gr. | 17 |
| Percent Filled Ear | 18 |
| Plant Height per Plot cm | 19 |
| SPAD 46DPS TP2 | 20 |
| SPAD 54DPS TP5 | 21 |

Table 11. Provided are the maize correlated parameters (vectors).
"DW" = Dry Weight;
"FW" = Fresh Weight;
"gr." = grams;
"cm" = centimeter;
"SPAD" = chlorophyll levels.
"TP2" = time point 2;
"TP5" = time point 5.

Experimental Results

Twelve maize accessions were grown, and characterized for parameters, as described above. The average for each parameter was calculated using the JMP software, and values are summarized in Tables 12-13 below. Subsequent correlation between the various transcriptome sets for all or sub set of lines was done by the bioinformatics unit and results were integrated into the database.

TABLE 12

Measured parameters in Maize Hybrid

| Ecotype/Treatment | Line-1 | Line-2 | Line-3 | Line-4 | Line-5 | Line-6 | Line-7 | Line-8 |
|---|---|---|---|---|---|---|---|---|
| 1 | 28.96 | 23.78 | 28.05 | 25.73 | 28.72 | 25.78 | 26.43 | 25.19 |
| 2 | 657.50 | 472.02 | 641.11 | 580.56 | 655.56 | 569.44 | 511.11 | 544.44 |
| 3 | 85.06 | 77.91 | 90.51 | 95.95 | 91.62 | 72.41 | 74.03 | 76.53 |
| 4 | 245.83 | 189.88 | 262.22 | 263.89 | 272.22 | 177.78 | 188.89 | 197.22 |
| 5 | 135.17 | 116.31 | 131.97 | 114.00 | 135.28 | 94.28 | 120.94 | 107.72 |
| 6 | 19.69 | 19.05 | 20.52 | 21.34 | 20.92 | 18.23 | 19.02 | 18.57 |
| 7 | 5.58 | 5.10 | 5.67 | 5.53 | 5.73 | 5.23 | 5.22 | 5.33 |
| 8 | 278.19 | 190.30 | 288.28 | 247.88 | 280.11 | 175.84 | 192.47 | 204.70 |
| 9 | 0.92 | 0.95 | 0.93 | 0.92 | 0.91 | 0.95 | 0.87 | 0.94 |
| 10 | 0.75 | 0.67 | 0.75 | 0.77 | 0.81 | 0.71 | 0.71 | 0.75 |
| 11 | 1.17 | 1.07 | 1.18 | 1.20 | 1.23 | 1.12 | 1.14 | 1.13 |
| 12 | 0.81 | 0.79 | 0.80 | 0.80 | 0.82 | 0.80 | 0.79 | 0.84 |
| 13 | 0.28 | 0.22 | 0.28 | 0.27 | 0.31 | 0.24 | 0.24 | 0.27 |
| 14 | 16.17 | 15.02 | 16.20 | 15.89 | 16.17 | 15.17 | 16.00 | 14.83 |
| 15 | 12.00 | 8.40 | 11.69 | 11.78 | 11.94 | 12.33 | 12.44 | 12.22 |
| 16 | 153.90 | 120.96 | 152.50 | 159.16 | 140.46 | 117.14 | 123.24 | 131.27 |
| 17 | 140.68 | 128.93 | 153.67 | 176.98 | 156.61 | 119.67 | 119.69 | 133.51 |
| 18 | 80.62 | 94.34 | 82.14 | 92.71 | 80.38 | 82.76 | 73.25 | 81.06 |
| 19 | 278.08 | 269.79 | 275.13 | 238.50 | 286.94 | 224.83 | 264.44 | 251.61 |
| 21 | 54.28 | 57.18 | 56.01 | 59.68 | 54.77 | 59.14 | 57.99 | 60.36 |
| 20 | 51.67 | 56.41 | 53.55 | 55.21 | 55.30 | 59.35 | 58.48 | 55.88 |

Table 12. Provided are the measured parameters under normal growth conditions of maize accessions according to the Correlation (Corr.) ID numbers (described in Table 16 above).

TABLE 13

Measured parameters in Maize Hybrid additional parameters

| Ecotype/Treatment | Line-9 | Line-10 | Line-11 | Line-12 |
|---|---|---|---|---|
| 1 |  |  | 26.67 |  |
| 2 |  | 574.17 | 522.22 |  |
| 3 |  | 55.20 | 95.36 |  |
| 4 |  | 141.11 | 261.11 |  |
| 5 |  | 60.44 | 112.50 |  |
| 6 |  | 16.69 | 21.70 |  |
| 7 |  | 4.12 | 5.58 |  |
| 8 |  | 142.72 | 264.24 |  |
| 9 |  | 0.80 | 0.96 |  |
| 10 |  | 0.50 | 0.76 |  |
| 11 |  | 0.92 | 1.18 |  |
| 12 |  | 0.67 | 0.81 |  |
| 13 |  | 0.19 | 0.30 |  |
| 14 |  | 14.27 | 15.39 |  |
| 15 |  | 9.28 | 12.56 |  |
| 16 |  | 40.84 | 170.66 |  |
| 17 |  | 54.32 | 173.23 |  |
| 18 |  | 81.06 | 91.60 |  |
| 19 |  | 163.78 | 278.44 |  |
| 21 | 54.77 | 51.39 | 61.14 | 53.34 |
| 20 | 52.98 | 53.86 | 59.75 | 49.99 |

Table 13. Provided are the measured parameters under normal growth conditions of maize accessions according to the Correlation (Corr.) ID numbers (described in Table 16 above).

TABLE 14

Correlation between the expression level of selected genes of some embodiments of the invention in various tissues and the phenotypic performance of maintenance of performance under drought conditions across maize lines

| Gene Name | R | P value | Exp. set | Corr. Set ID | Gene Name | R | P value | Exp. set | Corr. Set ID |
|---|---|---|---|---|---|---|---|---|---|
| LAB278_H0 | 0.79 | 6.01E-02 | 2 | 9 | LAB278_H0 | 0.77 | 7.11E-02 | 2 | 18 |
| LNU74_H109 | 0.74 | 5.73E-02 | 1 | 16 | LNU74_H109 | 0.81 | 2.65E-02 | 1 | 15 |
| LNU74_H109 | 0.82 | 2.31E-02 | 1 | 13 | LNU74_H109 | 0.73 | 6.23E-02 | 1 | 11 |
| LNU74_H109 | 0.71 | 7.22E-02 | 1 | 9 | LNU74_H109 | 0.73 | 6.08E-02 | 1 | 10 |
| LNU74_H109 | 0.72 | 6.53E-02 | 1 | 7 | LNU74_H109 | 0.76 | 1.86E-02 | 3 | 15 |
| LNU74_H109 | 0.78 | 6.95E-02 | 2 | 6 | LNU74_H109 | 0.73 | 9.68E-02 | 2 | 18 |
| LYM350 | 0.75 | 3.19E-02 | 5 | 15 | LYM350 | 0.86 | 5.88E-03 | 5 | 11 |
| LYM350 | 0.81 | 1.50E-02 | 5 | 10 | LYM350 | 0.78 | 3.76E-02 | 7 | 2 |
| LYM350 | 0.81 | 1.58E-02 | 8 | 1 | LYM350 | 0.77 | 2.58E-02 | 8 | 13 |
| LYM350 | 0.85 | 7.38E-03 | 8 | 2 | LYM350 | 0.71 | 4.75E-02 | 8 | 5 |
| LYM350 | 0.81 | 1.46E-02 | 8 | 7 | LYM350 | 0.82 | 1.19E-02 | 8 | 8 |
| LYM350 | 0.75 | 3.39E-02 | 8 | 4 | LYM350 | 0.80 | 5.47E-02 | 2 | 9 |
| LYM350 | 0.86 | 2.75E-02 | 2 | 12 | LYM350 | 0.72 | 6.99E-02 | 4 | 15 |
| LYM490_H1 | 0.97 | 2.52E-04 | 7 | 3 | LYM490_H1 | 0.99 | 3.12E-05 | 7 | 16 |
| LYM490_H1 | 0.81 | 2.83E-02 | 7 | 14 | LYM490_H1 | 0.86 | 1.26E-02 | 7 | 13 |
| LYM490_H1 | 0.81 | 2.65E-02 | 7 | 21 | LYM490_H1 | 0.94 | 1.56E-03 | 7 | 11 |
| LYM490_H1 | 0.94 | 1.57E-03 | 7 | 6 | LYM490_H1 | 0.83 | 2.21E-02 | 7 | 9 |
| LYM490_H1 | 0.92 | 3.00E-03 | 7 | 10 | LYM490_H1 | 0.84 | 1.72E-02 | 7 | 18 |
| LYM490_H1 | 0.87 | 1.13E-02 | 7 | 19 | LYM490_H1 | 0.87 | 1.14E-02 | 7 | 5 |
| LYM490_H1 | 0.95 | 1.25E-03 | 7 | 7 | LYM490_H1 | 0.83 | 1.97E-02 | 7 | 8 |
| LYM490_H1 | 0.83 | 2.13E-02 | 7 | 12 | LYM490_H1 | 0.90 | 5.79E-03 | 7 | 4 |
| LYM490_H1 | 0.99 | 9.71E-06 | 7 | 17 | WYM104 | 0.76 | 2.85E-02 | 5 | 9 |
| WYM104 | 0.70 | 1.21E-01 | 4 | 1 | WYM104 | 0.83 | 2.21E-02 | 4 | 14 |
| WYM104 | 0.84 | 1.72E-02 | 7 | 3 | WYM104 | 0.74 | 5.98E-02 | 7 | 16 |
| WYM104 | 0.77 | 4.37E-02 | 7 | 14 | WYM104 | 0.87 | 1.16E-02 | 7 | 6 |
| WYM104 | 0.82 | 2.27E-02 | 7 | 18 | WYM104 | 0.79 | 3.32E-02 | 7 | 4 |
| WYM104 | 0.79 | 3.32E-02 | 7 | 17 | WYM104 | 0.75 | 1.90E-02 | 3 | 15 |
| WYM104 | 0.74 | 2.34E-02 | 3 | 11 | WYM104 | 0.74 | 2.19E-02 | 3 | 10 |
| WYM104 | 0.73 | 2.47E-02 | 3 | 7 | WYM104 | 0.71 | 3.15E-02 | 3 | 12 |
| WYM105 | 0.70 | 5.09E-02 | 5 | 18 | WYM105 | 0.74 | 5.54E-02 | 4 | 14 |
| WYM105 | 0.74 | 5.90E-02 | 4 | 5 | WYM105 | 0.81 | 4.82E-02 | 7 | 1 |
| WYM105 | 0.86 | 1.28E-02 | 1 | 9 | WYM105 | 0.86 | 1.31E-02 | 1 | 19 |
| WYM105 | 0.81 | 2.65E-02 | 1 | 5 | WYM105 | 0.71 | 7.62E-02 | 1 | 12 |
| WYM105 | 0.74 | 3.68E-02 | 8 | 15 | WYM105 | 0.85 | 3.10E-02 | 2 | 3 |
| WYM105 | 0.88 | 1.97E-02 | 2 | 16 | WYM105 | 0.85 | 3.38E-02 | 2 | 13 |
| WYM105 | 0.80 | 5.53E-02 | 2 | 11 | WYM105 | 0.82 | 4.66E-02 | 2 | 6 |
| WYM105 | 0.75 | 8.50E-02 | 2 | 18 | WYM105 | 0.78 | 6.78E-02 | 2 | 7 |
| WYM105 | 0.76 | 7.98E-02 | 2 | 8 | WYM105 | 0.82 | 4.37E-02 | 2 | 4 |
| WYM105 | 0.81 | 4.85E-02 | 2 | 17 | WYM106 | 0.83 | 1.12E-02 | 8 | 1 |
| WYM106 | 0.75 | 3.16E-02 | 8 | 13 | WYM106 | 0.81 | 1.41E-02 | 8 | 2 |
| WYM107 | 0.77 | 7.33E-02 | 4 | 1 | WYM107 | 0.80 | 3.13E-02 | 4 | 2 |
| WYM107 | 0.72 | 6.78E-02 | 1 | 12 | WYM107 | 0.78 | 6.76E-02 | 2 | 14 |
| WYM107 | 0.76 | 7.67E-02 | 2 | 2 | WYM108 | 0.71 | 4.92E-02 | 5 | 10 |
| WYM108 | 0.88 | 2.08E-02 | 4 | 1 | WYM108 | 0.87 | 1.12E-02 | 4 | 3 |
| WYM108 | 0.81 | 2.62E-02 | 4 | 16 | WYM108 | 0.98 | 1.20E-04 | 4 | 14 |
| WYM108 | 0.76 | 4.77E-02 | 4 | 13 | WYM108 | 0.88 | 9.41E-03 | 4 | 11 |
| WYM108 | 0.83 | 2.07E-02 | 4 | 6 | WYM108 | 0.78 | 4.00E-02 | 4 | 10 |
| WYM108 | 0.75 | 5.26E-02 | 4 | 5 | WYM108 | 0.84 | 1.72E-02 | 4 | 7 |
| WYM108 | 0.87 | 1.11E-02 | 4 | 8 | WYM108 | 0.90 | 5.64E-03 | 4 | 4 |
| WYM108 | 0.83 | 1.97E-02 | 4 | 17 | WYM108 | 0.76 | 4.64E-02 | 7 | 3 |
| WYM108 | 0.77 | 4.13E-02 | 7 | 16 | WYM108 | 0.76 | 4.79E-02 | 7 | 6 |
| WYM108 | 0.77 | 4.08E-02 | 7 | 9 | WYM108 | 0.88 | 8.87E-03 | 7 | 18 |
| WYM108 | 0.87 | 1.08E-02 | 7 | 19 | WYM108 | 0.77 | 4.20E-02 | 7 | 5 |
| WYM108 | 0.78 | 4.00E-02 | 7 | 17 | WYM108 | 0.79 | 3.51E-02 | 1 | 9 |
| WYM108 | 0.77 | 4.11E-02 | 1 | 19 | WYM108 | 0.92 | 1.06E-03 | 8 | 3 |
| WYM108 | 0.82 | 1.35E-02 | 8 | 16 | WYM108 | 0.71 | 4.90E-02 | 8 | 14 |
| WYM108 | 0.78 | 2.29E-02 | 8 | 13 | WYM108 | 0.82 | 1.17E-02 | 8 | 11 |
| WYM108 | 0.89 | 3.31E-03 | 8 | 6 | WYM108 | 0.74 | 3.54E-02 | 8 | 10 |
| WYM108 | 0.82 | 1.19E-02 | 8 | 2 | WYM108 | 0.92 | 1.30E-03 | 8 | 7 |
| WYM108 | 0.90 | 2.59E-03 | 8 | 8 | WYM108 | 0.95 | 2.85E-04 | 8 | 4 |
| WYM108 | 0.85 | 7.71E-03 | 8 | 17 | WYM108 | 0.72 | 1.93E-02 | 6 | 19 |
| WYM108 | 0.84 | 4.53E-03 | 3 | 15 | WYM108 | 0.79 | 1.07E-02 | 3 | 11 |
| WYM108 | 0.79 | 1.07E-02 | 3 | 10 | WYM108 | 0.72 | 2.86E-02 | 3 | 7 |
| WYM108 | 0.75 | 1.91E-02 | 3 | 12 | WYM108 | 0.73 | 9.70E-02 | 2 | 3 |
| WYM108 | 0.77 | 7.48E-02 | 2 | 6 | WYM108 | 0.71 | 1.15E-01 | 2 | 10 |
| WYM108 | 0.82 | 4.75E-02 | 2 | 17 | WYM42 | 0.71 | 7.65E-02 | 4 | 14 |
| WYM42 | 0.70 | 7.93E-02 | 7 | 19 | WYM42 | 0.88 | 9.54E-03 | 1 | 3 |
| WYM42 | 0.85 | 1.60E-02 | 1 | 16 | WYM42 | 0.73 | 6.10E-02 | 1 | 14 |
| WYM42 | 0.72 | 6.79E-02 | 1 | 11 | WYM42 | 0.89 | 7.62E-03 | 1 | 6 |
| WYM42 | 0.71 | 7.23E-02 | 1 | 9 | WYM42 | 0.76 | 4.76E-02 | 1 | 18 |
| WYM42 | 0.87 | 1.07E-02 | 1 | 19 | WYM42 | 0.83 | 2.12E-02 | 1 | 5 |
| WYM42 | 0.78 | 3.92E-02 | 1 | 7 | WYM42 | 0.79 | 3.41E-02 | 1 | 8 |

TABLE 14-continued

Correlation between the expression level of selected genes of some embodiments of the invention in various tissues and the phenotypic performance of maintenance of performance under drought conditions across maize lines

| Gene Name | R | P value | Exp. set | Corr. Set ID | Gene Name | R | P value | Exp. set | Corr. Set ID |
|---|---|---|---|---|---|---|---|---|---|
| WYM42 | 0.82 | 2.48E−02 | 1 | 4 | WYM42 | 0.85 | 1.65E−02 | 1 | 17 |
| WYM42 | 0.78 | 1.29E−02 | 6 | 1 | WYM42 | 0.72 | 1.10E−01 | 2 | 12 |
| WYM43 | 0.82 | 2.32E−02 | 1 | 3 | WYM43 | 0.80 | 3.01E−02 | 1 | 16 |
| WYM43 | 0.80 | 3.06E−02 | 1 | 11 | WYM43 | 0.77 | 4.38E−02 | 1 | 6 |
| WYM43 | 0.79 | 3.34E−02 | 1 | 10 | WYM43 | 0.70 | 7.78E−02 | 1 | 19 |
| WYM43 | 0.80 | 3.09E−02 | 1 | 5 | WYM43 | 0.76 | 4.81E−02 | 1 | 7 |
| WYM43 | 0.71 | 7.66E−02 | 1 | 8 | WYM43 | 0.73 | 6.11E−02 | 1 | 12 |
| WYM43 | 0.79 | 3.51E−02 | 1 | 4 | WYM43 | 0.85 | 1.54E−02 | 1 | 17 |
| WYM44 | 0.80 | 1.65E−02 | 5 | 3 | WYM44 | 0.75 | 3.10E−02 | 5 | 16 |
| WYM44 | 0.73 | 4.01E−02 | 5 | 11 | WYM44 | 0.85 | 8.13E−03 | 5 | 6 |
| WYM44 | 0.75 | 3.14E−02 | 5 | 7 | WYM44 | 0.71 | 4.64E−02 | 5 | 8 |
| WYM44 | 0.80 | 1.77E−02 | 5 | 4 | WYM44 | 0.76 | 3.01E−02 | 5 | 17 |
| WYM44 | 0.71 | 1.15E−01 | 4 | 1 | WYM44 | 0.70 | 1.18E−01 | 7 | 1 |
| WYM44 | 0.72 | 6.99E−02 | 1 | 2 | WYM44 | 0.86 | 2.73E−02 | 2 | 3 |
| WYM44 | 0.73 | 9.73E−02 | 2 | 16 | WYM44 | 0.70 | 1.21E−01 | 2 | 13 |
| WYM44 | 0.87 | 2.46E−02 | 2 | 11 | WYM44 | 0.84 | 3.44E−02 | 2 | 6 |
| WYM44 | 0.82 | 4.48E−02 | 2 | 7 | WYM44 | 0.79 | 6.07E−02 | 2 | 8 |
| WYM44 | 0.85 | 3.19E−02 | 2 | 4 | WYM44 | 0.85 | 3.29E−02 | 2 | 17 |
| WYM46 | 0.72 | 6.62E−02 | 4 | 14 | WYM46 | 0.79 | 3.46E−02 | 4 | 13 |
| WYM46 | 0.70 | 7.79E−02 | 4 | 2 | WYM46 | 0.79 | 3.33E−02 | 1 | 3 |
| WYM46 | 0.75 | 5.45E−02 | 1 | 16 | WYM46 | 0.90 | 5.88E−03 | 1 | 14 |
| WYM46 | 0.71 | 7.63E−02 | 1 | 11 | WYM46 | 0.82 | 2.40E−02 | 1 | 6 |
| WYM46 | 0.75 | 5.23E−02 | 1 | 19 | WYM46 | 0.90 | 5.71E−03 | 1 | 5 |
| WYM46 | 0.76 | 4.53E−02 | 1 | 7 | WYM46 | 0.91 | 4.99E−03 | 1 | 8 |
| WYM46 | 0.88 | 8.45E−03 | 1 | 4 | WYM46 | 0.76 | 4.71E−02 | 1 | 17 |
| WYM46 | 0.70 | 5.11E−02 | 8 | 5 | WYM46 | 0.74 | 9.12E−02 | 2 | 12 |
| WYM47 | 0.74 | 5.93E−02 | 4 | 3 | WYM47 | 0.84 | 1.75E−02 | 4 | 16 |
| WYM47 | 0.78 | 3.66E−02 | 4 | 13 | WYM47 | 0.80 | 3.15E−02 | 4 | 11 |
| WYM47 | 0.84 | 1.86E−02 | 4 | 9 | WYM47 | 0.86 | 1.38E−02 | 4 | 10 |
| WYM47 | 0.95 | 1.12E−03 | 4 | 19 | WYM47 | 0.93 | 2.40E−03 | 4 | 5 |
| WYM47 | 0.90 | 6.28E−03 | 4 | 7 | WYM47 | 0.78 | 3.75E−02 | 4 | 8 |
| WYM47 | 0.86 | 1.28E−02 | 4 | 12 | WYM47 | 0.70 | 7.98E−02 | 4 | 4 |
| WYM47 | 0.77 | 4.41E−02 | 4 | 17 | WYM47 | 0.75 | 5.46E−02 | 7 | 3 |
| WYM47 | 0.82 | 2.37E−02 | 7 | 16 | WYM47 | 0.79 | 3.26E−02 | 7 | 13 |
| WYM47 | 0.73 | 6.09E−02 | 7 | 6 | WYM47 | 0.79 | 3.63E−02 | 7 | 9 |
| WYM47 | 0.74 | 5.81E−02 | 7 | 10 | WYM47 | 0.94 | 1.47E−03 | 7 | 19 |
| WYM47 | 0.80 | 3.10E−02 | 7 | 5 | WYM47 | 0.79 | 3.63E−02 | 7 | 7 |
| WYM47 | 0.75 | 5.04E−02 | 7 | 8 | WYM47 | 0.73 | 6.24E−02 | 7 | 12 |
| WYM47 | 0.75 | 5.11E−02 | 7 | 17 | WYM47 | 0.78 | 4.00E−02 | 1 | 16 |
| WYM47 | 0.78 | 3.93E−02 | 1 | 13 | WYM47 | 0.74 | 5.93E−02 | 1 | 11 |
| WYM47 | 0.82 | 2.49E−02 | 1 | 9 | WYM47 | 0.83 | 2.12E−02 | 1 | 10 |
| WYM47 | 0.89 | 6.74E−03 | 1 | 19 | WYM47 | 0.83 | 2.17E−02 | 1 | 5 |
| WYM47 | 0.83 | 2.05E−02 | 1 | 7 | WYM47 | 0.88 | 9.38E−03 | 1 | 12 |
| WYM47 | 0.86 | 5.97E−03 | 8 | 1 | WYM47 | 0.79 | 1.92E−02 | 8 | 13 |
| WYM47 | 0.81 | 1.58E−02 | 8 | 2 | WYM47 | 0.72 | 1.90E−02 | 6 | 3 |
| WYM47 | 0.80 | 5.44E−03 | 6 | 16 | WYM47 | 0.71 | 2.19E−02 | 6 | 13 |
| WYM47 | 0.70 | 2.32E−02 | 6 | 6 | WYM47 | 0.72 | 1.78E−02 | 6 | 9 |
| WYM47 | 0.73 | 1.73E−02 | 6 | 10 | WYM47 | 0.85 | 1.72E−03 | 6 | 19 |
| WYM47 | 0.71 | 2.07E−02 | 6 | 5 | WYM47 | 0.77 | 9.12E−03 | 6 | 7 |
| WYM47 | 0.74 | 1.52E−02 | 6 | 12 | WYM47 | 0.74 | 1.38E−02 | 6 | 17 |
| WYM47 | 0.77 | 1.52E−02 | 3 | 3 | WYM47 | 0.82 | 6.40E−03 | 3 | 16 |
| WYM47 | 0.74 | 2.31E−02 | 3 | 13 | WYM47 | 0.88 | 1.88E−03 | 3 | 11 |
| WYM47 | 0.72 | 2.77E−02 | 3 | 6 | WYM47 | 0.76 | 1.78E−02 | 3 | 9 |
| WYM47 | 0.92 | 4.39E−04 | 3 | 10 | WYM47 | 0.85 | 4.01E−03 | 3 | 19 |
| WYM47 | 0.75 | 2.00E−02 | 3 | 5 | WYM47 | 0.86 | 2.75E−03 | 3 | 7 |
| WYM47 | 0.94 | 1.94E−04 | 3 | 12 | WYM47 | 0.87 | 2.48E−03 | 3 | 17 |
| WYM47 | 0.70 | 1.21E−01 | 2 | 3 | WYM47 | 0.72 | 1.10E−01 | 2 | 14 |
| WYM47 | 0.80 | 5.45E−02 | 2 | 11 | WYM47 | 0.75 | 8.63E−02 | 2 | 6 |
| WYM47 | 0.74 | 9.41E−02 | 2 | 19 | WYM47 | 0.73 | 1.00E−01 | 2 | 4 |
| WYM48 | 0.80 | 1.68E−02 | 5 | 9 | WYM48 | 0.76 | 4.67E−02 | 7 | 9 |
| WYM48 | 0.86 | 1.40E−02 | 1 | 9 | WYM48 | 0.81 | 2.58E−02 | 1 | 12 |
| WYM48 | 0.72 | 1.09E−01 | 2 | 12 | WYM51 | 0.82 | 2.43E−02 | 4 | 3 |
| WYM51 | 0.78 | 3.85E−02 | 4 | 14 | WYM51 | 0.70 | 7.79E−02 | 4 | 11 |
| WYM51 | 0.84 | 1.71E−02 | 4 | 6 | WYM51 | 0.75 | 5.10E−02 | 4 | 8 |
| WYM51 | 0.86 | 1.25E−02 | 4 | 4 | WYM51 | 0.75 | 4.98E−02 | 4 | 17 |
| WYM51 | 0.78 | 3.71E−02 | 1 | 16 | WYM51 | 0.74 | 5.74E−02 | 1 | 11 |
| WYM51 | 0.98 | 1.75E−04 | 1 | 9 | WYM51 | 0.82 | 2.28E−02 | 1 | 10 |
| WYM51 | 0.89 | 6.88E−03 | 1 | 19 | WYM51 | 0.80 | 3.01E−02 | 1 | 5 |
| WYM51 | 0.83 | 2.10E−02 | 1 | 7 | WYM51 | 0.90 | 6.23E−03 | 1 | 12 |
| WYM51 | 0.70 | 7.79E−02 | 1 | 17 | WYM51 | 0.87 | 2.50E−02 | 2 | 3 |
| WYM51 | 0.76 | 8.24E−02 | 2 | 16 | WYM51 | 0.84 | 3.58E−02 | 2 | 11 |
| WYM51 | 0.91 | 1.07E−02 | 2 | 6 | WYM51 | 0.72 | 1.05E−01 | 2 | 7 |

TABLE 14-continued

Correlation between the expression level of selected genes of some embodiments of the invention in various tissues and the phenotypic performance of maintenance of performance under drought conditions across maize lines

| Gene Name | R | P value | Exp. set | Corr. Set ID | Gene Name | R | P value | Exp. set | Corr. Set ID |
|---|---|---|---|---|---|---|---|---|---|
| WYM51 | 0.80 | 5.39E−02 | 2 | 4 | WYM51 | 0.83 | 4.06E−02 | 2 | 17 |
| WYM52 | 0.81 | 1.43E−02 | 8 | 1 | WYM52 | 0.77 | 2.66E−02 | 8 | 3 |
| WYM52 | 0.90 | 2.20E−03 | 8 | 16 | WYM52 | 0.88 | 3.75E−03 | 8 | 13 |
| WYM52 | 0.77 | 2.48E−02 | 8 | 11 | WYM52 | 0.79 | 2.00E−02 | 8 | 10 |
| WYM52 | 0.89 | 3.02E−03 | 8 | 2 | WYM52 | 0.72 | 4.46E−02 | 8 | 5 |
| WYM52 | 0.94 | 6.36E−04 | 8 | 7 | WYM52 | 0.95 | 2.33E−04 | 8 | 8 |
| WYM52 | 0.88 | 4.32E−03 | 8 | 4 | WYM55 | 0.83 | 1.17E−02 | 5 | 12 |
| WYM55 | 0.85 | 3.37E−02 | 4 | 1 | WYM55 | 0.85 | 1.45E−02 | 4 | 2 |
| WYM55 | 0.75 | 5.09E−02 | 7 | 2 | WYM55 | 0.86 | 2.98E−02 | 1 | 1 |
| WYM55 | 0.70 | 7.71E−02 | 1 | 14 | WYM55 | 0.71 | 7.59E−02 | 1 | 15 |
| WYM55 | 0.72 | 6.65E−02 | 1 | 2 | WYM55 | 0.87 | 5.35E−03 | 8 | 1 |
| WYM55 | 0.75 | 3.13E−02 | 8 | 14 | WYM55 | 0.85 | 8.04E−03 | 8 | 13 |
| WYM55 | 0.77 | 2.68E−02 | 8 | 11 | WYM55 | 0.76 | 2.91E−02 | 8 | 10 |
| WYM55 | 0.97 | 5.99E−05 | 8 | 2 | WYM55 | 0.79 | 1.87E−02 | 8 | 5 |
| WYM55 | 0.90 | 2.46E−03 | 8 | 7 | WYM55 | 0.86 | 5.97E−03 | 8 | 8 |
| WYM55 | 0.81 | 1.55E−02 | 8 | 4 | WYM55 | 0.72 | 2.97E−02 | 3 | 15 |
| WYM56 | 0.73 | 9.99E−02 | 4 | 1 | WYM56 | 0.79 | 3.59E−02 | 4 | 3 |
| WYM56 | 0.76 | 4.89E−02 | 4 | 16 | WYM56 | 0.87 | 1.15E−02 | 4 | 14 |
| WYM56 | 0.72 | 6.82E−02 | 4 | 15 | WYM56 | 0.74 | 5.58E−02 | 4 | 13 |
| WYM56 | 0.88 | 9.81E−03 | 4 | 11 | WYM56 | 0.73 | 6.16E−02 | 4 | 6 |
| WYM56 | 0.79 | 3.63E−02 | 4 | 10 | WYM56 | 0.80 | 3.26E−02 | 4 | 7 |
| WYM56 | 0.75 | 5.30E−02 | 4 | 8 | WYM56 | 0.81 | 2.64E−02 | 4 | 4 |
| WYM56 | 0.79 | 3.53E−02 | 4 | 17 | WYM56 | 0.79 | 3.57E−02 | 7 | 19 |
| WYM56 | 0.72 | 1.84E−02 | 6 | 19 | WYM56 | 0.71 | 2.14E−02 | 6 | 5 |
| WYM56 | 0.80 | 5.41E−02 | 2 | 3 | WYM56 | 0.73 | 9.81E−02 | 2 | 16 |
| WYM56 | 0.72 | 1.09E−01 | 2 | 13 | WYM56 | 0.84 | 3.42E−02 | 2 | 6 |
| WYM56 | 0.89 | 1.65E−02 | 2 | 18 | WYM56 | 0.88 | 2.21E−02 | 2 | 17 |
| WYM57 | 0.77 | 2.55E−02 | 5 | 13 | WYM57 | 0.81 | 4.08E−03 | 6 | 20 |
| WYM57 | 0.79 | 6.14E−02 | 2 | 3 | WYM57 | 0.79 | 6.07E−02 | 2 | 16 |
| WYM57 | 0.82 | 4.61E−02 | 2 | 13 | WYM57 | 0.80 | 5.34E−02 | 2 | 6 |
| WYM57 | 0.93 | 6.49E−03 | 2 | 18 | WYM57 | 0.90 | 1.47E−02 | 2 | 17 |
| WYM58 | 0.76 | 2.88E−02 | 5 | 15 | WYM58 | 0.86 | 5.85E−03 | 5 | 12 |
| WYM58 | 0.70 | 7.99E−02 | 7 | 9 | WYM58 | 0.75 | 5.00E−02 | 7 | 19 |
| WYM58 | 0.93 | 7.01E−03 | 1 | 1 | WYM58 | 0.71 | 2.27E−02 | 6 | 18 |
| WYM58 | 0.79 | 6.31E−02 | 2 | 9 | WYM58 | 0.70 | 1.18E−01 | 2 | 18 |
| WYM58 | 0.87 | 2.59E−02 | 2 | 12 | WYM59 | 0.81 | 1.52E−02 | 5 | 1 |
| WYM59 | 0.75 | 3.04E−02 | 5 | 2 | WYM60 | 0.95 | 1.22E−03 | 4 | 3 |
| WYM60 | 0.95 | 1.13E−03 | 4 | 16 | WYM60 | 0.82 | 2.29E−02 | 4 | 14 |
| WYM60 | 0.85 | 1.50E−02 | 4 | 13 | WYM60 | 0.89 | 8.05E−03 | 4 | 11 |
| WYM60 | 0.91 | 4.97E−03 | 4 | 6 | WYM60 | 0.72 | 6.73E−02 | 4 | 9 |
| WYM60 | 0.88 | 8.90E−03 | 4 | 10 | WYM60 | 0.92 | 3.77E−03 | 4 | 19 |
| WYM60 | 0.95 | 9.43E−04 | 4 | 5 | WYM60 | 0.93 | 2.75E−03 | 4 | 7 |
| WYM60 | 0.92 | 3.01E−03 | 4 | 8 | WYM60 | 0.79 | 3.65E−02 | 4 | 12 |
| WYM60 | 0.92 | 3.07E−03 | 4 | 4 | WYM60 | 0.94 | 1.61E−03 | 4 | 17 |
| WYM60 | 0.71 | 7.22E−02 | 7 | 9 | WYM60 | 0.71 | 7.67E−02 | 1 | 10 |
| WYM60 | 0.73 | 6.07E−02 | 1 | 12 | WYM61 | 0.79 | 3.33E−02 | 4 | 3 |
| WYM61 | 0.90 | 6.35E−03 | 4 | 16 | WYM61 | 0.73 | 6.34E−02 | 4 | 13 |
| WYM61 | 0.90 | 6.38E−03 | 4 | 11 | WYM61 | 0.71 | 7.45E−02 | 4 | 6 |
| WYM61 | 0.91 | 4.50E−03 | 4 | 9 | WYM61 | 0.94 | 1.48E−03 | 4 | 10 |
| WYM61 | 0.80 | 3.21E−02 | 4 | 19 | WYM61 | 0.80 | 3.09E−02 | 4 | 5 |
| WYM61 | 0.89 | 6.54E−03 | 4 | 7 | WYM61 | 0.96 | 7.57E−04 | 4 | 12 |
| WYM61 | 0.89 | 7.56E−03 | 4 | 17 | WYM61 | 0.70 | 7.75E−02 | 7 | 3 |
| WYM61 | 0.70 | 7.91E−02 | 7 | 6 | WYM61 | 0.73 | 6.01E−02 | 7 | 18 |
| WYM61 | 0.70 | 7.80E−02 | 1 | 9 | WYM61 | 0.80 | 3.01E−02 | 1 | 12 |
| WYM61 | 0.80 | 1.61E−02 | 8 | 19 | WYM61 | 0.85 | 7.85E−03 | 8 | 5 |
| WYM61 | 0.73 | 2.63E−02 | 3 | 12 | WYM62 | 0.81 | 1.48E−02 | 8 | 3 |
| WYM62 | 0.86 | 6.19E−03 | 8 | 16 | WYM62 | 0.78 | 2.24E−02 | 8 | 6 |
| WYM62 | 0.78 | 2.20E−02 | 8 | 4 | WYM62 | 0.80 | 1.82E−02 | 8 | 17 |
| WYM63 | 0.79 | 3.62E−02 | 7 | 21 | WYM63 | 0.73 | 6.12E−02 | 7 | 9 |
| WYM63 | 0.78 | 3.98E−02 | 7 | 10 | WYM63 | 0.75 | 5.34E−02 | 7 | 19 |
| WYM63 | 0.70 | 7.92E−02 | 7 | 7 | WYM63 | 0.87 | 1.04E−02 | 7 | 12 |
| WYM63 | 0.71 | 7.36E−02 | 1 | 16 | WYM63 | 0.72 | 6.58E−02 | 1 | 9 |
| WYM63 | 0.93 | 2.32E−03 | 1 | 19 | WYM63 | 0.92 | 3.36E−03 | 1 | 5 |
| WYM63 | 0.76 | 4.79E−02 | 1 | 7 | WYM63 | 0.72 | 6.85E−02 | 1 | 8 |
| WYM63 | 0.72 | 6.77E−02 | 1 | 12 | WYM63 | 0.92 | 3.66E−04 | 3 | 3 |
| WYM63 | 0.91 | 6.53E−04 | 3 | 16 | WYM63 | 0.94 | 2.01E−04 | 3 | 13 |
| WYM63 | 0.87 | 2.57E−03 | 3 | 11 | WYM63 | 0.85 | 3.74E−03 | 3 | 6 |
| WYM63 | 0.73 | 2.69E−02 | 3 | 9 | WYM63 | 0.88 | 1.54E−03 | 3 | 10 |
| WYM63 | 0.80 | 9.36E−03 | 3 | 19 | WYM63 | 0.75 | 2.09E−02 | 3 | 5 |
| WYM63 | 0.91 | 6.58E−04 | 3 | 7 | WYM63 | 0.89 | 1.51E−03 | 3 | 8 |
| WYM63 | 0.82 | 6.92E−03 | 3 | 12 | WYM63 | 0.90 | 8.54E−04 | 3 | 4 |
| WYM63 | 0.92 | 3.57E−04 | 3 | 17 | WYM63 | 0.83 | 4.19E−02 | 2 | 2 |

TABLE 14-continued

Correlation between the expression level of selected genes of some embodiments of the invention in various tissues and the phenotypic performance of maintenance of performance under drought conditions across maize lines

| Gene Name | R | P value | Exp. set | Corr. Set ID | Gene Name | R | P value | Exp. set | Corr. Set ID |
|---|---|---|---|---|---|---|---|---|---|
| WYM64 | 0.85 | 3.25E−02 | 4 | 1 | WYM64 | 0.80 | 5.63E−02 | 2 | 9 |
| WYM64 | 0.72 | 1.05E−01 | 2 | 18 | WYM65 | 0.72 | 6.93E−02 | 4 | 18 |
| WYM66 | 0.78 | 3.72E−02 | 4 | 19 | WYM66 | 0.75 | 5.05E−02 | 4 | 5 |
| WYM66 | 0.73 | 6.35E−02 | 1 | 5 | WYM67 | 0.90 | 2.40E−03 | 5 | 11 |
| WYM67 | 0.80 | 1.66E−02 | 5 | 10 | WYM67 | 0.75 | 8.67E−02 | 4 | 1 |
| WYM67 | 0.89 | 7.62E−03 | 4 | 2 | WYM67 | 0.73 | 9.89E−02 | 7 | 1 |
| WYM67 | 0.87 | 2.40E−02 | 1 | 1 | WYM67 | 0.80 | 2.92E−02 | 1 | 2 |
| WYM67 | 0.75 | 3.23E−02 | 8 | 16 | WYM67 | 0.82 | 4.36E−02 | 2 | 3 |
| WYM67 | 0.73 | 9.92E−02 | 2 | 11 | WYM67 | 0.78 | 6.51E−02 | 2 | 6 |
| WYM67 | 0.72 | 1.08E−01 | 2 | 18 | WYM67 | 0.73 | 9.64E−02 | 2 | 7 |
| WYM67 | 0.76 | 8.23E−02 | 2 | 4 | WYM67 | 0.84 | 3.77E−02 | 2 | 17 |
| WYM69 | 0.71 | 4.86E−02 | 5 | 6 | WYM69 | 0.72 | 6.59E−02 | 4 | 3 |
| WYM69 | 0.79 | 3.50E−02 | 4 | 16 | WYM69 | 0.71 | 7.33E−02 | 4 | 6 |
| WYM69 | 0.86 | 1.37E−02 | 4 | 9 | WYM69 | 0.93 | 2.72E−03 | 4 | 19 |
| WYM69 | 0.81 | 2.77E−02 | 4 | 5 | WYM69 | 0.75 | 5.03E−02 | 4 | 7 |
| WYM69 | 0.74 | 5.86E−02 | 4 | 17 | WYM69 | 0.91 | 1.12E−02 | 7 | 1 |
| WYM69 | 0.87 | 9.95E−03 | 7 | 3 | WYM69 | 0.87 | 1.09E−02 | 7 | 16 |
| WYM69 | 0.92 | 3.64E−02 | 7 | 14 | WYM69 | 0.79 | 3.38E−02 | 7 | 15 |
| WYM69 | 0.84 | 1.73E−02 | 7 | 13 | WYM69 | 0.84 | 1.69E−02 | 7 | 11 |
| WYM69 | 0.86 | 1.33E−02 | 7 | 6 | WYM69 | 0.74 | 5.91E−02 | 7 | 9 |
| WYM69 | 0.84 | 1.80E−02 | 7 | 10 | WYM69 | 0.80 | 3.03E−02 | 7 | 19 |
| WYM69 | 0.85 | 1.63E−02 | 7 | 5 | WYM69 | 0.89 | 8.01E−03 | 7 | 7 |
| WYM69 | 0.89 | 7.70E−03 | 7 | 8 | WYM69 | 0.77 | 4.41E−02 | 7 | 12 |
| WYM69 | 0.87 | 1.05E−02 | 7 | 4 | WYM69 | 0.84 | 1.73E−02 | 7 | 17 |
| WYM69 | 0.72 | 6.91E−02 | 1 | 11 | WYM69 | 0.81 | 2.57E−02 | 1 | 9 |
| WYM69 | 0.78 | 3.77E−02 | 1 | 10 | WYM69 | 0.76 | 4.90E−02 | 1 | 7 |
| WYM69 | 0.87 | 9.98E−03 | 1 | 12 | WYM69 | 0.72 | 1.89E−02 | 6 | 16 |
| WYM69 | 0.74 | 2.28E−02 | 3 | 15 | WYM69 | 0.76 | 1.78E−02 | 3 | 13 |
| WYM69 | 0.81 | 7.98E−03 | 3 | 11 | WYM69 | 0.85 | 3.77E−03 | 3 | 10 |
| WYM69 | 0.76 | 1.84E−02 | 3 | 7 | WYM69 | 0.83 | 5.48E−03 | 3 | 12 |
| WYM69 | 0.92 | 9.31E−03 | 2 | 3 | WYM69 | 0.96 | 1.84E−03 | 2 | 16 |
| WYM69 | 0.96 | 1.89E−03 | 2 | 13 | WYM69 | 0.92 | 8.68E−03 | 2 | 11 |
| WYM69 | 0.98 | 4.20E−04 | 2 | 6 | WYM69 | 0.90 | 1.52E−02 | 2 | 10 |
| WYM69 | 0.87 | 2.60E−02 | 2 | 18 | WYM69 | 0.83 | 4.32E−02 | 2 | 19 |
| WYM69 | 0.95 | 4.23E−03 | 2 | 7 | WYM69 | 0.95 | 3.79E−03 | 2 | 8 |
| WYM69 | 0.96 | 2.84E−03 | 2 | 4 | WYM69 | 0.91 | 1.23E−02 | 2 | 17 |
| WYM98 | 0.86 | 5.98E−03 | 5 | 11 | WYM98 | 0.77 | 2.44E−02 | 5 | 10 |
| WYM98 | 0.71 | 5.07E−02 | 5 | 2 | WYM98 | 0.73 | 3.98E−02 | 5 | 7 |
| WYM98 | 0.81 | 5.31E−02 | 4 | 1 | WYM98 | 0.82 | 2.26E−02 | 4 | 2 |
| WYM98 | 0.78 | 6.79E−02 | 7 | 1 | WYM98 | 0.86 | 2.77E−02 | 1 | 1 |
| WYM98 | 0.73 | 6.50E−02 | 1 | 16 | WYM98 | 0.73 | 6.32E−02 | 1 | 15 |
| WYM98 | 0.71 | 7.44E−02 | 1 | 13 | WYM98 | 0.82 | 2.25E−02 | 1 | 11 |
| WYM98 | 0.87 | 1.02E−02 | 1 | 10 | WYM98 | 0.84 | 1.76E−02 | 1 | 2 |
| WYM98 | 0.79 | 3.55E−02 | 1 | 7 | WYM98 | 0.87 | 1.02E−02 | 1 | 12 |
| WYM98 | 0.71 | 7.46E−02 | 1 | 17 | WYM98 | 0.74 | 3.45E−02 | 8 | 1 |
| WYM98 | 0.74 | 3.49E−02 | 8 | 3 | WYM98 | 0.75 | 3.15E−02 | 8 | 8 |
| WYM98 | 0.73 | 4.09E−02 | 8 | 4 | WYM98 | 0.70 | 5.22E−02 | 8 | 17 |
| WYM98 | 0.73 | 2.53E−02 | 3 | 15 | WYM98 | 0.71 | 1.12E−01 | 2 | 10 |
| WYM98 | 0.82 | 4.54E−02 | 2 | 2 | | | | | |

Table 14: Correlations (R) between the genes expression levels in various tissues and the phenotypic performance.
"Corr. ID"—correlation set ID according to the correlated parameters Table 11 above.
"Exp. Set"—Expression set.
"R" = Pearson correlation coefficient;
"P" = p value.

Example 5

Production of Barley Transcriptome and High Throughput Correlation Analysis Using 44K Barley Oligonucleotide Micro-Array In order to produce a high throughput correlation analysis comparing between plant phenotype and gene expression level, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 47,500 Barley genes and transcripts. In order to define correlations between the levels of RNA expression and yield or vigor related parameters, various plant characteristics of 25 different Barley accessions were analyzed in the field under normal growth conditions. Among them, 13 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Barley tissues—Five tissues at different developmental stages [meristem, flower, booting spike, stem, flag leaf], representing different plant characteristics, were sampled and RNA was extracted as described above. Each micro-array expression information tissue type has received a Set ID as summarized in Table 15 below.

TABLE 15

Barley transcriptome expression sets

| Expression Set | Set ID |
|---|---|
| Yield barley booting spike | 1 |
| Yield barley flower | 2 |
| Yield barley meristem | 3 |
| Yield barley stem | 4 |

Table 15: Provided are the barley transcriptome expression sets.

Barley yield components and vigor related parameters assessment—25 Barley accessions in 4 repetitive blocks (named A, B, C, and D), each containing 4 plants per plot were grown at net house. Plants were phenotyped on a daily basis following the standard descriptor of barley (Table 16, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

spike was calculated by dividing the total grain number by the number of spikes.

Grain average size (cm)—

At the end of the experiment (50% of the spikes were dry) all spikes from plots within blocks A-D were collected. The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

Grain average weight (mgr)—At the end of the experiment (50% of the spikes were dry) all spikes from plots within blocks A-D were collected. The total grains from 5 spikes that were manually threshed were counted and weight. The average weight was calculated by dividing the total weight by the total grain number.

Grain yield per spike (gr)—At the end of the experiment (50% of the spikes were dry) all spikes from plots within blocks A-D were collected. The total grains from 5 spikes that were manually threshed were weight. The grain yield was calculated by dividing the total weight by the spike number.

Spike length analysis—At the end of the experiment (50% of the spikes were dry) all spikes from plots within blocks A-D were collected. The five chosen spikes per plant were measured using measuring tape excluding the awns.

Spike number analysis—At the end of the experiment (50% of the spikes were dry) all spikes from plots within blocks A-D were collected. The spikes per plant were counted.

Growth habit scoring—At the growth stage 10 (booting), each of the plants was scored for its growth habit nature. The scale that was used was 1 for prostate nature till 9 for erect.

Hairiness of basal leaves—At the growth stage 5 (leaf sheath strongly erect; end of tillering), each of the plants was

TABLE 16

Barley standard descriptors

| Trait | Parameter | Range | Description |
|---|---|---|---|
| Growth habit | Scoring | 1-9 | Prostrate (1) or Erect (9) |
| Hairiness of basal leaves | Scoring | P (Presence)/A (Absence) | Absence (1) or Presence (2) |
| Stem pigmentation | Scoring | | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 16. Barley standard descriptors.

Grains Per Spike—At the end of the experiment (50% of the spikes were dry) all spikes from plots within blocks A-D were collected. The total number of grains from 5 spikes that were manually threshed was counted. The average grain per scored for its hairiness nature of the leaf before the last. The scale that was used was 1 for prostate nature till 9 for erect.

Plant height—At the harvest stage (50% of spikes were dry) each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At the growth stage 10 (booting), each of the plants was scored for its stem color. The scale that was used was 1 for green till 5 for full purple.

Experimental Results 13 different Barley accessions were grown and characterized for 13 parameters as described above. The average for each of the measured parameter was calculated using the JMP software and values are summarized in Tables 18 and 19 below. Subsequent correlation analysis between the various transcriptome sets (Table 15) and the average parameters (Tables 18 and 19) was conducted. Follow, results were integrated to the database.

TABLE 18

Measured parameters of correlation IDs in Barley accessions

| Ecotype/Treatment | Line-1 | Line-2 | Line-3 | Line-4 | Line-5 | Line-6 | Line-7 |
|---|---|---|---|---|---|---|---|
| 1 | 35.05 | 28.06 | 28.76 | 17.87 | 41.22 | 29.73 | 34.99 |
| 2 | 0.27 | 0.23 | 0.24 | 0.17 | 0.29 | 0.28 | 0.28 |
| 3 | 20.23 | 17.98 | 17.27 | 17.73 | 14.47 | 16.78 | 14.07 |
| 4 | 2.60 | 2.00 | 1.92 | 3.17 | 4.33 | 2.69 | 3.50 |
| 5 | 1.53 | 1.33 | 1.69 | 1.08 | 1.42 | 1.69 | 1.19 |
| 6 | 134.27 | 130.50 | 138.77 | 114.58 | 127.75 | 129.38 | 121.63 |
| 7 | 3.56 | 2.54 | 2.58 | 1.57 | 3.03 | 2.52 | 2.62 |
| 8 | 12.04 | 10.93 | 11.83 | 9.90 | 11.68 | 11.53 | 11.22 |
| 9 | 48.85 | 48.27 | 37.42 | 61.92 | 33.27 | 41.69 | 40.63 |
| 10 | 1.13 | 2.50 | 1.69 | 1.75 | 2.33 | 2.31 | 2.19 |
| 11 | 78.87 | 66.14 | 68.49 | 53.39 | 68.30 | 74.17 | 58.33 |
| 12 | 62.40 | 64.08 | 65.15 | 58.92 | 63.00 | 70.54 | 60.88 |

Table 18. Provided are the values of each of the parameters measured in Barley accessions according to the correlation identifications presented in Table 17.

Vegetative dry weight and spike yield—

At the end of the experiment (50% of the spikes were dry) all spikes and vegetative material from plots within blocks A-D were collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr) after drying at 30° C. in oven for 48 hours.

Harvest Index (for Barley)—The harvest index was calculated using Formula XI.

Harvest Index=Average spike dry weight per plant/ (Average vegetative dry weight per plant+Average spike dry weight per plant)    Formula XI:

TABLE 17

| Barley correlated parameters (vectors) | |
|---|---|
| Correlated parameter with | Correlation ID |
| Grain weight | 1 |
| Grains Size | 2 |
| Grains per spike | 3 |
| Growth habit | 4 |
| Hairiness of basal leaves | 5 |
| Plant height | 6 |
| Seed Yield of 5 Spikes | 7 |
| Spike length | 8 |
| Spikes per plant | 9 |
| Stem pigmentation | 10 |
| Vegetative dry weight | 11 |
| days to flowering | 12 |

Table 17. Provided are the Barley correlated parameters.

TABLE 19

Barley accessions, additional measured parameters

| Ecotype/Treatment | Line-8 | Line-9 | Line-10 | Line-11 | Line-12 | Line-13 |
|---|---|---|---|---|---|---|
| 1 | 20.58 | 37.13 | 25.22 | 27.50 | 29.56 | 19.58 |
| 2 | 0.19 | 0.27 | 0.22 | 0.22 | 0.27 | 0.18 |
| 3 | 21.54 | 13.40 | 12.12 | 12.10 | 15.28 | 17.07 |
| 4 | 3.00 | 2.47 | 3.60 | 3.67 | 3.50 | 3.00 |
| 5 | 1.00 | 1.60 | 1.30 | 1.17 | 1.08 | 1.17 |
| 6 | 126.80 | 121.40 | 103.89 | 99.83 | 118.42 | 117.17 |
| 7 | 2.30 | 2.68 | 1.55 | 1.68 | 2.35 | 1.67 |
| 8 | 11.11 | 10.18 | 8.86 | 8.58 | 10.51 | 9.80 |
| 10 | 62.00 | 50.60 | 40.00 | 49.33 | 43.09 | 51.40 |
| 11 | 2.30 | 3.07 | 1.70 | 1.83 | 1.58 | 2.17 |
| 12 | 62.23 | 68.31 | 35.35 | 38.32 | 56.15 | 42.68 |
| 1 | 20.58 | 37.13 | 25.22 | 27.50 | 29.56 | 19.58 |
| 2 | 0.19 | 0.27 | 0.22 | 0.22 | 0.27 | 0.18 |
| 3 | 21.54 | 13.40 | 12.12 | 12.10 | 15.28 | 17.07 |
| 4 | 3.00 | 2.47 | 3.60 | 3.67 | 3.50 | 3.00 |
| 5 | 1.00 | 1.60 | 1.30 | 1.17 | 1.08 | 1.17 |
| 6 | 126.80 | 121.40 | 103.89 | 99.83 | 118.42 | 117.17 |
| 7 | 2.30 | 2.68 | 1.55 | 1.68 | 2.35 | 1.67 |
| 8 | 11.11 | 10.18 | 8.86 | 8.58 | 10.51 | 9.80 |
| 9 | 62.00 | 50.60 | 40.00 | 49.33 | 43.09 | 51.40 |
| 10 | 2.30 | 3.07 | 1.70 | 1.83 | 1.58 | 2.17 |
| 11 | 62.23 | 68.31 | 35.35 | 38.32 | 56.15 | 42.68 |
| 12 | 58.10 | 60.40 | 52.80 | 53.00 | 64.58 | 56.00 |
| 9 | 62.00 | 50.60 | | | | |

Table 19. Provided are the values of each of the parameters measured in Barley accessions according to the correlation identifications presented in Table 17.

TABLE 20

Correlation between the expression level of selected genes of some embodiments of the invention in various tissues and the phenotypic performance of maintenance of performance under drought conditions across barley varieties

| Gene Name | R | P value | Exp. set | Corr. Set ID | Gene Name | R | P value | Exp. set | Corr. Set ID |
|---|---|---|---|---|---|---|---|---|---|
| LYM320 | 0.86 | 5.69E−03 | 1 | 9 | LYM332 | 0.78 | 3.71E−02 | 2 | 9 |
| LYM90 | 0.77 | 1.63E−02 | 1 | 2 | LYM90 | 0.81 | 7.77E−03 | 1 | 1 |
| LYM90 | 0.87 | 2.38E−03 | 1 | 7 | LYM90 | 0.78 | 1.33E−02 | 1 | 11 |
| WYM1 | 0.79 | 4.05E−03 | 1 | 4 | WYM11 | 0.75 | 1.88E−02 | 3 | 2 |
| WYM11 | 0.75 | 2.07E−02 | 3 | 1 | WYM11 | 0.76 | 1.74E−02 | 3 | 7 |
| WYM12 | 0.71 | 3.38E−02 | 1 | 6 | WYM12 | 0.72 | 2.81E−02 | 1 | 12 |
| WYM12 | 0.72 | 4.44E−02 | 2 | 2 | WYM12 | 0.72 | 4.28E−02 | 2 | 1 |
| WYM12 | 0.76 | 1.12E−02 | 2 | 5 | WYM12 | 0.90 | 1.00E−03 | 3 | 2 |
| WYM12 | 0.87 | 2.11E−03 | 3 | 1 | WYM12 | 0.72 | 1.24E−02 | 3 | 6 |
| WYM12 | 0.74 | 3.73E−02 | 3 | 9 | WYM12 | 0.77 | 5.72E−03 | 3 | 7 |
| WYM12 | 0.75 | 8.25E−03 | 3 | 11 | WYM12 | 0.72 | 3.00E−02 | 3 | 12 |
| WYM12 | 0.89 | 2.48E−04 | 3 | 5 | WYM13 | 0.70 | 5.28E−02 | 2 | 1 |
| WYM13 | 0.71 | 5.02E−02 | 2 | 6 | WYM13 | 0.76 | 2.91E−02 | 2 | 8 |
| WYM13 | 0.80 | 1.70E−02 | 2 | 7 | WYM13 | 0.81 | 1.38E−02 | 2 | 11 |
| WYM13 | 0.71 | 4.74E−02 | 2 | 12 | WYM16 | 0.75 | 1.16E−02 | 2 | 9 |
| WYM16 | 0.84 | 9.12E−03 | 2 | 3 | WYM17 | 0.79 | 1.22E−02 | 3 | 7 |
| WYM18 | 0.72 | 1.28E−02 | 1 | 12 | WYM19 | 0.80 | 1.03E−02 | 1 | 2 |
| WYM19 | 0.77 | 1.50E−02 | 1 | 1 | WYM19 | 0.81 | 7.84E−03 | 1 | 5 |
| WYM19 | 0.80 | 1.64E−02 | 2 | 4 | WYM2 | 0.74 | 9.86E−03 | 3 | 6 |
| WYM2 | 0.75 | 1.95E−02 | 3 | 8 | WYM2 | 0.86 | 2.88E−03 | 3 | 7 |
| WYM2 | 0.79 | 1.11E−02 | 3 | 11 | WYM20 | 0.75 | 1.98E−02 | 3 | 2 |
| WYM20 | 0.75 | 1.96E−02 | 3 | 7 | WYM3 | 0.80 | 9.56E−03 | 1 | 2 |
| WYM3 | 0.82 | 6.45E−03 | 1 | 1 | WYM3 | 0.71 | 3.33E−02 | 1 | 7 |
| WYM4 | 0.79 | 1.14E−02 | 1 | 2 | WYM4 | 0.74 | 2.40E−02 | 1 | 1 |
| WYM4 | 0.80 | 9.37E−03 | 1 | 7 | WYM7 | 0.75 | 3.38E−02 | 2 | 10 |
| WYM7 | 0.80 | 1.03E−02 | 3 | 3 | WYM9 | 0.78 | 1.36E−02 | 3 | 2 |
| WYM9 | 0.81 | 7.50E−03 | 3 | 1 | WYM9 | 0.80 | 9.80E−03 | 3 | 7 |

Table 20. Correlations (R) between the genes expression levels in various tissues and the phenotypic performance.
"Corr. ID"—correlation set ID according to the correlated parameters Table 17 above.
"Exp. Set"—Expression set.
"R" = Pearson correlation coefficient;
"P" = p value.

Example 6

Production of Barley Transcriptome and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Barley varieties grown under regular and drought growth conditions Experimental procedures analyzed barley tissues—Four tissues [leaf, meristem, spike and root tip] at two developmental stages, representing different plant characteristics, were sampled and RNA was extracted as described above. Each micro-array expression information tissue type has received a Set ID as summarized in Table 21 below.

TABLE 21

Barley transcriptome expression sets

| Expression Set | Set ID |
|---|---|
| booting spike drought | 1 |
| leaf drought reproductive | 2 |
| leaf drought vegetative | 3 |
| meristems drought vegetative | 4 |
| root tip drought vegetative | 5 |
| root tip drought-recovery vegetative | 6 |

Table 21: Provided are the barley transcriptome expression sets.

Barley yield components and vigor related parameters assessment—15 Barley accessions in 5 repetitive blocks, each containing 5 plants per pot were grown at net house. Two different treatments were applied: plants were regularly fertilized and watered during plant growth until harvesting (as recommended for commercial growth) or under drought stress. Plants were phenotyped on a daily basis following the standard descriptor of barley [Table 22 (below)]. Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

Grains number—The total number of grains from all spikes that were manually threshed was counted. No of grains per plot were counted Grain weight (gr.)—At the end of the experiment all spikes of the pots were collected. The total grains from all spikes that were manually threshed were weight. The grain yield was calculated by per plot.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using measuring tape. Height was measured from ground level to top of the longest spike excluding awns at two time points at the Vegetative growth (30 days after sowing) and at harvest.

Heading date—Each of the plants was monitored for flowering date. Heading date was calculated from sowing date till 50% of the spikes emerged.

Spike weight—The biomass and spikes weight of each plot was separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Root dry weight=total weight of the root portion underground after drying at 70° C. in oven for 48 hours at harvest.

Root/Shoot Ratio—The Root/Shoot Ratio was calculated using Formula XII.

Root/Shoot Ratio=total weight of the root at harvest/ total weight of the vegetative portion above ground at harvest.    Formula XII:

Total No of tillers—all tillers were counted per plot at two time points at the Vegetative growth (30 days after sowing) and at harvest SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and no. of lateral roots—3 plants per plot were selected for measurement of root weight, root length and for counting the number of lateral roots formed.

Shoot FW—weight of 3 plants per plots were recorded at different timepoints.

Relative water content—Fresh weight (FW) of three leaves from three plants each from different seed ID is immediately recorded; then leaves are soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I (RWC=[(FW−DW)/(TW−DW)]×100) as described above.

Harvest Index (for barley)—The harvest index was calculated using Formula XI above [Average spike dry weight per plant/(Average vegetative dry weight per plant+Average spike dry weight per plant)].

Growth rate: the growth rate (GR) of Plant Height (Formula V above), SPAD (Formula XIII below) and number of tillers (Formula XIV below) were calculated with the indicated Formulas.

Growth rate of SPAD=Regression coefficient of SPAD measurements along time course.    Formula XIII:

Growth rate of Number of tillers=Regression coefficient of Number of tillers along time course.    Formula XIV:

TABLE 22

Barley correlated parameters (vectors)

| Correlated parameter with | Correlation ID |
|---|---|
| Chlorophyll levels | 1 |
| Dry weight harvest | 2 |
| Dry weight vegetative growth | 3 |
| Fresh weight | 4 |
| Grain number | 5 |
| Grain weight | 6 |
| Harvest index | 7 |
| Heading date | 8 |
| Height growth rate | 9 |
| Number of tillers growth rate | 10 |
| Plant height | 11 |
| RBiH/BiH | 12 |
| Relative water content | 13 |
| Root dry weight | 14 |
| Root fresh weight | 15 |
| Root length | 16 |
| SPAD growth rate | 17 |
| Spike length | 18 |
| Spike number | 19 |
| Spike weight per plant | 20 |
| Spike width | 21 |
| Tillers number | 22 |
| lateral root number | 23 |

Table 22: Provided are the Barley correlated parameters.

Experimental Results

Fifteen different Barley accessions were grown and characterized for different parameters as described above. The average for each of the measured parameter was calculated using the JMP software and values are summarized in Tables 23-24 below. Subsequent correlation analysis between the various transcriptome sets (Table 21) and the average parameters (Tables 23-24) was conducted. Follow, results were integrated to the database.

TABLE 23

Measured parameters of correlation IDs in Barley accessions

| Ecotype/ Treatment | Line-1 | Line-2 | Line-3 | Line-4 | Line-5 | Line-6 | Line-7 | Line-8 |
|---|---|---|---|---|---|---|---|---|
| 1 | 41.33 | 33.57 | 36.57 | 40.50 | 45.07 | 39.73 | 38.33 | 36.17 |
| 2 | 6.15 | 5.05 | 3.20 | 3.28 | 4.76 | 3.55 | 4.52 | 3.38 |
| 3 | 0.21 | 0.21 | | | | 0.17 | | |
| 4 | 1.90 | 1.52 | 1.17 | 1.95 | 1.90 | 1.22 | 1.75 | 1.58 |
| 5 | 170.00 | 267.50 | 111.00 | 205.33 | 153.60 | 252.50 | 288.40 | 274.50 |
| 6 | 5.55 | 9.80 | 3.55 | 7.20 | 5.28 | 7.75 | 9.92 | 10.25 |
| 7 | 0.47 | 0.66 | 0.53 | 0.69 | 0.53 | 0.69 | 0.69 | 0.75 |

TABLE 23-continued

Measured parameters of correlation IDs in Barley accessions

| Ecotype/Treatment | Line-1 | Line-2 | Line-3 | Line-4 | Line-5 | Line-6 | Line-7 | Line-8 |
|---|---|---|---|---|---|---|---|---|
| 8 | 75.00 | 71.00 | 65.00 |  | 66.75 | 90.00 | 90.00 |  |
| 9 | 0.27 | 0.86 | 0.73 | 0.88 | 0.40 | 0.94 | 0.70 | 0.71 |
| 10 | 0.07 | 0.10 | 0.06 | 0.07 | 0.16 | 0.06 | 0.10 | 0.05 |
| 11 | 46.00 | 52.80 | 35.00 | 38.00 | 45.20 | 48.00 | 37.67 | 41.20 |
| 11 | 46.00 | 52.80 | 35.00 | 38.00 | 45.20 | 48.00 | 37.67 | 41.20 |
| 12 | 0.01 | 0.01 | 0.01 | 0.01 | 0.03 | 0.02 | 0.01 | 0.01 |
| 13 | 80.60 | 53.40 | 55.87 |  | 43.21 | 69.78 | 45.49 | 76.51 |
| 14 | 77.52 | 60.19 | 27.13 | 18.62 | 117.42 | 70.72 | 37.34 | 25.56 |
| 15 | 2.07 | 1.48 | 1.12 | 1.87 | 1.67 | 1.68 | 1.62 | 0.85 |
| 16 | 21.67 | 20.33 | 22.00 | 24.00 | 20.67 | 18.33 | 21.00 | 20.33 |
| 17 | 0.09 | −0.12 | 0.00 | 0.01 | 0.04 | −0.07 | 0.01 | 0.00 |
| 18 | 16.70 | 16.85 | 13.27 | 13.55 | 14.19 | 15.64 | 15.66 | 17.49 |
| 19 | 4.20 | 4.36 | 7.60 | 8.44 | 4.92 | 3.43 | 6.90 | 5.80 |
| 20 | 17.72 | 24.24 | 18.20 | 18.00 | 19.50 | 15.00 | 23.40 | 28.16 |
| 21 | 8.64 | 9.07 | 7.82 | 7.32 | 8.74 | 7.62 | 6.98 | 8.05 |
| 22 | 11.68 | 9.04 | 10.92 | 10.16 | 10.32 | 8.78 | 13.00 | 7.44 |
| 22 | 11.68 | 9.04 | 10.92 | 10.16 | 10.32 | 8.78 | 13.00 | 7.44 |
| 23 | 8.33 | 8.67 | 7.33 | 7.67 | 6.67 | 6.67 | 7.67 | 6.67 |

Table 23: Provided are the values of each of the parameters measured in Barley accessions according to the correlation identifications presented in Table 22 above.

TABLE 24

Measured parameters of correlation IDs in additional Barley accessions

| Ecotype/Treatment | Line-9 | Line-10 | Line-11 | Line-12 | Line-13 | Line-14 | Line-15 |
|---|---|---|---|---|---|---|---|
| 1 | 42.13 | 31.77 | 33.47 | 42.37 | 42.27 | 36.77 | 40.63 |
| 2 | 5.67 | 3.31 | 2.65 | 5.12 | 6.86 | 3.11 | 3.74 |
| 3 | 0.25 |  |  | 0.13 | 0.19 | 0.22 |  |
| 4 | 1.88 | 1.73 | 1.00 | 0.90 | 0.90 | 1.43 | 0.83 |
| 5 | 348.50 | 358.00 | 521.39 | 71.50 | 160.13 | 376.67 | 105.00 |
| 6 | 8.50 | 14.03 | 17.52 | 2.05 | 5.38 | 11.00 | 2.56 |
| 7 | 0.60 | 0.81 | 0.87 | 0.29 | 0.44 | 0.78 | 0.41 |
| 8 | 90.00 |  |  | 90.00 | 81.60 | 90.00 |  |
| 9 | 0.77 | 0.80 | 0.92 | 0.39 | 0.88 | −0.13 | 0.20 |
| 10 | 0.10 | 0.06 | 0.06 | 0.18 | 0.15 | 0.02 | 0.44 |
| 11 | 40.80 | 49.86 | 43.00 | 47.40 | 64.80 | 52.60 | 32.00 |
| 11 | 40.80 | 49.86 | 43.00 | 47.40 | 64.80 | 52.60 | 32.00 |
| 12 | 0.01 | 0.01 | 0.02 | 0.02 | 0.01 | 0.01 | 0.03 |
| 13 | 87.41 |  |  | 58.32 | 80.58 | 73.09 |  |
| 14 | 66.18 | 22.13 | 41.12 | 116.95 | 84.10 | 37.46 | 98.86 |
| 15 | 1.45 | 1.38 | 0.82 | 0.58 | 0.63 | 1.07 | 0.70 |
| 16 | 21.67 | 19.67 | 16.67 | 17.00 | 15.17 | 27.00 | 15.00 |
| 17 | −0.06 | 0.04 | 0.05 | 0.00 | −0.07 | 0.03 | −0.06 |
| 18 | 16.00 | 18.31 | 17.42 | 14.23 | 14.81 | 16.54 | 12.72 |
| 19 | 8.55 | 9.67 | 5.42 | 3.05 | 4.07 | 3.72 | 3.21 |
| 20 | 21.96 | 33.03 | 34.80 | 11.73 | 18.78 | 21.00 | 9.88 |
| 21 | 6.06 | 6.73 | 9.55 | 7.84 | 7.81 | 8.35 | 5.47 |
| 22 | 13.92 | 11.00 | 6.78 | 8.45 | 9.15 | 5.12 | 16.13 |
| 22 | 13.92 | 11.00 | 6.78 | 8.45 | 9.15 | 5.12 | 16.13 |
| 23 | 6.00 | 8.67 | 7.67 | 6.33 | 7.00 | 7.00 | 6.67 |

Table 24: Provided are the values of each of the parameters measured in Barley accessions according to the correlation identifications presented in Table 22 above.

TABLE 25

Correlation between the expression level of selected genes of some embodiments of the invention in various tissues and the phenotypic performance of maintenance of performance under drought conditions across barley varieties

| Gene Name | R | P value | Exp. set | Corr. Set ID | Gene Name | R | P value | Exp. set | Corr. Set ID |
|---|---|---|---|---|---|---|---|---|---|
| LYM320 | 0.76 | 8.01E−02 | 1 | 10 | LYM320 | 0.75 | 3.09E−02 | 3 | 10 |
| LYM320 | 0.82 | 1.18E−02 | 3 | 11 | LYM320 | 0.81 | 2.60E−02 | 2 | 5 |
| LYM320 | 0.82 | 2.38E−02 | 2 | 6 | LYM320 | 0.81 | 8.20E−03 | 4 | 10 |
| LYM320 | 0.71 | 3.12E−02 | 4 | 11 | LYM332 | 0.92 | 8.49E−03 | 1 | 11 |
| LYM332 | 0.77 | 7.51E−02 | 1 | 20 | LYM332 | 0.79 | 1.19E−02 | 6 | 7 |

TABLE 25-continued

Correlation between the expression level of selected genes of some embodiments of the invention in various tissues and the phenotypic performance of maintenance of performance under drought conditions across barley varieties

| Gene Name | R | P value | Exp. set | Corr. Set ID | Gene Name | R | P value | Exp. set | Corr. Set ID |
|---|---|---|---|---|---|---|---|---|---|
| LYM332 | 0.83 | 5.18E−03 | 6 | 5 | LYM332 | 0.84 | 4.14E−03 | 6 | 6 |
| LYM332 | 0.74 | 2.18E−02 | 6 | 20 | LYM332 | 0.82 | 1.29E−02 | 5 | 10 |
| LYM332 | 0.74 | 3.66E−02 | 5 | 2 | LYM332 | 0.83 | 6.05E−03 | 4 | 19 |
| LYM90 | 0.74 | 3.50E−02 | 3 | 19 | LYM90 | 0.74 | 5.81E−02 | 2 | 22 |
| LYM90 | 0.85 | 7.72E−03 | 5 | 19 | LYM90 | 0.73 | 3.80E−02 | 5 | 20 |
| LYM91 | 0.79 | 6.25E−02 | 1 | 16 | LYM91 | 0.95 | 3.06E−03 | 1 | 1 |
| LYM91 | 0.75 | 1.96E−02 | 6 | 19 | WYM1 | 0.71 | 4.85E−02 | 3 | 21 |
| WYM1 | 0.71 | 4.77E−02 | 3 | 11 | WYM1 | 0.76 | 3.03E−02 | 3 | 14 |
| WYM1 | 0.85 | 1.58E−02 | 2 | 16 | WYM1 | 0.73 | 6.27E−02 | 2 | 1 |
| WYM1 | 0.77 | 2.46E−02 | 5 | 5 | WYM1 | 0.72 | 4.54E−02 | 5 | 9 |
| WYM1 | 0.88 | 3.70E−03 | 5 | 12 | WYM1 | 0.75 | 8.64E−02 | 5 | 8 |
| WYM11 | 0.75 | 8.40E−02 | 1 | 21 | WYM11 | 0.81 | 1.45E−02 | 3 | 19 |
| WYM11 | 0.78 | 2.10E−02 | 5 | 19 | WYM11 | 0.72 | 4.28E−02 | 5 | 17 |
| WYM12 | 0.73 | 9.61E−02 | 1 | 10 | WYM12 | 0.74 | 8.96E−02 | 1 | 22 |
| WYM12 | 0.82 | 4.55E−02 | 1 | 16 | WYM12 | 0.95 | 4.35E−03 | 1 | 12 |
| WYM12 | 0.97 | 1.67E−03 | 1 | 2 | WYM12 | 0.99 | 6.17E−05 | 1 | 14 |
| WYM12 | 0.75 | 3.36E−02 | 3 | 21 | WYM12 | 0.87 | 1.13E−02 | 6 | 8 |
| WYM12 | 0.83 | 1.97E−02 | 2 | 5 | WYM12 | 0.89 | 7.39E−03 | 2 | 12 |
| WYM12 | 0.72 | 4.60E−02 | 5 | 21 | WYM12 | 0.76 | 2.86E−02 | 5 | 12 |
| WYM12 | 0.70 | 7.98E−02 | 4 | 8 | WYM13 | 0.86 | 2.80E−02 | 1 | 18 |
| WYM13 | 0.86 | 2.91E−02 | 1 | 20 | WYM13 | 0.70 | 7.76E−02 | 2 | 18 |
| WYM13 | 0.73 | 3.87E−02 | 5 | 12 | WYM15 | 0.73 | 1.02E−01 | 1 | 16 |
| WYM15 | 0.92 | 1.14E−03 | 3 | 19 | WYM15 | 0.73 | 4.03E−02 | 3 | 20 |
| WYM15 | 0.90 | 8.49E−04 | 4 | 19 | WYM16 | 0.83 | 1.07E−02 | 3 | 19 |
| WYM16 | 0.72 | 4.39E−02 | 3 | 22 | WYM16 | 0.71 | 7.67E−02 | 2 | 5 |
| WYM16 | 0.75 | 5.45E−02 | 2 | 6 | WYM16 | 0.72 | 4.50E−02 | 5 | 19 |
| WYM16 | 0.83 | 1.11E−02 | 5 | 17 | WYM16 | 0.89 | 1.43E−03 | 4 | 19 |
| WYM17 | 0.72 | 1.09E−01 | 1 | 20 | WYM17 | 0.70 | 1.18E−01 | 5 | 13 |
| WYM17 | 0.71 | 4.75E−02 | 5 | 20 | WYM17 | 0.76 | 4.53E−02 | 4 | 13 |
| WYM17 | 0.83 | 5.94E−03 | 4 | 14 | WYM17 | 0.73 | 6.26E−02 | 4 | 8 |
| WYM18 | 0.98 | 6.88E−04 | 1 | 16 | WYM18 | 0.71 | 1.16E−01 | 1 | 1 |
| WYM18 | 0.85 | 7.62E−03 | 3 | 12 | WYM18 | 0.79 | 1.88E−02 | 3 | 14 |
| WYM18 | 0.83 | 2.12E−02 | 2 | 16 | WYM18 | 0.72 | 2.80E−02 | 4 | 12 |
| WYM19 | 0.72 | 6.78E−02 | 3 | 8 | WYM19 | 0.81 | 2.75E−02 | 6 | 13 |
| WYM2 | 0.82 | 4.80E−02 | 1 | 21 | WYM20 | 0.79 | 1.89E−02 | 3 | 21 |
| WYM20 | 0.72 | 7.04E−02 | 2 | 16 | WYM3 | 0.75 | 5.12E−02 | 6 | 13 |
| WYM4 | 0.74 | 9.36E−02 | 1 | 23 | WYM4 | 0.87 | 2.49E−02 | 1 | 17 |
| WYM4 | 0.71 | 7.28E−02 | 2 | 16 | WYM4 | 0.74 | 2.13E−02 | 4 | 16 |
| WYM4 | 0.85 | 3.87E−03 | 4 | 15 | WYM7 | 0.74 | 9.53E−02 | 1 | 23 |
| WYM7 | 0.70 | 1.19E−01 | 1 | 17 | WYM7 | 0.74 | 3.72E−02 | 3 | 15 |
| WYM8 | 0.74 | 9.05E−02 | 1 | 16 | WYM8 | 0.77 | 2.69E−02 | 3 | 2 |
| WYM8 | 0.73 | 4.12E−02 | 3 | 14 | WYM9 | 0.71 | 7.10E−02 | 3 | 13 |
| WYM9 | 0.78 | 3.85E−02 | 2 | 7 | WYM9 | 0.71 | 7.63E−02 | 2 | 5 |
| WYM9 | 0.83 | 1.98E−02 | 2 | 6 | WYM9 | 0.79 | 3.42E−02 | 2 | 11 |
| WYM9 | 0.71 | 7.41E−02 | 2 | 17 | WYM9 | 0.86 | 1.27E−02 | 2 | 20 |

Table 25: Correlations (R) between the genes expression levels in various tissues and the phenotypic performance.

"Corr. ID"—correlation set ID according to the correlated parameters Table 22 above.

"Exp. Set"—Expression set.

"R" = Pearson correlation coefficient;

"P" = p value.

Example 7

Production of Maize Transcriptome and High Throughput Correlation Analysis with Yield Related Parameters when Grown Under Normal Using 60K Maize Oligonucleotide Micro-Arrays Correlation of Maize Hybrids and its Parents Grown Under Normal Conditions—

50 maize hybrids and their 14 parental lines were grown in 5 repetitive plots, in field. Maize seeds were planted and plants were grown in the field using commercial fertilization and irrigation protocols. In order to define correlations between the levels of RNA expression with yield components or vigor related parameters, 50 maize hybrids and their 14 maize parents were analyzed and were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Analyzed Maize tissues—All total of 64 selected maize lines were sampled. Plant tissues [leaves, stem, stem elongating internodes, female meristem] were sampled and RNA was extracted as described above. Each micro-array expression information tissue type has received a Set ID as summarized in Table 26 below.

TABLE 26

Maize transcriptome expression sets

| Expression Set | Set ID |
|---|---|
| heterosis flower female meristem:normal: | 1 |
| heterosis leaf:normal: | 2 |
| heterosis stem:normal: | 3 |
| heterosis stem elongating internodes:normal: | 4 |

Table 26: Provided are the maize transcriptome expression sets

The following parameters were collected either by sampling 6 plants per plot or by measuring the parameter across all the plants within the plot.

Grain weight per plant (Kg.)—At the end of the experiment all ears from plots were collected. 6 ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear weight per plant (gr.)—At the end of the experiment (when ears were harvested) total and 6 selected ears per plots within blocks were collected separately. The plants with (total and 6) were weighted (gr.) separately and the average ear per plant was calculated.

Plant height and ear height—Plants were characterized for height at harvesting. In each measure, 6 plants were measured for their height using a measuring tape. Height was measured from ground level to top of the plant below the tassel. Ear height was measured from the ground level to the place were the main ear is located.

Average dry weight—At the end of the experiment (when Inflorescence were dry) all vegetative material from plots were collected.

Cob width [cm]—The width of the cob without grains was measured using a caliper.

Total dry matter=total weight of the vegetative portion above ground (including ears, excluding roots).

Filled/Whole Ear—was calculated as the length of the ear with grains out of the total ear.

Ear row num—The number of rows in each ear was counted.

Stalk width [cm]—The diameter of the stalk was measured in the internode located below the main ear. Measurement was performed in 6 plants per each plot.

Leaf area index [LAI]=total leaf area of all plants in a plot. Measurement was performed using a Leaf area-meter.

1000 grain weight—At the end of the experiment all seeds from all plots were collected and weighedand the weight of 1000 was calculated.

Plant height growth: the growth rate (GR) of Plant Height was calculated using Formula V (described above).

Leaf growth: the growth rate (GR) of leaf number was calculated using Formula VI (described above).

Harvest Index—The harvest index was calculated using Formula X above [Average grain dry weight per Ear/(Average vegetative dry weight per Ear+Average Ear dry weight)].

Heading date—Each of the plants was monitored for flowering date. Heading date was calculated from sowing date till 50% of the male flowering.

Number days to silk emergence—Each of the plots was monitored for Silk emergence date. Number days to Silk emergence was calculated from sowing date till 50% of the spikes emerged.

Nodes number—the number of nodes was calculated from the whole plant.

The following parameters were collected using digital imaging system:

Grain Area ($cm^2$)—At the end of the growing period the grains were separated from the ear. A sample of ~200 grains were weighted, photographed and images were processed using the below described image processing system. The grain area was measured from those images and was divided by the number of grains.

Grain Length and Grain Width (mm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Grain Perimeter (cm)—At the end of the growing period the grains were separated from the ear. A sample of ~200 grains were weight, photographed and images were processed using the below described image processing system. The sum of grain perimeter was measured from those images and was divided by the number of grains.

Ear Area ($cm^2$)—At the end of the growing period 6 ears were, photographed and images were processed using the below described image processing system. The Ear area was measured from those images and was divided by the number of Ears.

Ear Filled Grain Area—At the end of the growing period 6 ears were, photographed and images were processed using the below described image processing system. The Ear filled grain area was the ear with grains out of the total ear and was measured from those images and was divided by the number of Ears.

Ear Length, width and perimeter (cm)—At the end of the growing period 6 ears were, photographed and images were processed using the below described image processing system. The Ear length, width and perimeter were measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

TABLE 27

| Maize correlated parameters (vectors) | |
|---|---|
| Correlated parameter with | Correlation ID |
| 1000 grains weight | 1 |
| Average plant DW | 2 |
| Cob width | 3 |
| Ear Area | 4 |
| Ear Filled Grain Area | 5 |
| Ear Perimeter | 6 |
| Ear Width | 7 |
| Ear height | 8 |
| Ear length | 9 |
| Ear row num | 10 |
| Ears weight per plant (SP) | 11 |
| Filled/Whole Ear | 12 |
| Grain Perimeter | 13 |
| Grain area | 14 |
| Grain length | 15 |
| Grain width | 16 |
| Grains weight per plant (SP) | 17 |
| Harvest index | 18 |
| LAI | 19 |
| Leaf growth | 20 |
| Nodes number | 21 |
| Num days to Heading (field) | 22 |
| Num days to Silk emergence (field) | 23 |
| Plant height | 24 |
| Plant height growth | 25 |
| Stalk width | 26 |
| Total dry matter (SP) | 27 |

Table 27: Provided are the maize correlated parameters.

Tables 28-35 provide the measured parameters.

TABLE 28

Measured parameters in Maize accessions under normal conditions

| Ecotype/Treatment | Line-1 | Line-2 | Line-3 | Line-4 | Line-5 | Line-6 | Line-7 | Line-8 |
|---|---|---|---|---|---|---|---|---|
| 1 | 190.51 | 257.18 | 258.98 | 258.68 | 247.49 | 318.04 | 236.54 | 250.32 |
| 2 | 0.04 | 0.09 | 0.11 | 0.10 | 0.11 | 0.10 | 0.09 | 0.10 |
| 3 | 19.52 | 23.92 | 24.42 | 23.83 | 24.27 | 22.32 | 24.14 | 22.45 |
| 4 | 33.83 | 61.12 | 73.65 | 58.86 | 63.71 | 85.51 | 81.02 | 63.51 |
| 5 | 32.07 | 57.95 | 70.32 | 55.76 | 59.91 | 83.74 | 77.89 | 60.15 |
| 6 | 30.90 | 43.75 | 49.35 | 42.31 | 44.59 | 54.27 | 55.12 | 44.79 |
| 7 | 3.63 | 4.64 | 4.73 | 4.80 | 4.74 | 5.06 | 4.82 | 4.68 |
| 8 | 53.17 | 94.30 | 116.40 | 95.20 | 108.23 | 99.50 | 85.33 | 119.53 |
| 9 | 11.79 | 16.89 | 19.64 | 15.89 | 17.46 | 20.96 | 21.01 | 17.78 |
| 10 | 11.56 | 13.33 | 14.87 | 13.50 | 14.40 | 12.67 | 14.07 | 14.47 |
| 11 | 0.05 | 0.14 | 0.16 | 0.13 | 0.14 | 0.17 | 0.15 | 0.14 |
| 12 | 0.94 | 0.95 | 0.95 | 0.95 | 0.94 | 0.98 | 0.96 | 0.94 |
| 13 | 2.62 | 3.20 | 3.14 | 3.19 | 3.12 | 3.35 | 3.10 | 3.10 |
| 14 | 0.47 | 0.68 | 0.65 | 0.68 | 0.65 | 0.75 | 0.62 | 0.64 |
| 15 | 0.82 | 1.05 | 1.06 | 1.05 | 1.05 | 1.11 | 1.02 | 1.06 |
| 16 | 0.72 | 0.82 | 0.78 | 0.82 | 0.79 | 0.86 | 0.77 | 0.76 |
| 17 | 0.05 | 0.09 | 0.11 | 0.08 | 0.10 | 0.12 | 0.10 | 0.10 |
| 18 | 46.99 | 45.42 | 47.01 | 42.40 | 44.89 | 52.35 | 50.79 | 46.04 |
| 19 | 2875.33 | 5230.00 | 5543.00 | 5524.83 | 5515.33 | 5863.50 | 5537.17 | 6546.17 |
| 20 | 0.20 | 0.26 | 0.28 | 0.29 | 0.26 | 0.27 | 0.25 | 0.33 |
| 21 | 3.44 | 4.90 | 5.60 | 4.47 | 5.57 | 4.83 | 4.13 | 5.53 |
| 22 | 46.00 | 42.00 | 42.00 | 41.67 | 45.00 | 45.00 | 43.00 | 47.60 |
| 23 | 46.00 | 45.00 | 45.00 | 43.50 | 45.00 | 45.00 | 46.00 | 45.00 |
| 24 | 152.2 | 234.18 | 254.80 | 238.93 | 241.08 | 238.43 | 225.10 | 256.28 |
| 25 | 4.53 | 7.38 | 7.75 | 8.07 | 7.29 | 7.67 | 6.94 | 8.80 |
| 26 | 19.12 | 23.25 | 23.22 | 22.86 | 24.09 | 24.23 | 23.71 | 22.75 |
| 27 | 0.52 | 1.21 | 1.50 | 1.24 | 1.35 | 1.44 | 1.29 | 1.29 |

Table 28: Correlation IDs: 1, 2, 3, 4, 5, . . . etc. refer to those described in Table 27 above [Maize correlated parameters (vectors)].

TABLE 29

Measured parameters in Maize accessions under normal conditions

| Ecotype/Treatment | Line-9 | Line-10 | Line-11 | Line-12 | Line-13 | Line-14 | Line-15 | Line-16 |
|---|---|---|---|---|---|---|---|---|
| 1 | 280.76 | 169.91 | 255.84 | 213.97 | 264.06 | 253.92 | 284.00 | 221.00 |
| 2 | 0.09 | 0.06 | 0.10 | 0.13 | 0.11 | 0.12 | 0.11 | 0.11 |
| 3 | 26.97 | 21.72 | 24.13 | 22.20 | 24.56 | 23.69 | 23.81 | 23.21 |
| 4 | 57.70 | 27.36 | 63.38 | 53.07 | 78.65 | 76.72 | 76.57 | 63.37 |
| 5 | 52.92 | 26.33 | 57.48 | 41.25 | 74.89 | 75.09 | 69.95 | 57.74 |
| 6 | 41.33 | 29.58 | 45.78 | 46.42 | 53.45 | 50.69 | 52.89 | 46.42 |
| 7 | 4.86 | 3.70 | 4.54 | 3.87 | 4.89 | 4.80 | 4.70 | 4.44 |
| 8 | 101.93 | 74.67 | 80.80 | 120.07 | 102.46 | 110.30 | 100.83 | 124.33 |
| 9 | 15.47 | 9.14 | 18.01 | 17.41 | 20.52 | 19.72 | 20.76 | 18.45 |
| 10 | 14.63 | 13.13 | 14.17 | 12.96 | 13.88 | 14.37 | 13.41 | 15.03 |
| 11 | 0.13 | 0.05 | 0.12 | 0.08 | 0.15 | 0.15 | 0.13 | 0.12 |
| 12 | 0.90 | 0.94 | 0.90 | 0.74 | 0.95 | 0.98 | 0.89 | 0.89 |
| 13 | 3.29 | 2.65 | 3.13 | 2.77 | 3.19 | 3.13 | 3.21 | 3.03 |
| 14 | 0.71 | 0.46 | 0.65 | 0.52 | 0.68 | 0.64 | 0.69 | 0.60 |
| 15 | 1.13 | 0.84 | 1.02 | 0.93 | 1.07 | 1.05 | 1.04 | 1.01 |
| 16 | 0.80 | 0.70 | 0.81 | 0.70 | 0.80 | 0.77 | 0.84 | 0.75 |
| 17 | 0.09 | 0.04 | 0.07 | 0.05 | 0.11 | 0.10 | 0.09 | 0.08 |
| 18 | 43.17 | 37.90 | 42.30 | 27.73 | 45.90 | 45.17 | 43.27 | 36.54 |
| 19 | 5916.33 | 3426.67 | 5848.33 | 4930.83 | 6303.17 | 5042.33 | 5144.17 | 6057.33 |
| 20 | 0.27 | 0.25 | 0.25 | 0.24 | 0.26 | 0.26 | 0.25 | 0.23 |
| 21 | 5.10 | 4.27 | 4.17 | 6.50 | 5.08 | 5.13 | 4.40 | 5.30 |
| 22 | 41.67 | 41.60 | 42.00 | 45.50 | 45.00 | 42.00 | 45.00 | 45.33 |
| 23 | 47.20 | 53.00 | 45.00 | 45.00 | 45.25 | 45.50 | 48.00 | 46.00 |
| 24 | 225.08 | 191.73 | 231.07 | 237.17 | 242.83 | 246.03 | 254.93 | 260.87 |
| 25 | 7.07 | 5.71 | 6.58 | 6.18 | 7.03 | 7.15 | 7.85 | 7.70 |
| 26 | 22.16 | 19.09 | 23.23 | 23.05 | 22.29 | 23.54 | 22.34 | 22.94 |
| 27 | 1.16 | 0.61 | 1.19 | 1.17 | 1.42 | 1.49 | 1.34 | 1.27 |

Table 29: Correlation IDs: 1, 2, 3, 4, 5, . . . etc. refer to those described in Table 27 above [Maize correlated parameters (vectors)].

TABLE 30

Measured parameters in Maize accessions under normal conditions

| Ecotype/Treatment | Line-17 | Line-18 | Line-19 | Line-20 | Line-21 | Line-22 | Line-23 | Line-24 |
|---|---|---|---|---|---|---|---|---|
| 1 | 205.45 | 227.12 | 264.61 | 219.47 | 245.06 | 224.95 | 275.42 | 262.93 |
| 2 | 0.13 | 0.11 | 0.12 | 0.13 | 0.11 | 0.08 | 0.09 | 0.10 |
| 3 | 22.67 | 22.24 | 26.06 | 24.58 | 24.83 | 23.39 | 24.22 | 24.32 |
| 4 | 59.16 | 66.15 | 73.40 | 69.68 | 67.24 | 43.51 | 55.21 | 55.49 |
| 5 | 56.29 | 62.09 | 68.49 | 67.66 | 61.63 | 39.49 | 53.28 | 53.33 |
| 6 | 43.78 | 51.44 | 50.92 | 48.58 | 46.61 | 35.27 | 40.79 | 45.11 |
| 7 | 4.40 | 4.31 | 4.74 | 4.59 | 4.64 | 4.25 | 4.72 | 4.67 |
| 8 | 126.97 | 123.37 | 90.00 | 131.89 | 135.97 | 97.00 | 105.67 | 102.33 |
| 9 | 17.31 | 19.43 | 20.02 | 19.01 | 18.32 | 13.20 | 14.88 | 15.25 |
| 10 | 14.61 | 13.91 | 15.30 | 16.13 | 15.61 | 14.26 | 15.00 | 14.50 |
| 11 | 0.12 | 0.12 | 0.14 | 0.14 | 0.15 | 0.08 | 0.15 | 0.13 |
| 12 | 0.95 | 0.90 | 0.93 | 0.97 | 0.90 | 0.90 | 0.96 | 0.96 |
| 13 | 2.94 | 3.04 | 3.25 | 2.95 | 3.03 | 2.91 | 3.20 | 3.29 |
| 14 | 0.57 | 0.61 | 0.68 | 0.57 | 0.60 | 0.56 | 0.67 | 0.69 |
| 15 | 1.01 | 1.03 | 1.09 | 1.02 | 1.04 | 0.95 | 1.08 | 1.12 |
| 16 | 0.71 | 0.75 | 0.79 | 0.70 | 0.72 | 0.75 | 0.79 | 0.79 |
| 17 | 0.08 | 0.10 | 0.11 | 0.11 | 0.09 | 0.05 | 0.09 | 0.10 |
| 18 | 36.76 | 41.35 | 42.83 | 43.89 | 43.43 | 37.89 | 48.12 | 46.48 |
| 19 | 6247.50 | 5918.00 | 5621.75 | 6480.33 | 6408.17 | 4056.67 | 5556.50 | 4626.50 |
| 20 | 0.31 | 0.29 | 0.23 | 0.33 | 0.26 | 0.23 | 0.29 | 0.29 |
| 21 | 6.53 | 5.71 | 4.25 | 6.05 | 6.27 | 5.23 | 4.83 | 5.17 |
| 22 | 40.75 | 41.00 | 38.33 | 40.00 | 42.00 | 40.80 | 44.33 | 42.00 |
| 23 | 45.00 | 48.00 | 48.00 | 41.33 | 41.00 | 41.33 | 41.40 | 45.25 |
| 24 | 260.30 | 255.79 | 233.72 | 264.12 | 266.64 | 204.50 | 249.67 | 237.17 |
| 25 | 8.04 | 8.11 | 6.48 | 8.19 | 7.38 | 5.96 | 7.51 | 7.41 |
| 26 | 24.58 | 23.27 | 24.68 | 25.08 | 23.13 | 20.79 | 21.13 | 20.63 |
| 27 | 1.37 | 1.29 | 1.40 | 1.47 | 1.41 | 0.92 | 1.28 | 1.22 |

Table 30: Correlation IDs: 1, 2, 3, 4, 5, . . . etc. refer to those described in Table 27 above [Maize correlated parameters (vectors)].

TABLE 31

Measured parameters in Maize accessions under normal conditions

| Ecotype/Treatment | Line-25 | Line-26 | Line-27 | Line-28 | Line-29 | Line-30 | Line-31 | Line-32 |
|---|---|---|---|---|---|---|---|---|
| 1 | 245.85 | 262.71 | 239.16 | 255.66 | 303.25 | 214.93 | 228.10 | 254.51 |
| 2 | 0.10 | 0.13 | 0.11 | 0.09 | 0.14 | 0.10 | 0.14 | 0.11 |
| 3 | 23.69 | 24.03 | 24.05 | 23.29 | 24.80 | 24.66 | 25.13 | 26.11 |
| 4 | 68.01 | 60.04 | 73.03 | 58.82 | 94.18 | 69.44 | 73.03 | 65.02 |
| 5 | 62.50 | 56.82 | 69.42 | 56.12 | 90.14 | 64.64 | 70.46 | 60.11 |
| 6 | 46.30 | 42.55 | 46.67 | 41.90 | 54.03 | 49.72 | 46.90 | 42.72 |
| 7 | 4.91 | 4.71 | 5.24 | 4.66 | 5.64 | 4.41 | 4.98 | 5.04 |
| 8 | 95.69 | 128.67 | 119.69 | 91.05 | 108.33 | 88.78 | 129.83 | 121.67 |
| 9 | 17.65 | 16.24 | 17.91 | 16.32 | 20.96 | 20.05 | 18.49 | 16.63 |
| 10 | 14.88 | 15.67 | 16.23 | 13.63 | 14.67 | 15.33 | 17.17 | 15.47 |
| 11 | 0.12 | 0.16 | 0.15 | 0.13 | 0.21 | 0.12 | 0.16 | 0.14 |
| 12 | 0.91 | 0.94 | 0.95 | 0.95 | 0.96 | 0.93 | 0.96 | 0.92 |
| 13 | 3.19 | 3.22 | 3.14 | 3.19 | 3.40 | 2.96 | 3.01 | 3.21 |
| 14 | 0.66 | 0.66 | 0.63 | 0.68 | 0.76 | 0.56 | 0.58 | 0.67 |
| 15 | 1.05 | 1.11 | 1.09 | 1.06 | 1.17 | 0.97 | 1.03 | 1.08 |
| 16 | 0.80 | 0.76 | 0.74 | 0.81 | 0.82 | 0.73 | 0.72 | 0.79 |
| 17 | 0.09 | 0.11 | 0.10 | 0.09 | 0.12 | 0.08 | 0.11 | 0.09 |
| 18 | 42.18 | 44.27 | 44.69 | 47.94 | 46.14 | 40.60 | 38.88 | 41.87 |
| 19 | 5196.50 | 5537.50 | 6175.17 | 5007.17 | 7017.00 | 4816.75 | 6441.83 | 5872.83 |
| 20 | 0.26 | 0.28 | 0.29 | 0.29 | 0.28 | 0.18 | 0.29 | 0.26 |
| 21 | 4.28 | 5.67 | 5.87 | 4.63 | 5.33 | 4.89 | 5.67 | 5.83 |
| 22 | 47.00 | 41.75 | 43.50 | 45.50 | 46.00 | 45.00 | 45.00 | 48.50 |
| 23 | 41.33 | 45.00 | 48.00 | 45.00 | 45.00 | 48.50 | 45.00 | 42.00 |
| 24 | 232.25 | 269.17 | 251.29 | 223.38 | 250.00 | 219.17 | 267.83 | 238.70 |
| 25 | 7.85 | 8.57 | 7.53 | 7.65 | 7.95 | 5.08 | 8.13 | 7.29 |
| 26 | 21.52 | 22.55 | 22.96 | 21.70 | 24.87 | 24.05 | 24.16 | 22.00 |
| 27 | 1.24 | 1.57 | 1.44 | 1.19 | 1.86 | 1.13 | 1.61 | 1.37 |

Table 31: Correlation IDs: 1, 2, 3, 4, 5, . . . etc. refer to those described in Table 27 above [Maize correlated parameters (vectors)].

TABLE 32

Measured parameters in Maize accessions under normal conditions

| Ecotype/Treatment | Line-33 | Line-34 | Line-35 | Line-36 | Line-37 | Line-38 | Line-39 | Line-4s0 |
|---|---|---|---|---|---|---|---|---|
| 1 | 213.20 | 284.32 | 233.47 | 236.14 | 190.80 | 221.89 | 189.77 | 209.58 |
| 2 | 0.11 | 0.11 | 0.11 | 0.11 | 0.12 | 0.12 | 0.12 | 0.10 |
| 3 | 25.25 | 25.19 | 24.53 | 26.04 | 26.57 | 25.71 | 23.73 | 23.75 |
| 4 | 66.12 | 85.22 | 67.49 | 66.13 | 63.71 | 84.61 | 61.91 | 57.69 |
| 5 | 62.19 | 81.10 | 65.83 | 61.12 | 60.01 | 81.22 | 58.40 | 55.27 |
| 6 | 46.09 | 55.31 | 46.40 | 47.32 | 44.34 | 52.18 | 43.42 | 42.21 |
| 7 | 4.70 | 5.26 | 4.77 | 4.94 | 4.61 | 5.10 | 4.59 | 4.51 |
| 8 | 102.93 | 96.50 | 93.92 | 106.39 | 108.00 | 111.50 | 132.33 | 100.67 |
| 9 | 18.01 | 20.42 | 17.67 | 17.60 | 17.31 | 20.82 | 17.27 | 16.55 |
| 10 | 15.53 | 14.00 | 14.67 | 16.67 | 17.17 | 16.67 | 16.57 | 13.89 |
| 11 | 0.14 | 0.17 | 0.14 | 0.14 | 0.14 | 0.18 | 0.12 | 0.12 |
| 12 | 0.94 | 0.95 | 0.97 | 0.92 | 0.94 | 0.96 | 0.94 | 0.96 |
| 13 | 2.95 | 3.21 | 3.11 | 3.04 | 2.81 | 3.11 | 2.81 | 2.93 |
| 14 | 0.57 | 0.69 | 0.63 | 0.61 | 0.51 | 0.62 | 0.51 | 0.57 |
| 15 | 1.02 | 1.09 | 1.04 | 1.05 | 0.98 | 1.08 | 0.97 | 0.98 |
| 16 | 0.71 | 0.81 | 0.77 | 0.73 | 0.66 | 0.73 | 0.66 | 0.74 |
| 17 | 0.08 | 0.11 | 0.10 | 0.10 | 0.08 | 0.12 | 0.08 | 0.09 |
| 18 | 40.79 | 47.36 | 42.93 | 40.96 | 38.94 | 47.25 | 38.09 | 43.84 |
| 19 | 5230.50 | 6099.50 | 4960.17 | 5974.33 | 6490.25 | 7194.50 | 6731.00 | 5271.83 |
| 20 | 0.26 | 0.30 | 0.28 | 0.15 | 0.30 | 0.25 | 0.30 | 0.29 |
| 21 | 6.07 | 5.17 | 4.83 | 5.17 | 6.08 | 5.25 | 6.23 | 5.22 |
| 22 | 48.00 | 49.00 | 46.00 | 48.20 | 48.00 | 45.33 | 55.00 | 45.20 |
| 23 | 45.50 | 48.00 | 45.50 | 48.33 | 47.00 | 47.00 | 48.00 | 45.33 |
| 24 | 217.45 | 232.17 | 240.46 | 247.39 | 238.08 | 265.42 | 263.90 | 237.72 |
| 25 | 6.13 | 7.90 | 7.02 | 6.13 | 7.22 | 7.27 | 7.74 | 7.34 |
| 26 | 24.83 | 24.59 | 24.51 | 24.60 | 25.22 | 25.44 | 23.67 | 22.36 |
| 27 | 1.33 | 1.51 | 1.37 | 1.34 | 1.39 | 1.64 | 1.29 | 1.21 |

Table 32. Correlation IDs: 1, 2, 3, 4, 5, . . . etc. refer to those described in Table 27 above [Maize correlated parameters (vectors)].

TABLE 33

Measured parameters in Maize accessions under normal conditions

| Ecotype/Treatment | Line-41 | Line-42 | Line-43 | Line-44 | Line-45 | Line-46 | Line-47 | Line-48 |
|---|---|---|---|---|---|---|---|---|
| 1 | 163.36 | 162.24 | 204.98 | 234.99 | 244.33 | 237.54 | 212.39 | 96.70 |
| 2 | 0.11 | 0.14 | 0.13 | 0.16 | 0.12 | 0.12 | 0.05 | 0.09 |
| 3 | 22.88 | 23.40 | 26.01 | 26.64 | 26.55 | 21.63 | 21.76 | 17.21 |
| 4 | 57.08 | 57.70 | 72.64 | 77.81 | 72.24 | 44.63 | 39.61 | 27.53 |
| 5 | 55.46 | 54.92 | 68.86 | 72.94 | 68.58 | 41.47 | 37.69 | 24.47 |
| 6 | 44.25 | 41.44 | 48.09 | 49.39 | 45.18 | 35.50 | 34.49 | 31.43 |
| 7 | 4.04 | 4.34 | 4.90 | 5.08 | 5.27 | 4.06 | 3.63 | 2.81 |
| 8 | 152.87 | 152.97 | 115.79 | 140.56 | 117.96 | 130.46 | 45.17 | 122.03 |
| 9 | 17.58 | 16.66 | 19.06 | 19.42 | 17.57 | 13.65 | 13.48 | 12.24 |
| 10 | 16.03 | 16.77 | 16.50 | 16.79 | 16.83 | 13.13 | 13.32 | 12.20 |
| 11 | 0.11 | 0.11 | 0.15 | 0.18 | 0.16 | 0.07 | 0.07 | 0.03 |
| 12 | 0.97 | 0.94 | 0.95 | 0.92 | 0.95 | 0.92 | 0.93 | 0.88 |
| 13 | 2.55 | 2.69 | 3.04 | 3.10 | 3.17 | 2.85 | 2.71 | 2.02 |
| 14 | 0.43 | 0.47 | 0.60 | 0.62 | 0.64 | 0.54 | 0.51 | 0.27 |
| 15 | 0.88 | 0.92 | 1.03 | 1.08 | 1.11 | 0.94 | 0.86 | 0.69 |
| 16 | 0.62 | 0.65 | 0.73 | 0.73 | 0.73 | 0.73 | 0.74 | 0.50 |
| 17 | 0.08 | 0.07 | 0.10 | 0.12 | 0.10 | 0.05 | 0.04 | 0.01 |
| 18 | 39.50 | 33.74 | 42.36 | 39.27 | 43.54 | 29.73 | 47.67 | 16.59 |
| 19 | 6063.00 | 7723.00 | 6796.33 | 8181.75 | 5685.67 | 4841.17 | 3036.33 | 4221.83 |
| 20 | 0.32 | 0.24 | 0.18 | 0.25 | 0.22 | 0.26 | 0.21 | 0.22 |
| 21 | 7.17 | 6.97 | 5.42 | 6.50 | 5.54 | 6.17 | 3.03 | 6.97 |
| 22 | 42.00 | 45.00 | 42.00 | 45.00 | 43.50 | 46.00 | 48.67 | 44.25 |
| 23 | 53.00 | 45.00 | 54.50 | 48.00 | 46.00 | 54.00 | 47.33 | 45.00 |
| 24 | 270.13 | 289.47 | 264.62 | 278.94 | 250.33 | 249.83 | 151.63 | 213.21 |
| 25 | 8.45 | 7.54 | 6.72 | 7.57 | 5.98 | 5.97 | 4.66 | 6.03 |
| 26 | 23.36 | 24.72 | 24.56 | 26.62 | 23.10 | 21.21 | 20.18 | 21.42 |
| 27 | 1.21 | 1.34 | 1.49 | 1.86 | 1.48 | 1.16 | 0.63 | 0.69 |

Table 33. Correlation IDs: 1, 2, 3, 4, 5, ... etc. refer to those described in Table 27 above [Maize correlated parameters (vectors)].

TABLE 34

Measured parameters in Maize accessions under normal conditions

| Ecotype/Treatment | Line-49 | Line-50 | Line-51 | Line-52 | Line-53 | Line-54 | Line-55 | Line-56 |
|---|---|---|---|---|---|---|---|---|
| 1 | 261.45 | 247.02 | 226.98 | 229.90 | 223.89 | 266.77 | 247.68 | 212.41 |
| 2 | 0.07 | 0.12 | 0.12 | 0.08 | 0.13 | 0.11 | 0.12 | 0.11 |
| 3 | 16.47 | 22.15 | 21.28 | 16.89 | 24.28 | 24.82 | 24.44 | 25.20 |
| 4 | 40.38 | 72.46 | 84.80 | 27.60 | 65.29 | 72.97 | 69.25 | 71.51 |
| 5 | 30.89 | 70.21 | 83.08 | 18.69 | 58.53 | 68.17 | 62.29 | 65.30 |
| 6 | 42.66 | 53.45 | 56.32 | 29.01 | 50.34 | 51.55 | 47.17 | 49.75 |
| 7 | 3.24 | 4.42 | 4.60 | 3.05 | 4.25 | 4.92 | 4.79 | 4.68 |
| 8 | 92.03 | 129.67 | 103.28 | 82.54 | 100.40 | 101.33 | 106.90 | 125.78 |
| 9 | 16.57 | 20.41 | 23.01 | 11.42 | 19.50 | 18.52 | 18.56 | 19.26 |
| 10 | 9.95 | 13.94 | 13.67 | 6.71 | 14.19 | 15.17 | 14.75 | 16.30 |
| 11 | 0.05 | 0.15 | 0.15 | 0.03 | 0.10 | 0.17 | 0.13 | 0.12 |
| 12 | 0.73 | 0.97 | 0.98 | 0.65 | 0.89 | 0.93 | 0.87 | 0.90 |
| 13 | 2.93 | 3.10 | 3.02 | 2.57 | 2.90 | 3.20 | 3.13 | 2.97 |
| 14 | 0.58 | 0.63 | 0.60 | 0.45 | 0.56 | 0.67 | 0.64 | 0.57 |
| 15 | 0.94 | 1.05 | 1.01 | 0.81 | 0.95 | 1.08 | 1.03 | 1.01 |
| 16 | 0.78 | 0.76 | 0.75 | 0.70 | 0.75 | 0.78 | 0.79 | 0.71 |
| 17 | 0.02 | 0.10 | 0.11 | 0.01 | 0.07 | 0.09 | 0.07 | 0.09 |
| 18 | 30.03 | 43.39 | 46.96 | 12.14 | 32.82 | 44.89 | 37.82 | 43.41 |
| 19 | 3521.17 | 6460.17 | 5934.17 | 3966.17 | 5898.00 | 6248.83 | 5150.67 | 6197.83 |
| 20 | 0.19 | 0.27 | 0.25 | 0.15 | 0.18 | 0.26 | 0.21 | 0.25 |
| 21 | 4.73 | 5.89 | 4.72 | 5.79 | 4.80 | 4.44 | 5.13 | 5.17 |
| 22 | | | | | | | | |
| 23 | 46.00 | 46.00 | 44.50 | 47.00 | 45.00 | 45.67 | 47.33 | 49.00 |
| 24 | 204.70 | 266.94 | 249.50 | 195.96 | 244.73 | 264.39 | 251.72 | 277.00 |
| 25 | 5.63 | 7.75 | 7.49 | 3.64 | 5.70 | 7.28 | 6.55 | 7.63 |
| 26 | 19.18 | 23.09 | 24.67 | 21.14 | 23.81 | 23.46 | 25.20 | 22.17 |
| 27 | 0.68 | 1.51 | 1.47 | 0.62 | 1.35 | 1.55 | 1.38 | 1.26 |

Table 34: Correlation IDs: 1, 2, 3, 4, 5, ... etc. refer to those described in Table 27 above [Maize correlated parameters (vectors)].

TABLE 35

Measured parameters in Maize accessions under normal conditions

| Ecotype/Treatment | Line-57 | Line-58 | Line-59 | Line-60 | Line-61 | Line-62 | Line-63 | Line-64 |
|---|---|---|---|---|---|---|---|---|
| 1 | 240.39 | 202.45 | 238.09 | 272.16 | 227.76 | 256.12 | 218.50 | 228.72 |
| 2 | 0.12 | 0.11 | 0.09 | 0.10 | 0.12 | 0.11 | 0.15 | 0.10 |
| 3 | 22.78 | 24.20 | 23.54 | 23.00 | 23.40 | 25.60 | 24.04 | 25.34 |
| 4 | 69.09 | 78.70 | 73.52 | 75.59 | 68.66 | 74.97 | 66.97 | 71.79 |
| 5 | 65.69 | 76.13 | 70.12 | 73.11 | 64.40 | 70.84 | 63.35 | 68.26 |
| 6 | 47.33 | 50.88 | 51.14 | 53.61 | 47.34 | 47.60 | 52.23 | 47.09 |
| 7 | 4.85 | 4.80 | 4.70 | 4.62 | 4.72 | 5.13 | 4.42 | 4.95 |
| 8 | 105.95 | 118.02 | 98.23 | 112.54 | 132.73 | 127.80 | 148.60 | 98.10 |
| 9 | 18.18 | 20.37 | 19.59 | 20.48 | 18.87 | 18.59 | 18.91 | 18.11 |
| 10 | 15.13 | 15.97 | 13.77 | 13.77 | 15.97 | 15.83 | 16.49 | 16.20 |
| 11 | 0.14 | 0.14 | 0.14 | 0.14 | 0.14 | 0.16 | 0.12 | 0.14 |
| 12 | 0.93 | 0.97 | 0.95 | 0.97 | 0.93 | 0.94 | 0.94 | 0.94 |
| 13 | 3.14 | 2.95 | 3.13 | 3.16 | 3.01 | 3.18 | 2.89 | 3.00 |
| 14 | 0.64 | 0.56 | 0.64 | 0.67 | 0.59 | 0.66 | 0.54 | 0.59 |
| 15 | 1.04 | 1.01 | 1.03 | 1.06 | 1.04 | 1.08 | 1.01 | 1.03 |
| 16 | 0.78 | 0.70 | 0.78 | 0.80 | 0.72 | 0.77 | 0.68 | 0.72 |
| 17 | 0.10 | 0.09 | 0.10 | 0.10 | 0.09 | 0.09 | 0.09 | 0.09 |
| 18 | 43.42 | 43.67 | 50.32 | 46.29 | 40.66 | 44.06 | 36.22 | 46.26 |
| 19 | 5762.83 | 7229.83 | 5846.33 | 6018.67 | 7234.17 | 6496.17 | 7163.83 | 5400.17 |
| 20 | 0.24 | 0.30 | 0.26 | 0.27 | 0.31 | 0.26 | 0.20 | 0.27 |
| 21 | 4.93 | 5.80 | 4.80 | 5.04 | 5.60 | 5.87 | 6.50 | 4.97 |
| 22 | | | | | | | | |
| 23 | 46.67 | | | | | | | |
| 24 | 249.00 | 253.16 | 243.61 | 258.15 | 270.92 | 273.64 | 277.87 | 227.15 |
| 25 | 6.87 | 8.19 | 7.03 | 7.57 | 9.02 | 7.77 | 6.98 | 6.93 |
| 26 | 21.61 | 24.13 | 22.80 | 23.72 | 23.16 | 21.94 | 25.20 | 21.50 |
| 27 | 1.39 | 1.34 | 1.24 | 1.29 | 1.40 | 1.43 | 1.56 | 1.29 |

Table 35. Correlation IDs: 1, 2, 3, 4, 5, . . . etc. refer to those described in Table 27 above [Maize correlated parameters (vectors)].

TABLE 36

Correlation between the expression level of selected genes of some embodiments of the invention in various tissues and the phenotypic performance of maintenance of performance under drought conditions across maize varieties

| Gene Name | R | P value | Exp. set | Corr. Set ID | Gene Name | R | P value | Exp. set | Corr. Set ID |
|---|---|---|---|---|---|---|---|---|---|
| WYM104 | 0.85 | 9.12E−04 | 4 | 23 | WYM104 | 0.71 | 6.86E−05 | 2 | 18 |
| WYM105 | 0.71 | 6.04E−04 | 3 | 18 | WYM106 | 0.73 | 6.87E−03 | 4 | 5 |
| WYM106 | 0.72 | 8.70E−03 | 4 | 17 | WYM106 | 0.73 | 7.56E−03 | 4 | 11 |
| WYM106 | 0.71 | 9.85E−03 | 4 | 12 | WYM106 | 0.74 | 6.40E−03 | 4 | 10 |
| WYM106 | 0.81 | 1.27E−03 | 4 | 18 | WYM106 | 0.75 | 5.38E−03 | 4 | 7 |
| WYM106 | 0.71 | 9.56E−03 | 4 | 3 | WYM107 | 0.72 | 8.42E−03 | 4 | 5 |
| WYM107 | 0.78 | 2.50E−03 | 4 | 17 | WYM107 | 0.78 | 2.65E−03 | 4 | 11 |
| WYM107 | 0.74 | 6.11E−03 | 4 | 25 | WYM107 | 0.77 | 3.19E−03 | 4 | 18 |
| WYM107 | 0.70 | 1.06E−02 | 4 | 4 | WYM107 | 0.72 | 8.55E−03 | 4 | 7 |
| WYM107 | 0.73 | 7.59E−03 | 4 | 3 | WYM107 | 0.71 | 9.65E−03 | 4 | 6 |
| WYM108 | 0.74 | 2.69E−04 | 3 | 18 | WYM108 | 0.74 | 6.00E−03 | 4 | 25 |
| WYM47 | 0.76 | 4.11E−03 | 4 | 15 | WYM47 | 0.79 | 2.35E−03 | 4 | 25 |
| WYM47 | 0.73 | 7.58E−03 | 4 | 18 | WYM47 | 0.80 | 1.75E−03 | 4 | 14 |
| WYM47 | 0.77 | 3.15E−03 | 4 | 13 | WYM47 | 0.74 | 5.86E−03 | 4 | 7 |
| WYM47 | 0.70 | 1.09E−02 | 4 | 3 | WYM47 | 0.70 | 1.10E−02 | 4 | 20 |
| WYM47 | 0.74 | 6.36E−03 | 4 | 16 | WYM48 | 0.72 | 8.60E−03 | 4 | 17 |
| WYM48 | 0.75 | 5.41E−03 | 4 | 11 | WYM48 | 0.80 | 1.68E−03 | 4 | 18 |
| WYM48 | 0.72 | 7.99E−03 | 4 | 7 | WYM48 | 0.74 | 6.01E−03 | 4 | 3 |
| WYM55 | 0.74 | 5.92E−03 | 4 | 5 | WYM55 | 0.75 | 5.16E−03 | 4 | 17 |
| WYM55 | 0.81 | 1.36E−03 | 4 | 18 | WYM55 | 0.71 | 9.45E−03 | 4 | 4 |
| WYM55 | 0.75 | 4.99E−03 | 4 | 6 | WYM56 | 0.73 | 7.04E−03 | 4 | 5 |
| WYM56 | 0.83 | 8.09E−04 | 4 | 17 | WYM56 | 0.86 | 3.00E−04 | 4 | 11 |
| WYM56 | 0.87 | 2.80E−04 | 4 | 15 | WYM56 | 0.74 | 5.74E−03 | 4 | 25 |
| WYM56 | 0.75 | 4.73E−03 | 4 | 18 | WYM56 | 0.83 | 8.97E−04 | 4 | 14 |
| WYM56 | 0.81 | 1.41E−03 | 4 | 13 | WYM56 | 0.73 | 6.51E−03 | 4 | 4 |
| WYM56 | 0.81 | 1.31E−03 | 4 | 7 | WYM56 | 0.81 | 1.57E−03 | 4 | 3 |
| WYM56 | 0.77 | 3.43E−03 | 4 | 27 | WYM56 | 0.78 | 2.52E−03 | 4 | 19 |
| WYM58 | 0.80 | 1.94E−03 | 4 | 5 | WYM58 | 0.86 | 3.30E−04 | 4 | 17 |
| WYM58 | 0.82 | 1.20E−03 | 4 | 11 | WYM58 | 0.77 | 3.62E−03 | 4 | 15 |
| WYM58 | 0.91 | 4.96E−05 | 4 | 18 | WYM58 | 0.75 | 4.93E−03 | 4 | 14 |
| WYM58 | 0.76 | 3.98E−03 | 4 | 13 | WYM58 | 0.78 | 2.76E−03 | 4 | 4 |
| WYM58 | 0.80 | 1.68E−03 | 4 | 7 | WYM58 | 0.79 | 2.15E−03 | 4 | 3 |
| WYM58 | 0.78 | 3.01E−03 | 4 | 6 | WYM64 | 0.74 | 6.08E−03 | 4 | 17 |

TABLE 36-continued

Correlation between the expression level of selected genes of some embodiments of the invention in various tissues and the phenotypic performance of maintenance of performance under drought conditions across maize varieties

| Gene Name | R | P value | Exp. set | Corr. Set ID | Gene Name | R | P value | Exp. set | Corr. Set ID |
|---|---|---|---|---|---|---|---|---|---|
| WYM64 | 0.73 | 6.57E−03 | 4 | 11 | WYM64 | 0.73 | 6.63E−03 | 4 | 15 |
| WYM64 | 0.75 | 5.19E−03 | 4 | 18 | WYM64 | 0.79 | 2.27E−03 | 4 | 14 |
| WYM64 | 0.77 | 3.16E−03 | 4 | 13 | WYM64 | 0.73 | 6.63E−03 | 4 | 7 |
| WYM64 | 0.76 | 4.17E−03 | 4 | 16 | WYM64 | 0.75 | 4.59E−03 | 4 | 5 |
| WYM67 | 0.74 | 6.29E−03 | 4 | 17 | WYM67 | 0.72 | 7.99E−03 | 4 | 11 |
| WYM67 | 0.72 | 8.11E−03 | 4 | 18 | WYM67 | 0.74 | 6.20E−03 | 4 | 4 |
| WYM67 | 0.71 | 9.69E−03 | 4 | 3 | WYM67 | 0.75 | 5.11E−03 | 4 | 6 |
| WYM69 | 0.83 | 8.10E−04 | 4 | 21 | WYM98 | 0.78 | 2.71E−03 | 4 | 17 |
| WYM98 | 0.72 | 8.14E−03 | 4 | 11 | WYM98 | 0.73 | 6.72E−03 | 4 | 15 |
| WYM98 | 0.76 | 4.34E−03 | 4 | 25 | WYM98 | 0.82 | 2.22E−03 | 4 | 23 |
| WYM98 | 0.80 | 1.79E−03 | 4 | 18 | WYM98 | 0.74 | 5.63E−03 | 4 | 14 |
| WYM98 | 0.73 | 7.01E−03 | 4 | 13 | WYM98 | 0.74 | 5.57E−03 | 4 | 7 |
| WYM98 | 0.74 | 5.73E−03 | 4 | 3 | WYM98 | 0.71 | 1.04E−02 | 4 | 19 |

Table 36. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

Example 8

Production of *Brachypodium* Transcriptome and High Throughput Correlation Analysis Using 60K *Brachypodium* Oligonucleotide Micro-Array In order to produce a high throughput correlation analysis comparing between plant phenotype and gene expression level, the present inventors utilized a *brachypodium* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60K *brachypodium* genes and transcripts. In order to define correlations between the levels of RNA expression and yield or vigor related parameters, various plant characteristics of 24 different *brachypodium* accessions were analyzed. Among them, 22 accessions encompassing the observed variance were selected for RNA expression analysis and comparative genomic hybridization (CGH) analysis.

The correlation between the RNA levels and the characterized parameters was analyzed using Pearson correlation test [Hypertext Transfer Protocol://World Wide Web (dot) davidmlane (dot) com/hyperstat/A34739 (dot) html].

Additional correlation analysis was done by comparing plant phenotype and gene copy number. The correlation between the normalized copy number hybridization signal and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Brachypodium* tissues—two tissues [leaf and spike] were sampled and RNA was extracted as described above. Each micro-array expression information tissue type has received a Set ID as summarized in Table 37 below.

TABLE 37

| *Brachypodium* transcriptome expression sets | |
|---|---|
| Expression Set | Set ID |
| ecotypes 753/leaf:flowering:normal: | 1 |
| ecotypes 753/spike:flowering:normal: | 2 |

Table 37: Provided are the *brachypodium* transcriptome expression sets under normal conditions.

*Brachypodium* yield components and vigor related parameters assessment—

24 *brachypodium* accessions were grown in 4-6 repetitive plots (8 plant per plot), in a green house. The growing protocol was as follows: *brachypodium* seeds were sown in plots and grown under normal condition. Plants were continuously phenotyped during the growth period and at harvest (Table 38, below). The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute). At the end of the growing period the grains were separated from the spikes and the following parameters were measured using digital imaging system and collected:

No. of tillering—all tillers were counted per plant at harvest (mean per plot).

Head number—

At the end of the experiment, heads were harvested from each plot and were counted.

Total Grains weight per plot (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Highest number of spikelets—The highest spikelet number per head was calculated per plant (mean per plot).

Mean number of spikelets—The mean spikelet number per head was calculated per plot.

Plant height—Each of the plants was measured for its height using measuring tape. Height was measured from ground level to spike base of the longest spike at harvest.

Spikelets weight (gr.)—The biomass and spikes weight of each plot was separated, measured per plot.

Average head weight—calculated by dividing spikelets weight with head number (gr.).

Harvest Index—The harvest index was calculated using Formula XV.

Harvest Index(brachypodium)=Average grain weight/average dry(vegetative+spikelet)weight per plant.  Formula XV Spikelets Index—The Spikelets index is calculated using Formula XVI.

Spikelets Index=Average Spikelets weight per plant/(Average vegetative dry weight per plant plus Average Spikelets weight per plant).  Formula XVI:

Percent Number of heads with spikelets—The number of heads with more than one spikelet per plant were counted and the percent from all heads per plant was calculated.

Total dry mater per plot—Calculated as Vegetative portion above ground plus all the spikelet dry weight per plot.

1000 grain weight—At the end of the experiment all grains from all plots were collected and weighted and the weight of 1000 were calculated.

The following parameters were collected using digital imaging system:

At the end of the growing period the grains were separated from the spikes and the following parameters were measured and collected:

(i) Average Grain Area (cm$^2$)—A sample of ~200 grains was weighted, photographed and images were processed using the below described image processing system. The grain area was measured from those images and was divided by the number of grains.

(ii) Average Grain Length, perimeter and width (cm)—A sample of ~200 grains was weighted, photographed and images were processed using the below described image processing system. The sum of grain lengths and width (longest axis) was measured from those images and was divided by the number of grains.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

TABLE 38

*Brachypodium* correlated parameters (vectors)

| Correlated parameter with | Correlation ID |
|---|---|
| 1000 grain weight | 1 |
| Average head weight | 2 |
| Grain Perimeter | 3 |
| Grain area | 4 |
| Grain length | 5 |
| Grain width | 6 |
| Grains weight per plant | 7 |
| Grains weight per plot | 8 |
| Harvest index | 9 |
| Heads per plant | 10 |
| Heads per plot | 11 |
| Highest num of spikelets per plot | 12 |
| Mean num of spikelets per plot | 13 |
| Num of heads with spikelets per plant | 14 |
| Percent Num of heads with spikelets | 15 |
| Plant Vegetative DW | 16 |
| Plant height | 17 |
| Plants num | 18 |
| Spikelets DW per plant | 19 |
| Spikelets weight | 20 |
| Spikes index | 21 |
| Tillering | 22 |
| Total dry mater per plant | 23 |
| Total dry mater per plot | 24 |
| Vegetative DW | 25 |

Table 38: Provided are the *brachypodium* correlated parameters.

Experimental Results 25 different *Brachypodium* accessions were grown and characterized for different parameters as described above. The average for each of the measured parameter was calculated using the JMP software and values are summarized in Tables 39-40 below. Subsequent correlation analysis between the various transcriptome sets and the average parameters was conducted. Follow, results were integrated to the database.

TABLE 39

Measured parameters of correlation IDs in *Brachypodium* accessions under normal conditions

| Ecotype/Treatment | Line-1 | Line-2 | Line-3 | Line-4 | Line-5 | Line-6 | Line-7 | Line-8 | Line-9 | Line-10 | Line-11 |
|---|---|---|---|---|---|---|---|---|---|---|---|
| 1 | 3.75 | 3.78 | 3.35 | 4.88 | 5.54 | 4.98 | 4.83 | 5.54 | 3.84 | 4.76 | 4.73 |
| 2 | 0.06 | 0.04 | 0.05 | 0.07 | 0.04 | 0.06 | 0.05 | 0.04 | 0.08 | 0.06 | 0.05 |
| 3 | 1.67 | 1.62 | 1.62 | 1.69 | 1.82 | 1.83 | 1.74 | 1.93 | 1.68 | 1.82 | 1.69 |
| 4 | 0.10 | 0.10 | 0.09 | 0.09 | 0.11 | 0.11 | 0.10 | 0.11 | 0.10 | 0.11 | 0.10 |
| 5 | 0.73 | 0.72 | 0.72 | 0.74 | 0.83 | 0.82 | 0.78 | 0.90 | 0.75 | 0.79 | 0.75 |
| 6 | 0.18 | 0.17 | 0.17 | 0.16 | 0.16 | 0.17 | 0.17 | 0.16 | 0.17 | 0.18 | 0.17 |
| 7 | 0.14 | 0.06 | 0.08 | 0.26 | 0.14 | 0.14 | 0.14 | 0.11 | 0.08 | 0.07 | 0.39 |
| 8 | 1.05 | 0.44 | 0.61 | 1.96 | 1.11 | 1.07 | 1.09 | 0.84 | 0.50 | 0.39 | 3.07 |
| 9 | 0.13 | 0.14 | 0.15 | 0.20 | 0.20 | 0.16 | 0.14 | 0.26 | 0.07 | 0.11 | 0.22 |
| 10 | 16.29 | 7.08 | 6.59 | 11.63 | 10.48 | 9.09 | 14.13 | 5.88 | 11.89 | 8.02 | 23.75 |
| 11 | 121.75 | 56.60 | 52.75 | 83.40 | 82.40 | 70.13 | 110.33 | 47.00 | 81.50 | 48.60 | 185.50 |
| 12 | 3.00 | 2.60 | 3.00 | 2.20 | 2.00 | 2.25 | 1.83 | 2.00 | 3.50 | 2.00 | 2.50 |
| 13 | 2.10 | 2.10 | 1.72 | 1.69 | 1.38 | 1.65 | 1.43 | 1.25 | 2.41 | 1.56 | 1.76 |

TABLE 39-continued

Measured parameters of correlation IDs in *Brachypodium* accessions under normal conditions

| Ecotype/Treatment | Line-1 | Line-2 | Line-3 | Line-4 | Line-5 | Line-6 | Line-7 | Line-8 | Line-9 | Line-10 | Line-11 |
|---|---|---|---|---|---|---|---|---|---|---|---|
| 14 | 5.27 | 2.50 | 2.06 | 2.08 | 0.71 | 1.94 | 1.08 | 0.35 | 7.59 | 1.87 | 4.98 |
| 15 | 27.61 | 35.33 | 21.67 | 14.00 | 5.42 | 15.42 | 6.40 | 4.51 | 55.41 | 16.51 | 15.52 |
| 16 | 0.42 | 0.12 | 0.13 | 0.38 | 0.32 | 0.32 | 0.39 | 0.13 | 0.44 | 0.31 | 0.87 |
| 17 | 31.65 | 23.44 | 22.75 | 31.95 | 34.36 | 28.65 | 28.88 | 24.74 | 31.40 | 29.15 | 37.30 |
| 18 | 7.50 | 8.00 | 8.00 | 7.20 | 7.80 | 7.75 | 7.83 | 8.00 | 6.50 | 6.40 | 7.75 |
| 19 | 0.96 | 0.31 | 0.33 | 0.88 | 0.44 | 0.56 | 0.67 | 0.26 | 0.92 | 0.45 | 1.14 |
| 20 | 7.18 | 2.50 | 2.68 | 6.42 | 3.45 | 4.29 | 5.29 | 2.04 | 6.25 | 2.66 | 8.89 |
| 21 | 0.71 | 0.72 | 0.73 | 0.71 | 0.58 | 0.66 | 0.64 | 0.66 | 0.69 | 0.60 | 0.59 |
| 22 | 16.84 | 7.20 | 7.00 | 11.97 | 10.67 | 9.38 | 14.58 | 6.35 | 12.38 | 8.60 | 25.50 |
| 23 | 1.38 | 0.43 | 0.47 | 1.25 | 0.76 | 0.88 | 1.06 | 0.38 | 1.36 | 0.76 | 2.01 |
| 24 | 10.26 | 3.45 | 3.74 | 9.12 | 6.00 | 6.78 | 8.34 | 3.04 | 9.21 | 4.47 | 15.79 |
| 25 | 3.08 | 0.95 | 1.06 | 2.69 | 2.55 | 2.48 | 3.05 | 1.00 | 2.96 | 1.81 | 6.89 |

Table 39: Correlation IDs: 1, 2, 3, 4, 5 ... etc refer to those described in Table 38 above [*Brachypodium* correlated parameters (vectors)].

TABLE 40

Measured parameters of correlation IDs in *brachypodium* accessions under normal conditions

| Ecotype/Treatment | Line-12 | Line-13 | Line-14 | Line-15 | Line-16 | Line-17 | Line-18 | Line-19 | Line-20 | Line-21 | Line-22 |
|---|---|---|---|---|---|---|---|---|---|---|---|
| 1 | 5.24 | 4.96 | 4.00 | 4.26 | 5.99 | 4.34 | 3.70 | 3.90 | 4.82 | 4.87 | 3.76 |
| 2 | 0.05 | 0.06 | 0.10 | 0.08 | 0.08 | 0.06 | 0.09 | 0.04 | 0.06 | 0.09 | 0.09 |
| 3 | 1.91 | 1.71 | 1.81 | 1.75 | 1.87 | 1.66 | 1.65 | 1.60 | 1.80 | 1.90 | 1.68 |
| 4 | 0.12 | 0.10 | 0.10 | 0.09 | 0.12 | 0.09 | 0.09 | 0.09 | 0.10 | 0.11 | 0.09 |
| 5 | 0.86 | 0.74 | 0.84 | 0.80 | 0.84 | 0.74 | 0.75 | 0.72 | 0.79 | 0.87 | 0.76 |
| 6 | 0.19 | 0.17 | 0.15 | 0.14 | 0.18 | 0.16 | 0.15 | 0.15 | 0.17 | 0.16 | 0.15 |
| 7 | 0.14 | 0.13 | 0.37 | 0.49 | 0.31 | 0.20 | 0.35 | 0.27 | 0.32 | 0.44 | 0.30 |
| 8 | 1.09 | 1.07 | 2.99 | 3.52 | 2.41 | 1.47 | 2.58 | 2.03 | 2.58 | 3.40 | 1.92 |
| 9 | 0.09 | 0.18 | 0.09 | 0.16 | 0.18 | 0.11 | 0.21 | 0.17 | 0.15 | 0.18 | 0.09 |
| 10 | 16.06 | 9.74 | 22.19 | 24.32 | 13.25 | 19.22 | 16.11 | 21.40 | 25.88 | 17.05 | 25.54 |
| 11 | 125.00 | 80.75 | 177.50 | 172.80 | 98.60 | 143.17 | 123.50 | 156.83 | 207 | 135 | 177 |
| 12 | 2.40 | 2.00 | 3.50 | 3.80 | 2.80 | 2.83 | 2.83 | 2.33 | 2.60 | 4.50 | 3.17 |
| 13 | 1.83 | 1.42 | 2.71 | 2.61 | 2.12 | 2.15 | 2.17 | 1.85 | 1.93 | 2.85 | 2.79 |
| 14 | 3.70 | 0.89 | 12.58 | 12.13 | 6.35 | 7.15 | 9.44 | 5.02 | 4.90 | 7.72 | 15.36 |
| 15 | 20.34 | 8.11 | 53.21 | 47.81 | 42.81 | 34.92 | 52.40 | 20.84 | 17.55 | 47.73 | 59.01 |
| 16 | 0.69 | 0.34 | 1.72 | 1.32 | 0.48 | 0.63 | 0.82 | 0.67 | 0.87 | 1.05 | 1.73 |
| 17 | 45.09 | 22.39 | 55.04 | 45.34 | 40.20 | 39.18 | 45.35 | 29.41 | 38.39 | 46.74 | 58.82 |
| 18 | 8.00 | 8.25 | 8.00 | 7.00 | 7.60 | 7.33 | 7.50 | 7.33 | 8.00 | 7.88 | 6.83 |
| 19 | 0.83 | 0.59 | 2.27 | 1.91 | 1.09 | 1.26 | 1.46 | 0.96 | 1.56 | 1.42 | 2.25 |
| 20 | 6.65 | 4.92 | 18.15 | 13.49 | 8.35 | 9.42 | 11.31 | 7.16 | 12.44 | 11.05 | 15.55 |
| 21 | 0.54 | 0.68 | 0.56 | 0.59 | 0.70 | 0.66 | 0.68 | 0.60 | 0.65 | 0.57 | 0.57 |
| 22 | 16.56 | 10.53 | 27.15 | 26.30 | 13.56 | 20.79 | 16.99 | 23.61 | 27.20 | 18.25 | 29.09 |
| 23 | 1.53 | 0.93 | 3.99 | 3.23 | 1.57 | 1.89 | 2.28 | 1.63 | 2.43 | 2.47 | 3.98 |
| 24 | 12.20 | 7.76 | 31.94 | 22.78 | 12.04 | 14.14 | 17.78 | 12.29 | 19.40 | 19.27 | 27.67 |
| 25 | 5.55 | 2.84 | 13.80 | 9.28 | 3.70 | 4.72 | 6.47 | 5.13 | 6.96 | 8.23 | 12.12 |

Table 40: Correlation IDs: 1, 2, 3, 4, 5, ... etc. refer to those described in Table 38 above [*Brachypodium* correlated parameters (vectors)].

TABLE 41

Correlation between the expression level of selected genes of some embodiments of the invention in various tissues and the phenotypic performance of maintenance of performance under drought conditions across brachypodium ecotypes

| Gene Name | R | P value | Exp. set | Corr. Set ID | Gene Name | R | P value | Exp. set | Corr. Set ID |
|---|---|---|---|---|---|---|---|---|---|
| WYM100 | 0.78 | 7.47E−03 | 2 | 24 | WYM100 | 0.71 | 2.13E−02 | 2 | 19 |
| WYM100 | 0.71 | 2.03E−02 | 2 | 7 | WYM100 | 0.82 | 3.36E−03 | 2 | 25 |
| WYM100 | 0.79 | 6.09E−03 | 2 | 16 | WYM100 | 0.74 | 1.38E−02 | 2 | 20 |
| WYM100 | 0.82 | 3.50E−03 | 2 | 17 | WYM100 | 0.73 | 1.65E−02 | 2 | 8 |
| WYM100 | 0.73 | 1.67E−02 | 2 | 2 | WYM100 | 0.75 | 1.24E−02 | 2 | 23 |
| WYM101 | 0.86 | 6.31E−04 | 1 | 12 | WYM101 | 0.72 | 1.24E−02 | 1 | 7 |
| WYM101 | 0.80 | 2.86E−03 | 1 | 13 | WYM101 | 0.70 | 1.57E−02 | 1 | 8 |
| WYM101 | 0.78 | 7.88E−03 | 2 | 7 | WYM101 | 0.77 | 8.93E−03 | 2 | 8 |

TABLE 41-continued

Correlation between the expression level of selected genes of some embodiments of the invention in various tissues and the phenotypic performance of maintenance of performance under drought conditions across brachypodium ecotypes

| Gene Name | R | P value | Exp. set | Corr. Set ID | Gene Name | R | P value | Exp. set | Corr. Set ID |
|---|---|---|---|---|---|---|---|---|---|
| WYM21 | 0.76 | 6.26E−03 | 1 | 7 | WYM21 | 0.84 | 1.23E−03 | 1 | 15 |
| WYM21 | 0.71 | 1.54E−02 | 1 | 14 | WYM21 | 0.73 | 1.06E−02 | 1 | 17 |
| WYM21 | 0.75 | 7.67E−03 | 1 | 8 | WYM21 | 0.85 | 8.73E−04 | 1 | 2 |
| WYM22 | 0.82 | 2.16E−03 | 1 | 7 | WYM22 | 0.71 | 1.44E−02 | 1 | 25 |
| WYM22 | 0.72 | 1.30E−02 | 1 | 17 | WYM22 | 0.83 | 1.73E−03 | 1 | 8 |
| WYM23 | 0.81 | 2.57E−03 | 1 | 11 | WYM23 | 0.79 | 3.91E−03 | 1 | 22 |
| WYM23 | 0.73 | 1.05E−02 | 1 | 19 | WYM23 | 0.88 | 3.22E−04 | 1 | 12 |
| WYM23 | 0.72 | 1.22E−02 | 1 | 7 | WYM23 | 0.73 | 1.11E−02 | 1 | 15 |
| WYM23 | 0.72 | 1.24E−02 | 1 | 16 | WYM23 | 0.75 | 8.25E−03 | 1 | 14 |
| WYM23 | 0.89 | 2.59E−04 | 1 | 13 | WYM23 | 0.83 | 1.59E−03 | 1 | 10 |
| WYM23 | 0.73 | 1.04E−02 | 1 | 23 | WYM24 | 0.84 | 1.33E−03 | 1 | 11 |
| WYM24 | 0.82 | 2.01E−03 | 1 | 22 | WYM24 | 0.85 | 1.00E−03 | 1 | 24 |
| WYM24 | 0.87 | 4.23E−04 | 1 | 19 | WYM24 | 0.89 | 2.05E−04 | 1 | 12 |
| WYM24 | 0.92 | 7.82E−05 | 1 | 7 | WYM24 | 0.80 | 3.30E−03 | 1 | 25 |
| WYM24 | 0.85 | 1.02E−03 | 1 | 15 | WYM24 | 0.80 | 3.12E−03 | 1 | 16 |
| WYM24 | 0.84 | 1.12E−03 | 1 | 14 | WYM24 | 0.88 | 4.03E−04 | 1 | 20 |
| WYM24 | 0.89 | 2.16E−04 | 1 | 13 | WYM24 | 0.90 | 1.72E−04 | 1 | 8 |
| WYM24 | 0.82 | 2.18E−03 | 1 | 10 | WYM24 | 0.85 | 1.00E−03 | 1 | 2 |
| WYM24 | 0.85 | 9.86E−04 | 1 | 23 | WYM24 | 0.84 | 2.56E−03 | 2 | 11 |
| WYM24 | 0.88 | 8.05E−04 | 2 | 22 | WYM24 | 0.84 | 2.39E−03 | 2 | 24 |
| WYM24 | 0.87 | 9.31E−04 | 2 | 19 | WYM24 | 0.81 | 4.12E−03 | 2 | 25 |
| WYM24 | 0.80 | 5.52E−03 | 2 | 15 | WYM24 | 0.84 | 2.46E−03 | 2 | 16 |
| WYM24 | 0.88 | 8.44E−04 | 2 | 14 | WYM24 | 0.85 | 1.68E−03 | 2 | 20 |
| WYM24 | 0.73 | 1.64E−02 | 2 | 13 | WYM24 | 0.76 | 1.11E−02 | 2 | 17 |
| WYM24 | 0.86 | 1.59E−03 | 2 | 10 | WYM24 | 0.74 | 1.45E−02 | 2 | 2 |
| WYM24 | 0.86 | 1.36E−03 | 2 | 23 | WYM25 | 0.72 | 1.16E−02 | 1 | 24 |
| WYM25 | 0.72 | 1.29E−02 | 1 | 19 | WYM25 | 0.87 | 5.26E−04 | 1 | 12 |
| WYM25 | 0.74 | 8.61E−03 | 1 | 7 | WYM25 | 0.72 | 1.18E−02 | 1 | 25 |
| WYM25 | 0.80 | 3.13E−03 | 1 | 15 | WYM25 | 0.72 | 1.20E−02 | 1 | 16 |
| WYM25 | 0.73 | 1.08E−02 | 1 | 14 | WYM25 | 0.72 | 1.34E−02 | 1 | 20 |
| WYM25 | 0.88 | 4.11E−04 | 1 | 13 | WYM25 | 0.77 | 5.52E−03 | 1 | 17 |
| WYM25 | 0.72 | 1.17E−02 | 1 | 8 | WYM25 | 0.73 | 1.02E−02 | 1 | 2 |
| WYM25 | 0.73 | 1.15E−02 | 1 | 23 | WYM25 | 0.77 | 8.63E−03 | 2 | 11 |
| WYM25 | 0.80 | 5.38E−03 | 2 | 22 | WYM25 | 0.78 | 8.24E−03 | 2 | 24 |
| WYM25 | 0.78 | 7.44E−03 | 2 | 19 | WYM25 | 0.77 | 9.23E−03 | 2 | 25 |
| WYM25 | 0.74 | 1.50E−02 | 2 | 15 | WYM25 | 0.78 | 8.19E−03 | 2 | 16 |
| WYM25 | 0.80 | 5.33E−03 | 2 | 14 | WYM25 | 0.78 | 8.22E−03 | 2 | 20 |
| WYM25 | 0.79 | 6.72E−03 | 2 | 17 | WYM25 | 0.78 | 8.25E−03 | 2 | 10 |
| WYM25 | 0.78 | 7.39E−03 | 2 | 23 | WYM26 | 0.77 | 5.81E−03 | 1 | 11 |
| WYM26 | 0.74 | 9.07E−03 | 1 | 22 | WYM26 | 0.79 | 3.90E−03 | 1 | 24 |
| WYM26 | 0.77 | 5.38E−03 | 1 | 19 | WYM26 | 0.93 | 4.41E−05 | 1 | 12 |
| WYM26 | 0.76 | 6.30E−03 | 1 | 7 | WYM26 | 0.83 | 1.66E−03 | 1 | 5 |
| WYM26 | 0.81 | 2.30E−03 | 1 | 25 | WYM26 | 0.77 | 5.96E−03 | 1 | 15 |
| WYM26 | 0.76 | 7.04E−03 | 1 | 3 | WYM26 | 0.79 | 3.95E−03 | 1 | 16 |
| WYM26 | 0.74 | 8.81E−03 | 1 | 14 | WYM26 | 0.78 | 4.56E−03 | 1 | 20 |
| WYM26 | 0.90 | 1.54E−04 | 1 | 13 | WYM26 | 0.72 | 1.17E−02 | 1 | 17 |
| WYM26 | 0.76 | 7.03E−03 | 1 | 8 | WYM26 | 0.73 | 1.08E−02 | 1 | 10 |
| WYM26 | 0.74 | 9.36E−03 | 1 | 2 | WYM26 | 0.78 | 4.64E−03 | 1 | 23 |
| WYM26 | 0.81 | 4.33E−03 | 2 | 11 | WYM26 | 0.82 | 3.76E−03 | 2 | 22 |
| WYM26 | 0.75 | 1.19E−02 | 2 | 24 | WYM26 | 0.81 | 4.75E−03 | 2 | 19 |
| WYM26 | 0.79 | 6.55E−03 | 2 | 12 | WYM26 | 0.71 | 2.08E−02 | 2 | 25 |
| WYM26 | 0.88 | 8.81E−04 | 2 | 15 | WYM26 | 0.74 | 1.46E−02 | 2 | 16 |
| WYM26 | 0.85 | 1.77E−03 | 2 | 14 | WYM26 | 0.78 | 7.67E−03 | 2 | 20 |
| WYM26 | 0.88 | 8.82E−04 | 2 | 13 | WYM26 | 0.77 | 9.90E−03 | 2 | 17 |
| WYM26 | 0.83 | 2.91E−03 | 2 | 10 | WYM26 | 0.72 | 2.00E−02 | 2 | 2 |
| WYM26 | 0.78 | 7.81E−03 | 2 | 23 | WYM27 | 0.74 | 9.81E−03 | 1 | 11 |
| WYM27 | 0.72 | 1.30E−02 | 1 | 19 | WYM27 | 0.86 | 7.50E−04 | 1 | 12 |
| WYM27 | 0.86 | 7.19E−04 | 1 | 7 | WYM27 | 0.76 | 6.79E−03 | 1 | 15 |
| WYM27 | 0.72 | 1.22E−02 | 1 | 14 | WYM27 | 0.73 | 1.11E−02 | 1 | 20 |
| WYM27 | 0.81 | 2.68E−03 | 1 | 13 | WYM27 | 0.75 | 7.45E−03 | 1 | 17 |
| WYM27 | 0.85 | 8.11E−04 | 1 | 8 | WYM27 | 0.71 | 1.41E−02 | 1 | 10 |
| WYM28 | 0.76 | 6.12E−03 | 1 | 11 | WYM28 | 0.80 | 3.03E−03 | 1 | 22 |
| WYM28 | 0.86 | 6.25E−04 | 1 | 24 | WYM28 | 0.86 | 6.84E−04 | 1 | 19 |
| WYM28 | 0.81 | 2.33E−03 | 1 | 7 | WYM28 | 0.87 | 5.80E−04 | 1 | 25 |
| WYM28 | 0.80 | 3.18E−03 | 1 | 15 | WYM28 | 0.88 | 4.10E−04 | 1 | 16 |
| WYM28 | 0.85 | 8.82E−04 | 1 | 14 | WYM28 | 0.85 | 9.63E−04 | 1 | 20 |
| WYM28 | 0.82 | 2.15E−03 | 1 | 13 | WYM28 | 0.83 | 1.56E−03 | 1 | 17 |
| WYM28 | 0.78 | 5.04E−03 | 1 | 8 | WYM28 | 0.77 | 5.62E−03 | 1 | 10 |
| WYM28 | 0.80 | 3.41E−03 | 1 | 2 | WYM28 | 0.87 | 4.38E−04 | 1 | 23 |
| WYM29 | 0.78 | 8.03E−03 | 2 | 11 | WYM29 | 0.81 | 4.78E−03 | 2 | 22 |
| WYM29 | 0.81 | 4.37E−03 | 2 | 24 | WYM29 | 0.83 | 3.15E−03 | 2 | 19 |
| WYM29 | 0.80 | 5.00E−03 | 2 | 7 | WYM29 | 0.81 | 4.22E−03 | 2 | 25 |

TABLE 41-continued

Correlation between the expression level of selected genes of some embodiments of the invention in various tissues and the phenotypic performance of maintenance of performance under drought conditions across brachypodium ecotypes

| Gene Name | R | P value | Exp. set | Corr. Set ID | Gene Name | R | P value | Exp. set | Corr. Set ID |
|---|---|---|---|---|---|---|---|---|---|
| WYM29 | 0.79 | 6.14E−03 | 2 | 15 | WYM29 | 0.82 | 3.31E−03 | 2 | 16 |
| WYM29 | 0.83 | 3.29E−03 | 2 | 14 | WYM29 | 0.80 | 5.04E−03 | 2 | 20 |
| WYM29 | 0.76 | 1.14E−02 | 2 | 13 | WYM29 | 0.78 | 8.18E−03 | 2 | 8 |
| WYM29 | 0.79 | 6.66E−03 | 2 | 10 | WYM29 | 0.80 | 5.32E−03 | 2 | 2 |
| WYM29 | 0.83 | 3.17E−03 | 2 | 23 | WYM30 | 0.73 | 1.08E−02 | 1 | 7 |
| WYM30 | 0.71 | 1.49E−02 | 1 | 8 | WYM31 | 0.82 | 1.97E−03 | 1 | 11 |
| WYM31 | 0.77 | 5.14E−03 | 1 | 22 | WYM31 | 0.84 | 1.28E−03 | 1 | 24 |
| WYM31 | 0.83 | 1.61E−03 | 1 | 19 | WYM31 | 0.76 | 6.13E−03 | 1 | 12 |
| WYM31 | 0.89 | 2.60E−04 | 1 | 7 | WYM31 | 0.81 | 2.66E−03 | 1 | 25 |
| WYM31 | 0.81 | 2.27E−03 | 1 | 15 | WYM31 | 0.79 | 3.88E−03 | 1 | 16 |
| WYM31 | 0.79 | 4.01E−03 | 1 | 14 | WYM31 | 0.85 | 8.91E−04 | 1 | 20 |
| WYM31 | 0.80 | 3.08E−03 | 1 | 13 | WYM31 | 0.74 | 8.99E−03 | 1 | 17 |
| WYM31 | 0.89 | 2.70E−04 | 1 | 8 | WYM31 | 0.78 | 5.01E−03 | 1 | 10 |
| WYM31 | 0.83 | 1.62E−03 | 1 | 2 | WYM31 | 0.82 | 2.13E−03 | 1 | 23 |
| WYM31 | 0.75 | 1.22E−02 | 2 | 11 | WYM31 | 0.71 | 2.08E−02 | 2 | 22 |
| WYM31 | 0.77 | 9.72E−03 | 2 | 12 | WYM31 | 0.85 | 1.94E−03 | 2 | 7 |
| WYM31 | 0.74 | 1.44E−02 | 2 | 13 | WYM31 | 0.83 | 2.83E−03 | 2 | 8 |
| WYM31 | 0.74 | 1.46E−02 | 2 | 10 | WYM32 | 0.86 | 6.81E−04 | 1 | 12 |
| WYM32 | 0.81 | 2.75E−03 | 1 | 7 | WYM32 | 0.78 | 4.92E−03 | 1 | 13 |
| WYM32 | 0.71 | 1.44E−02 | 1 | 17 | WYM32 | 0.80 | 3.44E−03 | 1 | 8 |
| WYM32 | 0.74 | 1.39E−02 | 2 | 12 | WYM32 | 0.72 | 1.93E−02 | 2 | 5 |
| WYM33 | 0.80 | 3.20E−03 | 1 | 7 | WYM33 | 0.78 | 4.22E−03 | 1 | 8 |
| WYM33 | 0.70 | 2.40E−02 | 2 | 21 | WYM34 | 0.73 | 1.04E−02 | 1 | 12 |
| WYM34 | 0.91 | 8.90E−05 | 1 | 7 | WYM34 | 0.77 | 6.08E−03 | 1 | 15 |
| WYM34 | 0.93 | 3.40E−05 | 1 | 8 | WYM34 | 0.80 | 3.03E−03 | 1 | 2 |
| WYM35 | 0.83 | 1.52E−03 | 1 | 11 | WYM35 | 0.85 | 9.90E−04 | 1 | 22 |
| WYM35 | 0.89 | 2.81E−04 | 1 | 24 | WYM35 | 0.89 | 2.81E−04 | 1 | 19 |
| WYM35 | 0.88 | 3.57E−04 | 1 | 12 | WYM35 | 0.83 | 1.42E−03 | 1 | 7 |
| WYM35 | 0.88 | 3.89E−04 | 1 | 25 | WYM35 | 0.81 | 2.36E−03 | 1 | 15 |
| WYM35 | 0.88 | 3.03E−04 | 1 | 16 | WYM35 | 0.86 | 7.69E−04 | 1 | 14 |
| WYM35 | 0.88 | 3.46E−04 | 1 | 20 | WYM35 | 0.92 | 5.89E−05 | 1 | 13 |
| WYM35 | 0.78 | 4.70E−03 | 1 | 17 | WYM35 | 0.81 | 2.49E−03 | 1 | 8 |
| WYM35 | 0.82 | 1.86E−03 | 1 | 10 | WYM35 | 0.81 | 2.44E−03 | 1 | 2 |
| WYM35 | 0.89 | 2.23E−04 | 1 | 23 | WYM99 | 0.73 | 1.65E−02 | 2 | 12 |
| WYM99 | 0.71 | 2.08E−02 | 2 | 7 | WYM99 | 0.76 | 1.07E−02 | 2 | 5 |
| WYM99 | 0.72 | 1.90E−02 | 2 | 8 | | | | | |

Table 41: Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

Example 9

Production of Foxtail Millet Transcriptome and High Throughput Correlation Analysis Using 60K Foxtail Millet Oligonucleotide Micro-Array In order to produce a high throughput correlation analysis comparing between plant phenotype and gene expression level, the present inventors utilized a foxtail millet oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60K foxtail millet genes and transcripts. In order to define correlations between the levels of RNA expression and yield or vigor related parameters, various plant characteristics of 15 different foxtail millet accessions were analyzed. Among them, 11 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Foxtail millet tissues—three tissues at different developmental stages [leaf, flower, and stem], representing different plant characteristics, were sampled and RNA was extracted as described above. Each micro-array expression information tissue type has received a Set ID as summarized in Table 42 below.

TABLE 42

Foxtail millet transcriptome expression sets under normal conditions

| Expression Set | Set ID |
|---|---|
| flower:flowering stage | 1 |
| leaf:flowering stage | 2 |
| grain:grain filling stage:normal | 4 |
| leaf: grain filling stage:normal | 5 |
| stem:grain filling stage:normal | 6 |

Table 42: Provided are the foxtail millet transcriptome expression sets under normal conditions Foxtail millet yield components and vigor related parameters assessment—14 Foxtail millet accessions in 5 repetitive plots, in the field. Foxtail millet seeds were sown in soil and grown under normal condition in the field. Plants were continuously phenotyped during the growth period and at harvest (Table 44-45, below). The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol:// rsbweb (dot) nih (dot) gov/]. Next, analyzed data was saved to text files and processed using the JMP statistical analysis software (SAS institute).

The following parameters were collected using digital imaging system:

At the end of the growing period the grains were separated from the Plant 'Head' and the following parameters were measured and collected:

(i) Average Grain Area ($cm^2$)—A sample of ~200 grains was weighted, photographed and images were processed using the below described image processing system. The grain area was measured from those images and was divided by the number of grains.

(ii) Average Grain Length and width (cm)—A sample of ~200 grains was weighted, photographed and images were processed using the below described image processing system. The sum of grain lengths and width (longest axis) was measured from those images and was divided by the number of grains.

At the end of the growing period 14 'Heads' were photographed and images were processed using the below described image processing system.

(i) Head Average Area ($cm^2$) The 'Head' area was measured from those images and was divided by the number of 'Heads'.

(ii) Head Average Length (mm) The 'Head' length (longest axis) was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Grain Weight (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Head weight and head number—At the end of the experiment, heads were harvested from each plot and were counted and weighted (kg.).

Biomass at harvest—At the end of the experiment the vegetative material from plots was weighted.

Dry weight=total weight of the vegetative portion above ground (excluding roots) after drying at 70° C. in oven for 48 hours at harvest.

Total dry mater per plot—Calculated as Vegetative portion above ground plus all the heads dry weight per plot.

Number (Num) days to anthesis—Calculated as the number of days from sowing till 50% of the plot arrives at anthesis.

Maintenance of performance under drought conditions: Represent ratio for the specified parameter of Drought condition results divided by Normal conditions results (maintenance of phenotype under drought in comparison to normal conditions).

Data parameters collected are summarized in Table 43, herein below

TABLE 43

Foxtail millet correlated parameters (vectors)

| Correlated parameter with | Correlation ID |
|---|---|
| Biomass at harvest | 1 |
| Grain area | 2 |
| Grain length | 3 |
| Grain width | 4 |
| Grains weight per Head (plot) | 5 |
| Head Area | 6 |
| Head length | 7 |
| Heads num | 8 |
| Num days to Anthesis | 9 |
| Total Grains weight | 10 |
| Total dry matter | 11 |
| Total heads weight | 12 |

Table 43: Provided are the foxtail millet collected parameters.

Experimental Results 14 different foxtail millet accessions were grown and characterized for different parameters as described above. The average for each of the measured parameter was calculated using the JMP software and values are summarized in Tables 44-45 below. Subsequent correlation analysis between the various transcriptome sets and the average parameters was conducted. Follow, results were integrated to the database.

TABLE 44

Measured parameters of correlation IDs in foxtail millet accessions under normal conditions

| Line/Correlation ID | 1 | 2 | 3 | 4 | 5 | 6 | 7 |
|---|---|---|---|---|---|---|---|
| 1 | 2.14 | 3.99 | 3.17 | 3.58 | 3.60 | 3.06 | 4.04 |
| 2 | 0.03 | 0.04 | 0.03 | 0.03 | 0.03 | 0.03 | 0.03 |
| 3 | 0.24 | 0.24 | 0.25 | 0.25 | 0.26 | 0.25 | 0.23 |
| 4 | 0.17 | 0.19 | 0.17 | 0.16 | 0.16 | 0.17 | 0.16 |
| 5 | 3.40 | 7.29 | 1.49 | 1.30 | 1.57 | 0.69 | 2.10 |
| 6 | 37.83 | 57.87 | 19.59 | 17.10 | 19.76 | 9.42 | 22.92 |
| 7 | 23.13 | 24.25 | 17.56 | 14.79 | 15.38 | 8.56 | 16.08 |
| 8 | 427.60 | 149.20 | 867.00 | 1204.00 | 1146.40 | 2132.00 | 752.20 |

TABLE 44-continued

Measured parameters of correlation IDs in foxtail millet accessions under normal conditions

| Line/Correlation ID | 1 | 2 | 3 | 4 | 5 | 6 | 7 |
|---|---|---|---|---|---|---|---|
| 9 | 34.00 | 41.00 | 45.00 | 41.00 | 41.00 | 30.00 | 38.00 |
| 10 | 1449.63 | 1067.88 | 1302.82 | 1567.20 | 1794.80 | 1476.11 | 1582.57 |
| 11 | 0.62 | 0.85 | 0.96 | 0.92 | 0.90 | 0.48 | 0.92 |
| 12 | 3.81 | 5.95 | 6.20 | 5.64 | 6.27 | 6.07 | 6.32 |
| 1 | 2.14 | 3.99 | 3.17 | 3.58 | 3.60 | 3.06 | 4.04 |
| 2 | 0.03 | 0.04 | 0.03 | 0.03 | 0.03 | 0.03 | 0.03 |

Table 44: Provided are the values of each of the parameters (as described above) measured in Foxtail millet accessions (line) under normal growth conditions. Growth conditions are specified in the experimental procedure section.

TABLE 45

Additional measured parameters of correlation IDs in foxtail millet accessions under normal conditions

| Line/Correlation ID | 8 | 9 | 10 | 11 | 12 | 13 | 14 |
|---|---|---|---|---|---|---|---|
| 1 | 1.15 | 3.20 | 3.90 | 3.58 | 3.68 | 2.94 | 1.48 |
| 2 | 0.02 | 0.03 | 0.02 | 0.04 | 0.03 | 0.04 | 0.03 |
| 3 | 0.20 | 0.22 | 0.20 | 0.26 | 0.25 | 0.27 | 0.24 |
| 4 | 0.15 | 0.18 | 0.16 | 0.18 | 0.17 | 0.18 | 0.16 |
| 5 | 3.34 | 11.46 | 7.17 | 4.35 | 2.26 | 0.44 | 1.31 |
| 6 | 40.89 | 45.29 | 49.34 | 27.69 | 24.18 | 7.13 | 14.69 |
| 7 | 21.88 | 20.41 | 23.32 | 20.87 | 17.98 | 6.35 | 9.78 |
| 8 | 394.20 | 186.60 | 131.80 | 434.20 | 646.40 | 2797.80 | 994.60 |
| 9 | 30.00 | 38.00 | 51.00 | 44.00 | 51.00 | 31.00 | 27.00 |
| 10 | 1317.88 | 2131.60 | 937.93 | 1880.21 | 1427.12 | 1216.24 | 1296.69 |
| 11 | 0.45 | 0.59 | 1.00 | 0.91 | 1.03 | 0.62 | 0.46 |
| 12 | 2.82 | 7.25 | 5.24 | 6.58 | 5.85 | 5.62 | 2.73 |
| 1 | 1.15 | 3.20 | 3.90 | 3.58 | 3.68 | 2.94 | 1.48 |
| 2 | 0.02 | 0.03 | 0.02 | 0.04 | 0.03 | 0.04 | 0.03 |

Table 45: Provided are the values of each of the parameters (as described above) measured in Foxtail millet accessions (line) under normal growth conditions. Growth conditions are specified in the experimental procedure section.

TABLE 46

Correlation between the expression level of selected genes of some embodiments of the invention in various tissues and the phenotypic performance of maintenance of performance under drought conditions across foxtail millet varieties

| Gene Name | R | P value | Exp. set | Corr. Set ID | Gene Name | R | P value | Exp. set | Corr. Set ID |
|---|---|---|---|---|---|---|---|---|---|
| WYM102 | 0.95 | 0.00 | 6 | 5 | WYM102 | 0.70 | 0.05 | 6 | 10 |
| WYM102 | 0.83 | 0.01 | 6 | 6 | WYM102 | 0.86 | 0.03 | 2 | 5 |
| WYM102 | 0.71 | 0.11 | 2 | 10 | WYM103 | 0.87 | 0.03 | 2 | 5 |
| WYM103 | 0.80 | 0.06 | 2 | 7 | WYM103 | 0.80 | 0.06 | 2 | 4 |
| WYM103 | 0.83 | 0.04 | 2 | 6 | WYM36 | 0.71 | 0.01 | 1 | 7 |
| WYM36 | 0.80 | 0.00 | 1 | 9 | WYM36 | 0.74 | 0.01 | 4 | 12 |
| WYM36 | 0.79 | 0.01 | 4 | 5 | WYM36 | 0.92 | 0.00 | 4 | 10 |
| WYM36 | 0.73 | 0.04 | 6 | 7 | WYM36 | 0.73 | 0.04 | 6 | 6 |
| WYM36 | 0.74 | 0.10 | 2 | 5 | WYM36 | 0.97 | 0.00 | 2 | 7 |
| WYM36 | 0.86 | 0.03 | 2 | 4 | WYM36 | 0.90 | 0.01 | 2 | 6 |
| WYM36 | 0.74 | 0.01 | 3 | 11 | WYM36 | 0.72 | 0.02 | 3 | 9 |
| WYM37 | 0.87 | 0.00 | 6 | 5 | WYM37 | 0.91 | 0.00 | 6 | 10 |
| WYM37 | 0.81 | 0.01 | 6 | 7 | WYM37 | 0.94 | 0.00 | 6 | 6 |
| WYM37 | 0.77 | 0.07 | 2 | 3 | WYM37 | 0.86 | 0.03 | 2 | 8 |
| WYM38 | 0.77 | 0.03 | 6 | 2 | WYM38 | 0.83 | 0.00 | 3 | 5 |
| WYM40 | 0.78 | 0.01 | 4 | 12 | WYM40 | 0.74 | 0.01 | 4 | 11 |
| WYM40 | 0.85 | 0.00 | 4 | 9 | WYM40 | 0.88 | 0.00 | 4 | 1 |

TABLE 46-continued

Correlation between the expression level of selected genes of some embodiments of the invention in various tissues and the phenotypic performance of maintenance of performance under drought conditions across foxtail millet varieties

| Gene Name | R | P value | Exp. set | Corr. Set ID | Gene Name | R | P value | Exp. set | Corr. Set ID |
|---|---|---|---|---|---|---|---|---|---|
| WYM40 | 0.71 | 0.05 | 6 | 5 | WYM41 | 0.84 | 0.00 | 1 | 2 |
| WYM41 | 0.73 | 0.04 | 6 | 11 | WYM41 | 0.76 | 0.08 | 2 | 5 |
| WYM41 | 0.71 | 0.11 | 2 | 6 | | | | | |

Table 46: Correlations (R) between the genes expression levels in various issues and the phenotypic performance.
"Corr. ID"—correlation set ID according to the correlated parameters Table above.
"Exp. Set"—Expression set.
"R" = Pearson correlation coefficient;
"P" = p value.

Example 10

Production of Soybean (Glycine Max) Transcriptome and High Throughput Correlation Analysis with Yield Parameters Using 44K B. Soybean Oligonucleotide Micro-Arrays In order to produce a high throughput correlation analysis, the present inventors utilized a Soybean oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 42,000 Soybean genes and transcripts. In order to define correlations between the levels of RNA expression with yield components or plant architecture related parameters or plant vigor related parameters, various plant characteristics of 29 different *Glycine max* varieties were analyzed and 12 varieties were further used for RNA expression analysis. The correlation between the RNA levels and the characterized parameters was analyzed using Pearson correlation test.

Correlation of *Glycine max* Genes' expression levels with phenotypic characteristics across ecotype Experimental Procedures 29 Soybean varieties were grown in three repetitive plots, in field. Briefly, the growing protocol was as follows: Soybean seeds were sown in soil and grown under normal conditions until harvest. In order to define correlations between the levels of RNA expression with yield components or plant architecture related parameters or vigor related parameters, 12 different Soybean varieties (out of 29 varieties) were analyzed and used for gene expression analyses. Analysis was performed at two pre-determined time periods: at pod set (when the soybean pods are formed) and at harvest time (when the soybean pods are ready for harvest, with mature seeds).

Analyzed Soybean tissues

In order to define correlations between the levels of RNA expression with yield components or plant architecture related parameters or vigor related parameters, 12 different Soybean varieties (out of 29 varieties) were analyzed and used for gene expression analyses as described above. Analysis was performed at two pre-determined time periods: at pod set (when the soybean pods are formed) and at harvest time (when the soybean pods are ready for harvest, with mature seeds). Each micro-array expression information tissue type has received a Set ID as summarized in Table 47 below.

TABLE 47

Soybean transcriptome expression sets

| Expression Set | Set ID |
|---|---|
| Apical meristem; before flowering | 1 |
| Leaf; before flowering | 2 |
| Leaf; flowering | 3 |
| Leaf; pod setting | 4 |
| Root; before flowering | 5 |
| Root: flowering | 6 |
| Root: pod setting | 7 |
| Stem: before flowering | 8 |
| Stem: pod setting | 9 |
| Young flowers: flowering | 10 |
| Pod; pod setting | 11 |

Table 47: Provided are the soybean transcriptome expression sets.

RNA extraction—All 12 selected Soybean varieties were sample per treatment. Plant tissues [leaf, root, Stem, Pod, apical meristem, Flower buds] growing under normal conditions were sampled and RNA was extracted at the noted stages (e.g., before flowering, at flowering, at pod setting) as described above.

The collected data parameters were as follows:

Main branch base diameter [mm] at pod set—the diameter of the base of the main branch (based diameter) average of three plants per plot.

Fresh weight [gr./plant] at pod set—total weight of the vegetative portion above ground (excluding roots) before drying at pod set, average of three plants per plot.

Dry weight [gr./plant] at pod set—total weight of the vegetative portion above ground (excluding roots) after drying at 70° C. in oven for 48 hours at pod set, average of three plants per plot.

Total number of nodes with pods on lateral branches [value/plant]—counting of nodes which contain pods in lateral branches at pod set, average of three plants per plot.

Number of lateral branches at pod set [value/plant]—counting number of lateral branches at pod set, average of three plants per plot.

Total weight of lateral branches at pod set [gr./plant]—weight of all lateral branches at pod set, average of three plants per plot.

Total weight of pods on main stem at pod set [gr./plant]—weight of all pods on main stem at pod set, average of three plants per plot.

Total number of nodes on main stem [value/plant]—count of number of nodes on main stem starting from first node above ground, average of three plants per plot.

Total number of pods with 1 seed on lateral branches at pod set [value/plant]—count of the number of pods containing 1 seed in all lateral branches at pod set, average of three plants per plot.

Total number of pods with 2 seeds on lateral branches at pod set [value/plant]—count of the number of pods containing 2 seeds in all lateral branches at pod set, average of three plants per plot.

Total number of pods with 3 seeds on lateral branches at pod set [value/plant]—count of the number of pods containing 3 seeds in all lateral branches at pod set, average of three plants per plot.

Total number of pods with 4 seeds on lateral branches at pod set [value/plant]—count of the number of pods containing 4 seeds in all lateral branches at pod set, average of three plants per plot.

Total number of pods with 1 seed on main stem at pod set [value/plant]—count of the number of pods containing 1 seed in main stem at pod set, average of three plants per plot.

Total number of pods with 2 seeds on main stem at pod set [value/plant]—count of the number of pods containing 2 seeds in main stem at pod set, average of three plants per plot.

Total number of pods with 3 seeds on main stem at pod set [value/plant]—count of the number of pods containing 3 seeds in main stem at pod set, average of three plants per plot.

Total number of pods with 4 seeds on main stem at pod set [value/plant]—count of the number of pods containing 4 seeds in main stem at pod set, average of three plants per plot.

Total number of seeds per plant at pod set [value/plant]—count of number of seeds in lateral branches and main stem at pod set, average of three plants per plot.

Total number of seeds on lateral branches at pod set [value/plant]—count of total number of seeds on lateral branches at pod set, average of three plants per plot.

Total number of seeds on main stem at pod set [value/plant]—count of total number of seeds on main stem at pod set, average of three plants per plot.

Plant height at pod set [cm/plant]—total length from above ground till the tip of the main stem at pod set, average of three plants per plot.

Plant height at harvest [Cm/Plant]—total length from above ground till the tip of the main stem at harvest, average of three plants per plot.

Total weight of pods on lateral branches at pod set [gr./plant]—weight of all pods on lateral branches at pod set, average of three plants per plot.

Ratio of the number of pods per node on main stem at pod set—calculated in formula XVII, average of three plants per plot.

$$\text{Formula XVII: } \frac{\text{Total number of pods on main stem}}{\text{Total number of nodes on main stem}}, \text{ average of three plants per plot.}$$

Ratio of total number of seeds in main stem to number of seeds on lateral branches—calculated in Formula XVIII, average of three plants per plot.

$$\text{Formula XVIII: } \frac{\text{Total number of seeds on main stem at pod set}}{\text{Total number of seeds on lateral branches at pod set}}.$$

Total weight of pods per plant at pod set [gr./plant]—weight of all pods on lateral branches and main stem at pod set, average of three plants per plot.

Days till 50% flowering [days]—number of days till 50% flowering for each plot.

Days till 100% flowering [days]—number of days till 100% flowering for each plot.

Maturity [days]—measure as 95% of the pods in a plot have ripened (turned 100% brown). Delayed leaf drop and green stems are not considered in assigning maturity. Tests are observed 3 days per week, every other day, for maturity. The maturity date is the date that 95% of the pods have reached final color. Maturity is expressed in days after August 31 [according to the accepted definition of maturity in USA, Descriptor list for SOYBEAN, Hypertext Transfer Protocol://World Wide Web (dot) ars-grin (dot) gov/cgi-bin/npgs/html/desclist (dot) p1?51].

Seed quality [ranked 1-5]—measure at harvest; a visual estimate based on several hundred seeds. Parameter is rated according to the following scores considering the amount and degree of wrinkling, defective coat (cracks), greenishness, and moldy or other pigment. Rating is 1-very good, 2-good, 3-fair, 4-poor, 5-very poor.

Lodging [ranked 1-5]—is rated at maturity per plot according to the following scores: 1—most plants in a plot are erected; 2—all plants leaning slightly or a few plants down; 3—all plants leaning moderately, or 25%-50% down; 4—all plants leaning considerably, or 50%-80% down; 5—most plants down. Note: intermediate score such as 1.5 are acceptable.

Seed size [gr.]—weight of 1000 seeds per plot normalized to 13% moisture, measure at harvest.

Total weight of seeds per plant [gr./plant]—calculated at harvest (per 2 inner rows of a trimmed plot) as weight in grams of cleaned seeds adjusted to 13% moisture and divided by the total number of plants in two inner rows of a trimmed plot.

Yield at harvest [bushels/hectare]—calculated at harvest (per 2 inner rows of a trimmed plot) as weight in grams of cleaned seeds, adjusted to 13% moisture, and then expressed as bushels per acre.

Average lateral branch seeds per pod [number]—Calculate Num of Seeds on lateral branches-at pod set and divide by the Number of Total number of pods with seeds on lateral branches-at pod set.

Average main stem seeds per pod [number]—Calculate Total Number of Seeds on main stem at pod set and divide by the Number of Total number of pods with seeds on main stem at pod setting.

Main stem average internode length [cm]—Calculate Plant height at pod set and divide by the Total number of nodes on main stem at pod setting.

Total num of pods with seeds on main stem [number]—count all pods containing seeds on the main stem at pod setting.

Total num of pods with seeds on lateral branches [number]—count all pods containing seeds on the lateral branches at pod setting.

Total number of pods per plant at pod set [number]—count pods on main stem and lateral branches at pod setting.

Data parameters collected are summarized in Table 48, herein below

TABLE 48

Provided are the soybean correlated parameters.

| Correlated parameter with | Correlation ID |
|---|---|
| 100 percent flowering | 1 |
| 50 percent flowering | 2 |
| Base diameter at pod set | 3 |

TABLE 48-continued

Provided are the soybean correlated parameters.

| Correlated parameter with | Correlation ID |
|---|---|
| DW at pod set | 4 |
| Lodging | 5 |
| Maturity | 6 |
| Num of lateral branches | 7 |
| Num of pods with 1 seed on main stem at pod set | 8 |
| Num of pods with 2 seed on main stem | 9 |
| Num of pods with 3 seed on main stem | 10 |
| Num of pods with 4 seed on main stem | 11 |
| Plant height at harvest | 12 |
| Plant height at pod set | 13 |
| Ratio number of pods per node on main stem | 14 |
| Ratio number of seeds per main stem to seeds per 1 | 115 |
| Seed quality | 16 |
| Seed size | 17 |
| Total Number of Seeds on lateral branches | 18 |
| Total Number of Seeds on main stem at pod set | 19 |
| Total no of pods with 1 seed on lateral branch | 20 |
| Total no of pods with 2 seed on lateral branch | 21 |
| Total no of pods with 3 seed on lateral branch | 22 |
| Total no of pods with 4 seed on lateral branch | 23 |
| Total number of nodes on main stem | 24 |
| Total number of nodes with pods on lateral branch | 25 |
| Total number of seeds per plant | 26 |
| Total weight of lateral branches at pod set | 27 |
| Total weight of pods on lateral branches | 28 |
| Total weight of pods on main stem at pod set | 29 |
| Total weight of pods per plant | 30 |
| Total weight of seeds per plant | 31 |
| fresh weight at pod set | 32 |
| yield at harvest | 33 |

"DW" = dry weight;

Experimental Results

Twelve different Soybean varieties were grown and characterized for 33 parameters as specified above. The average for each of the measured parameters was calculated using the JMP software and values are summarized in Tables 49-50 below. Subsequent correlation analysis between the various transcriptome expression sets and the average parameters was conducted. Results were then integrated to the database.

TABLE 49

Measured parameters in Soybean varieties (lines 1-6)

| Line/Correlation ID | Line-1 | Line-2 | Line-3 | Line-4 | Line-5 | Line-6 |
|---|---|---|---|---|---|---|
| 1 | 67.33 | 71.67 | 67.67 | 67.33 | 60 | 74 |
| 2 | 61 | 65.33 | 60.67 | 61 | 54.67 | 68.33 |
| 3 | 8.333 | 9.544 | 9.678 | 8.111 | 8.822 | 10.12 |
| 4 | 53.67 | 50.33 | 38 | 46.17 | 60.83 | 55.67 |
| 5 | 1.667 | 1.833 | 1.167 | 1.667 | 2.667 | 2.833 |
| 6 | 24 | 43.67 | 30.33 | 30.33 | 38.33 | 40 |
| 7 | 9 | 8.667 | 9.111 | 9.889 | 7.667 | 17.56 |
| 8 | 1.111 | 4.375 | 1.444 | 1.444 | 4.556 | 1.667 |
| 9 | 16.89 | 16.25 | 13.22 | 16.89 | 27 | 8.111 |
| 10 | 29.56 | 1.75 | 19.78 | 22.33 | 11.67 | 22.78 |
| 11 | 0 | 0 | 0.111 | 0.111 | 0 | 0.444 |
| 12 | 96.67 | 76.67 | 67.5 | 75.83 | 74.17 | 76.67 |
| 13 | 86.78 | 69.56 | 62.44 | 70.89 | 69.44 | 63.89 |
| 14 | 2.874 | 1.377 | 2.132 | 2.256 | 2.6 | 1.87 |
| 15 | 0.893 | 0.896 | 0.869 | 0.891 | 2.316 | 0.365 |
| 16 | 2.333 | 3.5 | 3 | 2.167 | 2.833 | 2 |
| 17 | 89 | 219.3 | 93 | 86 | 191.3 | 71.33 |
| 18 | 150.9 | 55.89 | 134 | 160.4 | 75.44 | 324.6 |
| 19 | 123.6 | 43.89 | 87.67 | 102.7 | 93.56 | 88 |
| 20 | 1.556 | 3 | 1.778 | 1.778 | 5.667 | 5.625 |
| 21 | 17 | 18.75 | 26.44 | 32.33 | 21.56 | 33.5 |
| 22 | 38.44 | 2 | 26.44 | 31.33 | 8.889 | 82 |
| 23 | 0 | 0 | 0 | 0 | 0 | 1.5 |
| 24 | 16.56 | 16.78 | 16.11 | 18.11 | 16.78 | 17.11 |
| 25 | 23 | 16 | 23.11 | 33 | 15.22 | 45.25 |
| 26 | 274.4 | 99.78 | 221.7 | 263.1 | 169 | 412.5 |
| 27 | 67.78 | 63.78 | 64.89 | 74.89 | 54 | 167.2 |
| 28 | 26 | 14.89 | 20.11 | 20.11 | 21.11 | 30.25 |
| 29 | 22.11 | 14.33 | 16 | 15 | 33.78 | 9 |
| 30 | 48.11 | 29.22 | 36.11 | 35.11 | 54.89 | 38.88 |
| 31 | 15.09 | 10.5 | 17.23 | 16.51 | 12.06 | 10.25 |
| 32 | 170.9 | 198.2 | 152.6 | 163.9 | 224.7 | 265 |
| 33 | 47.57 | 43.77 | 50.37 | 56.3 | 44 | 40.33 |

Table 49: Provided are the values of each of the parameters (as described above) measured in soybean accessions (line) under normal growth conditions. Growth conditions are specified in the experimental procedure section.

TABLE 50

Measured parameters in Soybean varieties (lines 7-12)

| Line/Correlation ID | Line-7 | Line-8 | Line-9 | Line-10 | Line-11 | Line-12 |
|---|---|---|---|---|---|---|
| 1 | 73 | 72.33 | 68.67 | 73.67 | 68 | 70.67 |
| 2 | 66.5 | 65.67 | 62.33 | 67.67 | 61.67 | 64.33 |
| 3 | 8.456 | 8.089 | 8.256 | 7.733 | 8.156 | 7.889 |
| 4 | 48 | 52 | 44.17 | 52.67 | 56 | 47.5 |
| 5 | 2.667 | 2.5 | 1.833 | 3.5 | 3.333 | 1.5 |
| 6 | 41 | 38.33 | 31 | 39 | 27.33 | 32.67 |
| 7 | 11.67 | 12.11 | 8 | 9.111 | 6.778 | 10 |
| 8 | 4 | 4.333 | 2.111 | 1.889 | 3.444 | 1.222 |
| 9 | 21.33 | 17.67 | 20.33 | 16.11 | 28.11 | 16.56 |
| 10 | 11.11 | 28.22 | 24.11 | 36.44 | 39.67 | 32.33 |
| 11 | 0 | 0.556 | 0 | 3.889 | 0 | 0 |
| 12 | 101.7 | 98.33 | 75.83 | 116.7 | 76.67 | 71.67 |
| 13 | 89.78 | 82.11 | 70.56 | 101.7 | 79.56 | 67.22 |
| 14 | 1.98 | 2.712 | 2.777 | 2.754 | 3.7 | 2.836 |
| 15 | 3.9 | 0.783 | 1.183 | 1.984 | 1.033 | 0.832 |
| 16 | 3.5 | 2.5 | 2.167 | 2.333 | 2.167 | 2.167 |
| 17 | 88 | 75 | 80.67 | 75.67 | 76.33 | 77.33 |
| 18 | 46.88 | 176.2 | 143 | 105.4 | 184.3 | 187.3 |
| 19 | 80 | 126.6 | 115.1 | 159 | 178.7 | 131.3 |
| 20 | 2.875 | 3 | 1.25 | 2.667 | 1.778 | 3 |
| 21 | 8.5 | 22.78 | 21.75 | 10.67 | 23.78 | 25.67 |
| 22 | 9 | 42.11 | 32.75 | 25.67 | 45 | 44.33 |
| 23 | 0 | 0.333 | 0 | 1.111 | 0 | 0 |
| 24 | 18.78 | 18.89 | 16.78 | 21.11 | 19.33 | 20.78 |
| 25 | 8.25 | 25.44 | 21.88 | 16.33 | 22.56 | 24.22 |
| 26 | 136 | 302.8 | 260.5 | 264.4 | 363 | 318.7 |
| 27 | 45.44 | 83.22 | 64.33 | 52 | 76.89 | 67 |
| 28 | 4.125 | 20.11 | 17 | 9.222 | 28.11 | 22.56 |
| 29 | 9.033 | 16 | 15.89 | 14.56 | 30.44 | 18 |
| 30 | 14.25 | 36.11 | 32.75 | 23.78 | 58.56 | 40.56 |
| 31 | 7.297 | 11.38 | 15.68 | 10.83 | 12.98 | 15.16 |
| 32 | 160.7 | 196.3 | 155.3 | 178.1 | 204.4 | 164.2 |
| 33 | 34.23 | 44.27 | 53.67 | 42.47 | 43.6 | 52.2 |

Table 50: Provided are the values of each of the parameters (as described above) measured in soybean accessions (line) under normal growth conditions. Growth conditions are specified in the experimental procedure section.

TABLE 51

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| WYM110 | 0.91 | 1.95E−03 | 9 | 31 | WYM110 | 0.95 | 2.96E−04 | 9 | 33 |
| WYM84 | 0.73 | 1.62E−02 | 7 | 32 | WYM84 | 0.93 | 9.24E−05 | 7 | 3 |
| WYM84 | 0.76 | 1.10E−02 | 8 | 31 | WYM84 | 0.76 | 1.07E−02 | 8 | 33 |
| WYM84 | 0.72 | 4.46E−02 | 9 | 10 | WYM84 | 0.84 | 8.79E−03 | 9 | 31 |
| WYM84 | 0.82 | 1.32E−02 | 9 | 33 | WYM84 | 0.84 | 9.00E−03 | 9 | 22 |
| WYM84 | 0.86 | 6.02E−03 | 9 | 18 | WYM84 | 0.89 | 3.37E−03 | 9 | 21 |
| WYM84 | 0.82 | 1.35E−02 | 9 | 30 | WYM84 | 0.79 | 2.00E−02 | 9 | 25 |
| WYM84 | 0.92 | 1.13E−03 | 9 | 28 | WYM84 | 0.91 | 1.93E−03 | 9 | 26 |
| WYM84 | 0.75 | 4.97E−03 | 4 | 9 | WYM85 | 0.87 | 5.03E−03 | 9 | 31 |
| WYM85 | 0.75 | 3.21E−02 | 9 | 33 | WYM85 | 0.70 | 5.24E−02 | 9 | 29 |
| WYM85 | 0.72 | 8.08E−03 | 4 | 9 | WYM85 | 0.85 | 4.80E−04 | 1 | 27 |
| WYM85 | 0.72 | 8.05E−03 | 1 | 25 | WYM85 | 0.71 | 1.01E−02 | 1 | 3 |
| WYM86 | 0.74 | 1.52E−02 | 7 | 31 | WYM86 | 0.70 | 2.39E−02 | 8 | 31 |
| WYM86 | 0.70 | 2.40E−02 | 8 | 33 | WYM86 | 0.71 | 4.87E−02 | 9 | 31 |
| WYM86 | 0.80 | 1.90E−03 | 4 | 20 | WYM87 | 0.75 | 1.28E−02 | 7 | 20 |
| WYM87 | 0.73 | 1.73E−02 | 5 | 30 | WYM87 | 0.79 | 2.03E−02 | 9 | 31 |
| WYM87 | 0.82 | 1.25E−02 | 9 | 33 | | | | | |

Table 51: Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

Example 11

Identification of Genes which can be Used to Increase Yield And Other Agricultural Advantageous Traits Overall, 99 genes (SEQ ID NOs: 1-219 for polynucleotides and SEQ ID NOs: 220-366 for polypeptides) were identified to have a major impact on plant yield, growth rate, vigor, biomass, growth rate, oil content, abiotic stress tolerance, nitrogen use efficiency, water use efficiency and fertilizer use efficiency when expression thereof is increased in plants. The identified genes, their curated polynucleotide and polypeptide sequences, as well as their updated sequences according to GenBank database are summarized in Table 52, herein below.

TABLE 52

Identified genes for increasing yield, growth rate, vigor, biomass, oil content, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LAB278_H0 | maize\|10v1\|AW054293 | maize | 1 | 220 |
| LNU74_H109 | maize\|10v1\|AI621531 | maize | 2 | 221 |
| LYM208_H4 | sorghum\|09v1\|SB01G032070 | sorghum | 3 | 222 |
| LYM490_H1 | maize\|10v1\|W21761 | maize | 4 | 223 |
| WYM1 | barley\|10v2\|AJ228941 | barley | 5 | 224 |
| WYM2 | barley\|10v2\|AJ436276 | barley | 6 | 225 |
| WYM3 | barley\|10v2\|AJ460753 | barley | 7 | 226 |
| WYM4 | barley\|10v2\|AV833173 | barley | 8 | 227 |
| WYM7 | barley\|10v2\|BE194594 | barley | 9 | 228 |
| WYM8 | barley\|10v2\|BE195883 | barley | 10 | 229 |
| WYM9 | barley\|10v2\|BE214668 | barley | 11 | 230 |
| WYM11 | barley\|10v2\|BE412454 | barley | 12 | 231 |
| WYM12 | barley\|10v2\|BE420686 | barley | 13 | 232 |
| WYM13 | barley\|10v2\|BF623573 | barley | 14 | 233 |
| WYM15 | barley\|10v2\|BI946842 | barley | 15 | 234 |
| WYM16 | barley\|10v2\|BI947216 | barley | 16 | 235 |
| WYM17 | barley\|10v2\|BI947796 | barley | 17 | 236 |
| WYM18 | barley\|10v2\|BJ452833 | barley | 18 | 237 |
| WYM19 | barley\|10v2\|CB870239 | barley | 19 | 238 |
| WYM20 | barley\|10v2\|DN158111 | barley | 20 | 239 |
| WYM21 | brachypodium\|09v1\|BRADI3G52760 | brachypodium | 21 | 240 |
| WYM22 | brachypodium\|09v1\|DV475781 | brachypodium | 22 | 241 |
| WYM23 | brachypodium\|09v1\|DV476706 | brachypodium | 23 | 242 |
| WYM24 | brachypodium\|09v1\|DV485069 | brachypodium | 24 | 243 |
| WYM25 | brachypodium\|09v1\|GT758373 | brachypodium | 25 | 244 |
| WYM26 | brachypodium\|09v1\|GT759637 | brachypodium | 26 | 245 |
| WYM27 | brachypodium\|09v1\|GT764687 | brachypodium | 27 | 246 |
| WYM28 | brachypodium\|09v1\|GT765082 | brachypodium | 28 | 247 |
| WYM29 | brachypodium\|09v1\|GT770393 | brachypodium | 29 | 248 |
| WYM30 | brachypodium\|09v1\|GT775433 | brachypodium | 30 | 249 |
| WYM31 | brachypodium\|09v1\|GT780903 | brachypodium | 31 | 250 |
| WYM32 | brachypodium\|09v1\|GT784287 | brachypodium | 32 | 251 |
| WYM33 | brachypodium\|09v1\|GT791163 | brachypodium | 33 | 252 |
| WYM34 | brachypodium\|09v1\|GT847927 | brachypodium | 34 | 253 |
| WYM35 | brachypodium\|09v1\|SRR031795S0012454 | brachypodium | 35 | 254 |
| WYM36 | foxtail_millet\|10v2\|SICRP015958 | foxtail_millet | 36 | 255 |
| WYM37 | foxtail_millet\|10v2\|SICRP017191 | foxtail_millet | 37 | 256 |
| WYM38 | foxtail_millet\|11v1\|FOXTAILXMILLETX10V2XFXTRMSLX00055016D1XT1 | foxtail_millet | 38 | 257 |
| WYM40 | foxtail_millet\|11v1\|FOXTAILXMILLETX10V2XFXTRMSLX01384364D1XT1 | foxtail_millet | 39 | 258 |
| WYM41 | foxtail_millet\|11v1\|FOXTAILXMILLETX10V2XFXTSLX00803709D1XT1 | foxtail_millet | 40 | 259 |
| WYM42 | maize\|10v1\|AA054812 | maize | 41 | 260 |
| WYM43 | maize\|10v1\|AA979730 | maize | 42 | 261 |
| WYM44 | maize\|10v1\|AA979748 | maize | 43 | 262 |
| WYM46 | maize\|10v1\|AI372300 | maize | 44 | 263 |
| WYM47 | maize\|10v1\|AI586615 | maize | 45 | 264 |
| WYM48 | maize\|10v1\|AI600444 | maize | 46 | 265 |
| WYM51 | maize\|10v1\|AI649490 | maize | 47 | 266 |
| WYM52 | maize\|10v1\|AI665357 | maize | 48 | 267 |
| WYM55 | maize\|10v1\|AI920337 | maize | 49 | 268 |
| WYM56 | maize\|10v1\|AI920394 | maize | 50 | 269 |
| WYM57 | maize\|10v1\|AI974918 | maize | 51 | 270 |
| WYM58 | maize\|10v1\|AW267325 | maize | 52 | 271 |
| WYM59 | maize\|10v1\|AW506641 | maize | 53 | 272 |
| WYM60 | maize\|10v1\|BE055910 | maize | 54 | 273 |
| WYM61 | maize\|10v1\|BG355067 | maize | 55 | 274 |
| WYM62 | maize\|10v1\|BG458626 | maize | 56 | 275 |
| WYM63 | maize\|10v1\|BI245239 | maize | 57 | 276 |
| WYM64 | maize\|10v1\|BQ621148 | maize | 58 | 277 |

TABLE 52-continued

Identified genes for increasing yield, growth rate, vigor, biomass, oil content, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| WYM65 | maize\|10v1\|CD948252 | maize | 59 | 278 |
| WYM66 | maize\|10v1\|T26937 | maize | 60 | 279 |
| WYM67 | maize\|10v1\|T70625 | maize | 61 | 280 |
| WYM69 | maize\|10v1\|W59834 | maize | 62 | 281 |
| WYM70 | rice\|gb170\|OS03G48080 | rice | 63 | 282 |
| WYM71 | rice\|gb170\|OS07G44290 | rice | 64 | 283 |
| WYM72 | sorghum\|09v1\|SB01G030550 | sorghum | 65 | 284 |
| WYM74 | sorghum\|09v1\|SB02G002690 | sorghum | 66 | 285 |
| WYM76 | sorghum\|09v1\|SB03G037080 | sorghum | 67 | 286 |
| WYM77 | sorghum\|09v1\|SB04G005000 | sorghum | 68 | 287 |
| WYM79 | sorghum\|09v1\|SB06G001610 | sorghum | 69 | 288 |
| WYM80 | sorghum\|09v1\|SB06G032750 | sorghum | 70 | 289 |
| WYM81 | sorghum\|09v1\|SB09G030000 | sorghum | 71 | 290 |
| WYM83 | sorghum\|09v1\|SB10G029670 | sorghum | 72 | 291 |
| WYM84 | soybean\|11v1\|CD405767 | soybean | 73 | 292 |
| WYM85 | soybean\|11v1\|GLYMA02G41040 | soybean | 74 | 293 |
| WYM86 | soybean\|11v1\|GLYMA05G25910 | soybean | 75 | 294 |
| WYM87 | soybean\|11v1\|GLYMA07G08240 | soybean | 76 | 295 |
| WYM89 | wheat\|10v2\|BE401050 | wheat | 77 | 296 |
| WYM90 | wheat\|10v2\|BE401466 | wheat | 78 | 297 |
| WYM91 | wheat\|10v2\|BE418556 | wheat | 79 | 298 |
| WYM92 | wheat\|10v2\|BE423194 | wheat | 80 | 299 |
| WYM93 | wheat\|10v2\|BE497501 | wheat | 81 | 300 |
| WYM94 | wheat\|10v2\|BE604122 | wheat | 82 | 301 |
| WYM95 | wheat\|10v2\|CA656649 | wheat | 83 | 302 |
| WYM96 | wheat\|10v2\|CA660726 | wheat | 84 | 303 |
| WYM98 | maize\|10v1\|AI964515 | maize | 85 | 304 |
| WYM99 | brachypodium\|09v1\|DV472468 | brachypodium | 86 | 305 |
| WYM100 | brachypodium\|09v1\|DV475214 | brachypodium | 87 | 306 |
| WYM101 | brachypodium\|09v1\|GT774209 | brachypodium | 88 | 307 |
| WYM102 | foxtail_millet\|10v2\|SICRP028266 | foxtail_millet | 89 | 308 |
| WYM103 | foxtail_millet\|11v1\|FOXTAILXMILLETX10V2XFXTRMSLX06595039D1XT1 | foxtail_millet | 90 | 309 |
| WYM104 | maize\|10v1\|AI734660 | maize | 91 | 310 |
| WYM105 | maize\|10v1\|AW000637 | maize | 92 | 311 |
| WYM106 | maize\|10v1\|BG320875 | maize | 93 | 312 |
| WYM107 | maize\|10v1\|CF034815 | maize | 94 | 313 |
| WYM108 | maize\|10v1\|MZEPPGM | maize | 95 | 314 |
| WYM109 | rice\|gb170\|OS08G02210 | rice | 96 | 315 |
| WYM110 | soybean\|11v1\|GLYMA06G12470 | soybean | 97 | 316 |
| WYM112 | wheat\|10v2\|BE399157 | wheat | 98 | 317 |
| WYM113 | wheat\|10v2\|BF474853 | wheat | 99 | 318 |
| WYM3 | barley\|10v2\|AJ460753 | barley | 100 | 319 |
| WYM7 | barley\|10v2\|BE194594 | barley | 101 | 320 |
| WYM12 | barley\|10v2\|BE420686 | barley | 102 | 321 |
| WYM17 | barley\|10v2\|BI947796 | barley | 103 | 322 |
| WYM18 | barley\|10v2\|BJ452833 | barley | 104 | 323 |
| WYM19 | barley\|10v2\|CB870239 | barley | 105 | 324 |
| WYM20 | barley\|10v2\|DN158111 | barley | 106 | 325 |
| WYM21 | brachypodium\|09v1\|BRADI3G52760 | brachypodium | 107 | 240 |
| WYM26 | brachypodium\|09v1\|GT759637 | brachypodium | 108 | 245 |
| WYM27 | brachypodium\|09v1\|GT764687 | brachypodium | 109 | 246 |
| WYM28 | brachypodium\|09v1\|GT765082 | brachypodium | 110 | 247 |
| WYM29 | brachypodium\|09v1\|GT770393 | brachypodium | 111 | 248 |
| WYM34 | brachypodium\|09v1\|GT847927 | brachypodium | 112 | 253 |
| WYM35 | brachypodium\|09v1\|SRR031795S0012454 | brachypodium | 113 | 326 |
| WYM37 | foxtail_millet\|10v2\|SICRP017191 | foxtail_millet | 114 | 256 |
| WYM40 | foxtail_millet\|11v1\|FOXTAILXMILLETX10V2XFXTRMSLX01384364D1XT1 | foxtail_millet | 115 | 258 |
| WYM41 | foxtail_millet\|11v1\|FOXTAILXMILLETX10V2XFXTSLX00803709D1XT1 | foxtail_millet | 116 | 259 |
| WYM56 | maize\|10v1\|AI920394 | maize | 117 | 327 |
| WYM85 | soybean\|11v1\|GLYMA02G41040 | soybean | 118 | 328 |
| WYM87 | soybean\|11v1\|GLYMA07G08240 | soybean | 119 | 295 |
| WYM89 | wheat\|10v2\|BE401050 | wheat | 120 | 329 |
| WYM90 | wheat\|10v2\|BE401466 | wheat | 121 | 330 |
| WYM102 | foxtail_millet\|10v2\|SICRP028266 | foxtail_millet | 122 | 331 |
| WYM104 | maize\|10v1\|AI734660 | maize | 123 | 310 |
| WYM106 | maize\|10v1\|BG320875 | maize | 124 | 332 |
| LAB278_H0 | maize\|10v1\|AW054293 | maize | 125 | 333 |
| LNU74_H109 | maize\|10v1\|AI621531 | maize | 126 | 221 |
| LYM208_H4 | sorghum\|09v1\|SB01G032070 | sorghum | 127 | 334 |

TABLE 52-continued

Identified genes for increasing yield, growth rate, vigor, biomass, oil content, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM490_H1 | maize\|10v1\|W21761 | maize | 128 | 335 |
| WYM1 | barley\|10v2\|AJ228941 | barley | 129 | 224 |
| WYM2 | barley\|10v2\|AJ436276 | barley | 130 | 225 |
| WYM3 | barley\|10v2\|AJ460753 | barley | 131 | 336 |
| WYM4 | barley\|10v2\|AV833173 | barley | 132 | 337 |
| WYM7 | barley\|10v2\|BE194594 | barley | 133 | 338 |
| WYM8 | barley\|10v2\|BE195883 | barley | 134 | 229 |
| WYM9 | barley\|10v2\|BE214668 | barley | 135 | 339 |
| WYM11 | barley\|10v2\|BE412454 | barley | 136 | 231 |
| WYM12 | barley\|10v2\|BE420686 | barley | 137 | 340 |
| WYM13 | barley\|10v2\|BF623573 | barley | 138 | 233 |
| WYM15 | barley\|10v2\|BI946842 | barley | 139 | 234 |
| WYM16 | barley\|10v2\|BI947216 | barley | 140 | 235 |
| WYM17 | barley\|10v2\|BI947796 | barley | 141 | 341 |
| WYM18 | barley\|10v2\|BJ452833 | barley | 142 | 342 |
| WYM20 | barley\|10v2\|DN158111 | barley | 143 | 343 |
| WYM21 | brachypodium\|09v1\|BRADI3G52760 | brachypodium | 144 | 240 |
| WYM22 | brachypodium\|09v1\|DV475781 | brachypodium | 145 | 241 |
| WYM23 | brachypodium\|09v1\|DV476706 | brachypodium | 146 | 344 |
| WYM24 | brachypodium\|09v1\|DV485069 | brachypodium | 147 | 345 |
| WYM25 | brachypodium\|09v1\|GT758373 | brachypodium | 148 | 244 |
| WYM26 | brachypodium\|09v1\|GT759637 | brachypodium | 149 | 245 |
| WYM27 | brachypodium\|09v1\|GT764687 | brachypodium | 150 | 246 |
| WYM28 | brachypodium\|09v1\|GT765082 | brachypodium | 151 | 247 |
| WYM29 | brachypodium\|09v1\|GT770393 | brachypodium | 152 | 248 |
| WYM30 | brachypodium\|09v1\|GT775433 | brachypodium | 153 | 249 |
| WYM31 | brachypodium\|09v1\|GT780903 | brachypodium | 154 | 346 |
| WYM32 | brachypodium\|09v1\|GT784287 | brachypodium | 155 | 251 |
| WYM33 | brachypodium\|09v1\|GT791163 | brachypodium | 156 | 252 |
| WYM34 | brachypodium\|09v1\|GT847927 | brachypodium | 157 | 347 |
| WYM35 | brachypodium\|09v1\|SRR031795S0012454 | brachypodium | 158 | 348 |
| WYM36 | foxtail_millet\|10v2\|SICRP015958 | foxtail_millet | 159 | 255 |
| WYM37 | foxtail_millet\|10v2\|SICRP017191 | foxtail_millet | 160 | 256 |
| WYM38 | foxtail_millet\|11v1\|FOXTAILXMILLETX10V2XFXTRMSLX00055016D1XT1 | foxtail_millet | 161 | 257 |
| WYM40 | foxtail_millet\|11v1\|FOXTAILXMILLETX10V2XFXTRMSLX01384364D1XT1 | foxtail_millet | 162 | 349 |
| WYM42 | maize\|10v1\|AA054812 | maize | 163 | 260 |
| WYM43 | maize\|10v1\|AA979730 | maize | 164 | 350 |
| WYM44 | maize\|10v1\|AA979748 | maize | 165 | 262 |
| WYM46 | maize\|10v1\|AI372300 | maize | 166 | 263 |
| WYM47 | maize\|10v1\|AI586615 | maize | 167 | 264 |
| WYM48 | maize\|10v1\|AI600444 | maize | 168 | 351 |
| WYM51 | maize\|10v1\|AI649490 | maize | 169 | 266 |
| WYM52 | maize\|10v1\|AI665357 | maize | 170 | 267 |
| WYM55 | maize\|10v1\|AI920337 | maize | 171 | 268 |
| WYM56 | maize\|10v1\|AI920394 | maize | 172 | 269 |
| WYM57 | maize\|10v1\|AI974918 | maize | 173 | 352 |
| WYM58 | maize\|10v1\|AW267325 | maize | 174 | 353 |
| WYM59 | maize\|10v1\|AW506641 | maize | 175 | 272 |
| WYM60 | maize\|10v1\|BE055910 | maize | 176 | 273 |
| WYM61 | maize\|10v1\|BG355067 | maize | 177 | 354 |
| WYM62 | maize\|10v1\|BG458626 | maize | 178 | 355 |
| WYM63 | maize\|10v1\|BI245239 | maize | 179 | 276 |
| WYM64 | maize\|10v1\|BQ621148 | maize | 180 | 277 |
| WYM65 | maize\|10v1\|CD948252 | maize | 181 | 278 |
| WYM66 | maize\|10v1\|T26937 | maize | 182 | 279 |
| WYM67 | maize\|10v1\|T70625 | maize | 183 | 280 |
| WYM69 | maize\|10v1\|W59834 | maize | 184 | 281 |
| WYM70 | rice\|gb170\|OS03G48080 | rice | 185 | 282 |
| WYM71 | rice\|gb170\|OS07G44290 | rice | 186 | 283 |
| WYM72 | sorghum\|09v1\|SB01G030550 | sorghum | 187 | 356 |
| WYM74 | sorghum\|09v1\|SB02G002690 | sorghum | 188 | 285 |
| WYM76 | sorghum\|09v1\|SB03G037080 | sorghum | 189 | 286 |
| WYM77 | sorghum\|09v1\|SB04G005000 | sorghum | 190 | 357 |
| WYM79 | sorghum\|09v1\|SB06G001610 | sorghum | 191 | 288 |
| WYM80 | sorghum\|09v1\|SB06G032750 | sorghum | 192 | 358 |
| WYM81 | sorghum\|09v1\|SB09G030000 | sorghum | 193 | 290 |
| WYM83 | sorghum\|09v1\|SB10G029670 | sorghum | 194 | 291 |
| WYM84 | soybean\|11v1\|CD405767 | soybean | 195 | 292 |
| WYM85 | soybean\|11v1\|GLYMA02G41040 | soybean | 196 | 293 |
| WYM86 | soybean\|11v1\|GLYMA05G25910 | soybean | 197 | 294 |

TABLE 52-continued

Identified genes for increasing yield, growth rate, vigor, biomass, oil content, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| WYM87 | soybean\|11v1\|GLYMA07G08240 | soybean | 198 | 359 |
| WYM90 | wheat\|10v2\|BE401466 | wheat | 199 | 360 |
| WYM91 | wheat\|10v2\|BE418556 | wheat | 200 | 361 |
| WYM92 | wheat\|10v2\|BE423194 | wheat | 201 | 299 |
| WYM93 | wheat\|10v2\|BE497501 | wheat | 202 | 300 |
| WYM94 | wheat\|10v2\|BE604122 | wheat | 203 | 301 |
| WYM95 | wheat\|10v2\|CA656649 | wheat | 204 | 362 |
| WYM96 | wheat\|10v2\|CA660726 | wheat | 205 | 363 |
| WYM98 | maize\|10v1\|AI964515 | maize | 206 | 304 |
| WYM99 | brachypodium\|09v1\|DV472468 | brachypodium | 207 | 364 |
| WYM100 | brachypodium\|09v1\|DV475214 | brachypodium | 208 | 306 |
| WYM101 | brachypodium\|09v1\|GT774209 | brachypodium | 209 | 365 |
| WYM103 | foxtail_millet\|11v1\|FOXTAILXMILLETX10V2XFXTRMSLX06595039D1XT1 | foxtail_millet | 210 | 309 |
| WYM104 | maize\|10v1\|AI734660 | maize | 211 | 310 |
| WYM105 | maize\|10v1\|AW000637 | maize | 212 | 311 |
| WYM106 | maize\|10v1\|BG320875 | maize | 213 | 312 |
| WYM107 | maize\|10v1\|CF034815 | maize | 214 | 313 |
| WYM108 | maize\|10v1\|MZEPPGM | maize | 215 | 314 |
| WYM109 | rice\|gb170\|OS08G02210 | rice | 216 | 315 |
| WYM110 | soybean\|11v1\|GLYMA06G12470 | soybean | 217 | 316 |
| WYM112 | wheat\|10v2\|BE399157 | wheat | 218 | 366 |
| WYM113 | wheat\|10v2\|BF474853 | wheat | 219 | 318 |
| LYM90 | barley\|gb157.3\|AV927104_CT1 | barley | 9688 | 9701 |
| LYM91 | barley\|gb157.3\|BE060518_CT1 | barley | 9689 | 9702 |
| LYM320 | barley\|gb157SOLEXA\|BE421502 | barley | 9690 | 9703 |
| LYM332 | barley\|gb157SOLEXA\|BI947101 | barley | 9691 | 9704 |
| LYM350 | maize\|gb170\|AI612450 | maize | 9692 | 9705 |
| LAB259 | rice\|gb170\|OS09G31482 | rice | 9693 | 9708 |
| LYM90 | barley\|gb157.3\|AV927104_T1 | barley | 9694 | 9701 |
| LYM90 | barley\|gb157.3\|AV927104_T1 | barley | 9695 | 9701 |
| LYM91 | barley\|gb157.3\|BE060518_T1 | barley | 9696 | 9702 |
| LYM320 | barley\|gb157SOLEXA\|BE421502 | barley | 9697 | 9706 |
| LYM332 | barley\|gb157SOLEXA\|BI947101 | barley | 9698 | 9707 |
| LYM350 | maize\|gb170\|AI612450 | maize | 9699 | 9705 |
| LAB259 | rice\|gb170\|OS09G31482 | rice | 9700 | 9708 |

Table 52: Provided are the identified genes (core genes SEQ ID NOs: 1-99, core polypeptides: SEQ ID NOs: 220-318), their annotation, organism and polynucleotide and polypeptide sequence identifiers. Also provided are the polynucleotides variants SEQ ID NOs: 100-124 and their encoded polypeptides and the cloned polynucleotides SEQ ID NOs: 125-219 and their encoded polypeptides.
"polyn." = polynucleotide;
"polyp." = polypeptide.

Example 12

Identification of Homologous Sequences that Increase Yield, Fiber Yield, Fiber Quality, Growth Rate, Biomass, Oil Content, Vigor, Abst, and/or Nue of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To further investigate and identify putative orthologs of the genes affecting plant yield, oil yield, oil content, seed yield, growth rate, vigor, biomass, abiotic stress tolerance, and fertilizer use efficiency (FUE) genes and/or nitrogen use efficiency, all sequences were aligned using the BLAST (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level-identical amino acids in the protein domains and similarity in expression profiles. The search and identification of homologous genes involves the screening of sequence information available, for example, in public databases such as the DNA Database of Japan (DDBJ), GenBank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/dbbrowser/protocol/prodomqry (dot) html), PIR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 52 (Example 11 above) were identified from the databases using BLAST software with the Blastp and tBlastn algorithms as filters for the first stage, and the needle (EMBOSS package) or Frame+ algorithm alignment for the second stage. Local identity (Blast alignments) was defined with a very permissive cutoff—60% Identity on a span of 60% of the sequences lengths because it is used only as a filter for the global alignment stage. The default filtering of the Blast package was not utilized (by setting the parameter "—F F").

In the second stage, homologs were defined based on a global identity of at least 80% to the core gene polypeptide sequence. Two distinct forms for finding the optimal global alignment for protein or nucleotide sequences were used in this application:

1. Between Two Proteins (Following the Blastp Filter): EMBOSS-6.0.1 Needleman-Wunsch algorithm with the following modified parameters: gapopen=8 gapextend=2. The rest of the parameters were unchanged from the default options described hereinabove.

2. Between a Protein Sequence and a Nucleotide Sequence (Following the Tblastn Filter): GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options described hereinabove.

The query polypeptide sequences were SEQ ID NOs: 220-366 and 9701-9708 (which are encoded by the polynucleotides SEQ ID NOs:1-219 and 9688-9693, shown in Table 52 above) and the identified orthologous and homologous sequences having at least 80% global sequence identity are provided in Table 53, below. These homologous genes are expected to increase plant yield, seed yield, oil yield, oil content, growth rate, fiber yield, fiber quality, biomass, vigor, ABST and/or NUE of a plant.

---

Lengthy table referenced here

US10260073-20190416-T00001

Please refer to the end of the specification for access instructions.

---

The output of the functional genomics approach described herein is a set of genes highly predicted to improve yield and/or other agronomic important traits such as growth rate, vigor, oil content, fiber yield and/or quality, biomass, abiotic stress tolerance, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described here alone or set of genes together increases the overall yield and/or other agronomic important traits, hence expects to increase agricultural productivity.

Example 13

Gene Cloning and Generation of Binary Vectors for Plant Expression

To validate their role in improving plant yield, oil content, seed yield, biomass, growth rate, fiber yield, fiber quality, ABST, NUE and/or vigor, selected genes were over-expressed in plants, as follows.

Cloning strategy

Selected genes from those listed in Examples 1-12 hereinabove were cloned into binary vectors for the generation of transgenic plants. For cloning, the full-length open reading frame (ORF) was first identified. In case of ORF-EST clusters and in some cases already published mRNA sequences were analyzed to identify the entire open reading frame by comparing the results of several translation algorithms to known proteins from other plant species. To clone the full-length cDNAs, reverse transcription (RT) followed by polymerase chain reaction (PCR; RT-PCR) was performed on total RNA extracted from leaves, flowers, siliques or other plant tissues, growing under normal and different treated conditions. Total RNA was extracted as described in "GENERAL EXPERIMENTAL AND BIOINFORMATICS METHODS" above. Production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.), which are well known to those skilled in the art. PCR products were purified using PCR purification kit (Qiagen). In case where the entire coding sequence was not found, RACE kit from Invitrogen (RACE=Rapid Amplification of cDNA Ends) was used to access the full cDNA transcript of the gene from the RNA samples described above. RACE products were cloned into high copy vector followed by sequencing or directly sequenced.

The information from the RACE procedure was used for cloning of the full length ORF of the corresponding genes.

In case genomic DNA was cloned, the genes are amplified by direct PCR on genomic DNA extracted from leaf tissue using the DNAeasy kit (Qiagen Cat. No. 69104).

Usually, 2 sets of primers were synthesized for the amplification of each gene from a cDNA or a genomic sequence; an external set of primers and an internal set (nested PCR primers). When needed (e.g., when the first PCR reaction does not result in a satisfactory product for sequencing), an additional primer (or two) of the nested PCR primers is used.

To facilitate cloning of the cDNAs/genomic sequences, an 8-12 bp extension was added to the 5' of each primer. The primer extension includes an endonuclease restriction site. The restriction sites were selected using two parameters: (a). The site does not exist in the cDNA sequence; and (b). The restriction sites in the forward and reverse primers were designed such that the digested cDNA was inserted in the sense formation into the binary vector utilized for transformation.

PCR products were digested with the restriction endonucleases (New England BioLabs Inc) according to the sites designed in the primers. Each digested PCR product was inserted into a high copy vector pUC19 ([New England BioLabs Inc], or into plasmids originating from this vector. In some cases the undigested PCR product was inserted into pCR-Blunt II-TOPO (Invitrogen) or directly into the binary vector.

Sequencing of the amplified PCR products was performed, using ABI 377 sequencer (Amersham Biosciences Inc). In some cases, after confirming the sequences of the cloned genes, the cloned cDNA was introduced into a modified pGI binary vector containing the At6669 promoter via digestion with appropriate restriction endonucleases. The digested products and the linearized plasmid vector were ligated using T4 DNA ligase enzyme (Roche, Switzerland).

High copy plasmids containing the cloned genes were digested with the restriction endonucleases (New England BioLabs Inc) according to the sites designed in the primers and cloned into binary vectors.

Several DNA sequences of the selected genes were synthesized by a commercial supplier GeneArt [Hypertext Transfer Protocol://World Wide Web (dot) geneart (dot) com/]. Synthetic DNA was designed in silico. Suitable restriction enzymes sites were added to the cloned sequences at the 5' end and at the 3' end to enable later cloning into the pQFNc or other required binary vector downstream of the At6669 promoter (SEQ ID NO: 9405).

Binary Vectors Used for Cloning: The plasmid pPI was constructed by inserting a synthetic poly-(A) signal sequence, originating from pGL3 basic plasmid vector (Promega, Acc No U47295; by 4658-4811) into the HindIII restriction site of the binary vector pBI101.3 (Clontech, Acc. No. U12640). pGI (pBXYN) was similar to pPI, but the original gene in the backbone, the GUS gene, was replaced by the GUS-Intron gene followed by the NOS terminator (SEQ ID NO: 9419) (Vancanneyt. G, et al MGG 220, 245-50, 1990). pGI was used in the past to clone the polynucleotide sequences, initially under the control of 35S promoter [Odell, J T, et al. Nature 313, 810-812 (28 Feb. 1985); SEQ ID NO:9403].

Figure 2:
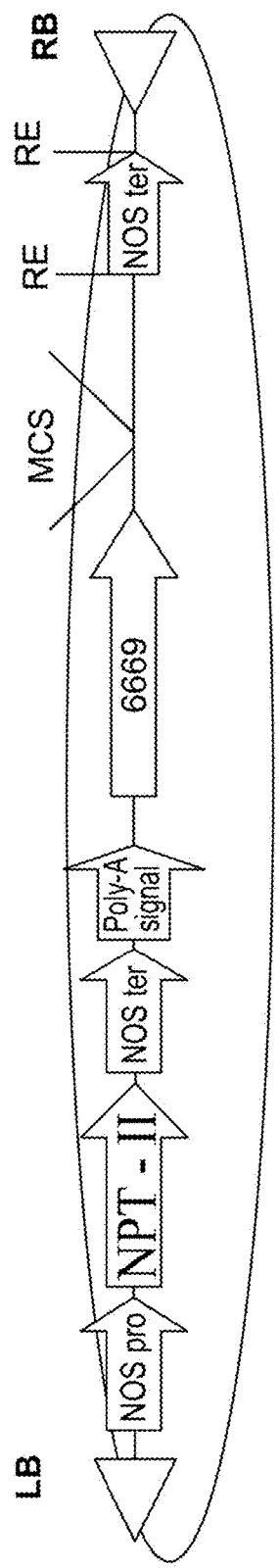
FIG. 2 is a schematic illustration of the modified pGI binary plasmid containing the new At6669 promoter (SEQ ID NO: 9405) (pQFN, pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the MCS of the vector pQFNc.
Figure 3A:
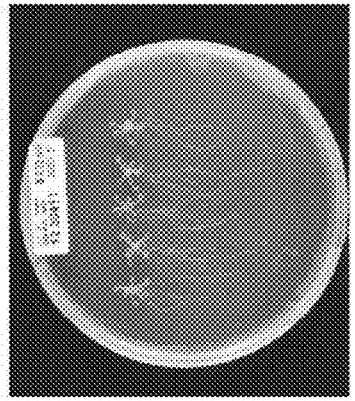
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3B:
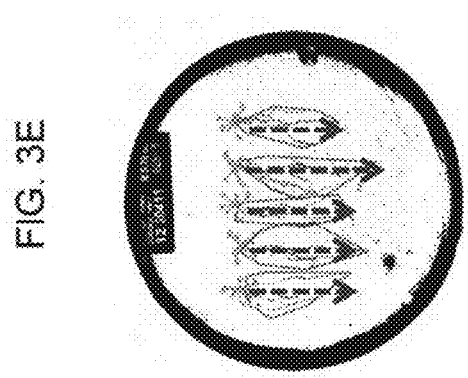
Figure 3C:
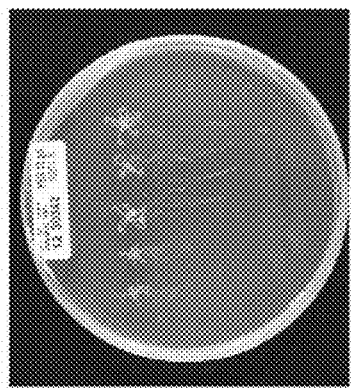
Figure 3D:
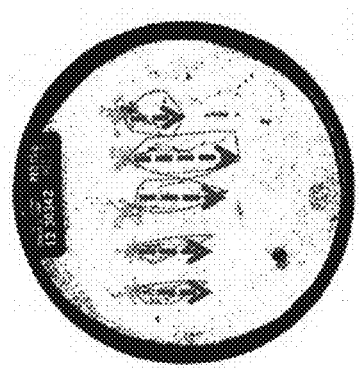
Figure 3E:
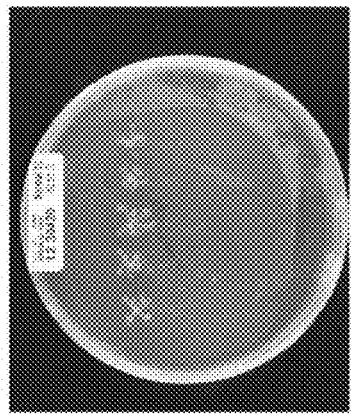
Figure 3F:
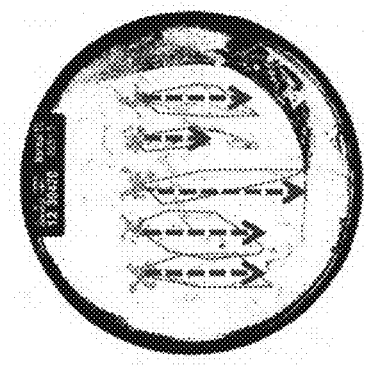
Figure 4:
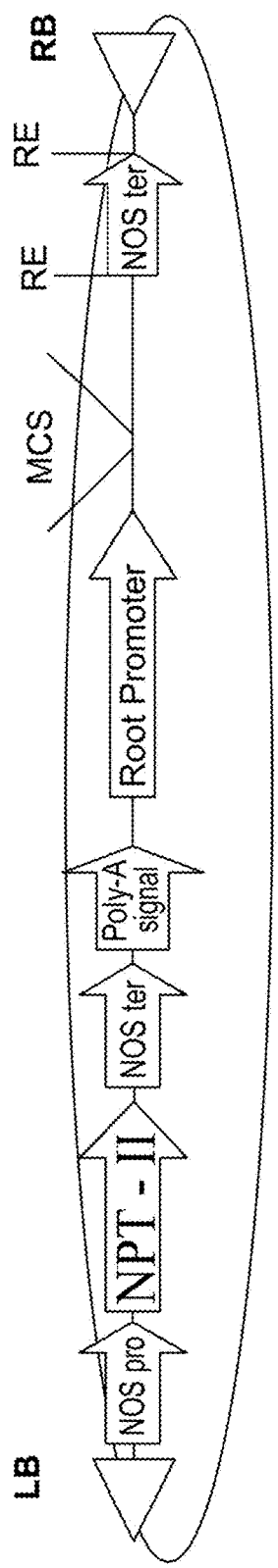
FIG. 4 is a schematic illustration of the modified pGI binary plasmid containing the Root Promoter (pQNa_RP; SEQ ID NO: 9417) used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal). The isolated polynucleotide sequences according to some embodiments of the invention were cloned into the MCS of the vector.
Figure 5:
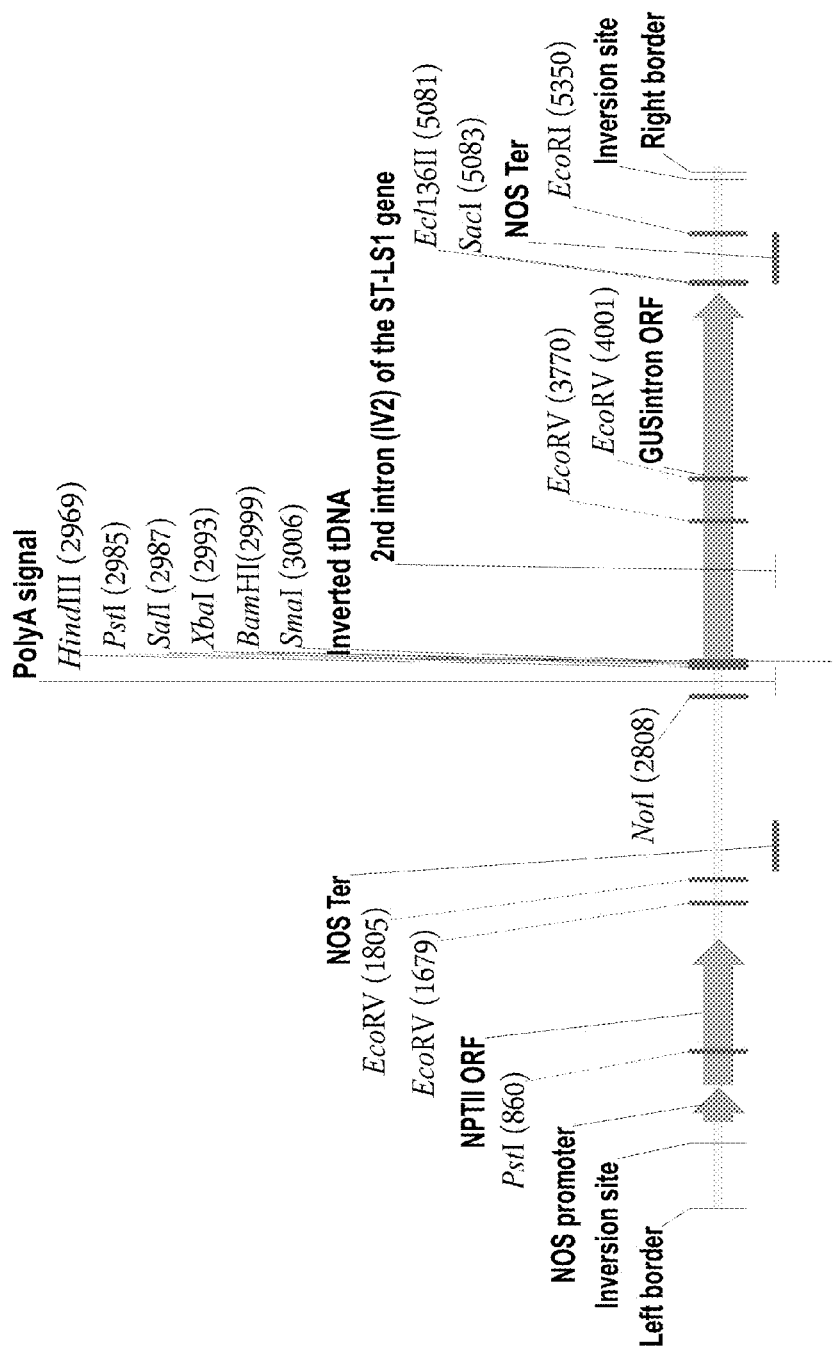
FIG. 5 is a schematic illustration of the pQYN plasmid (5714 bp).
Figure 6:
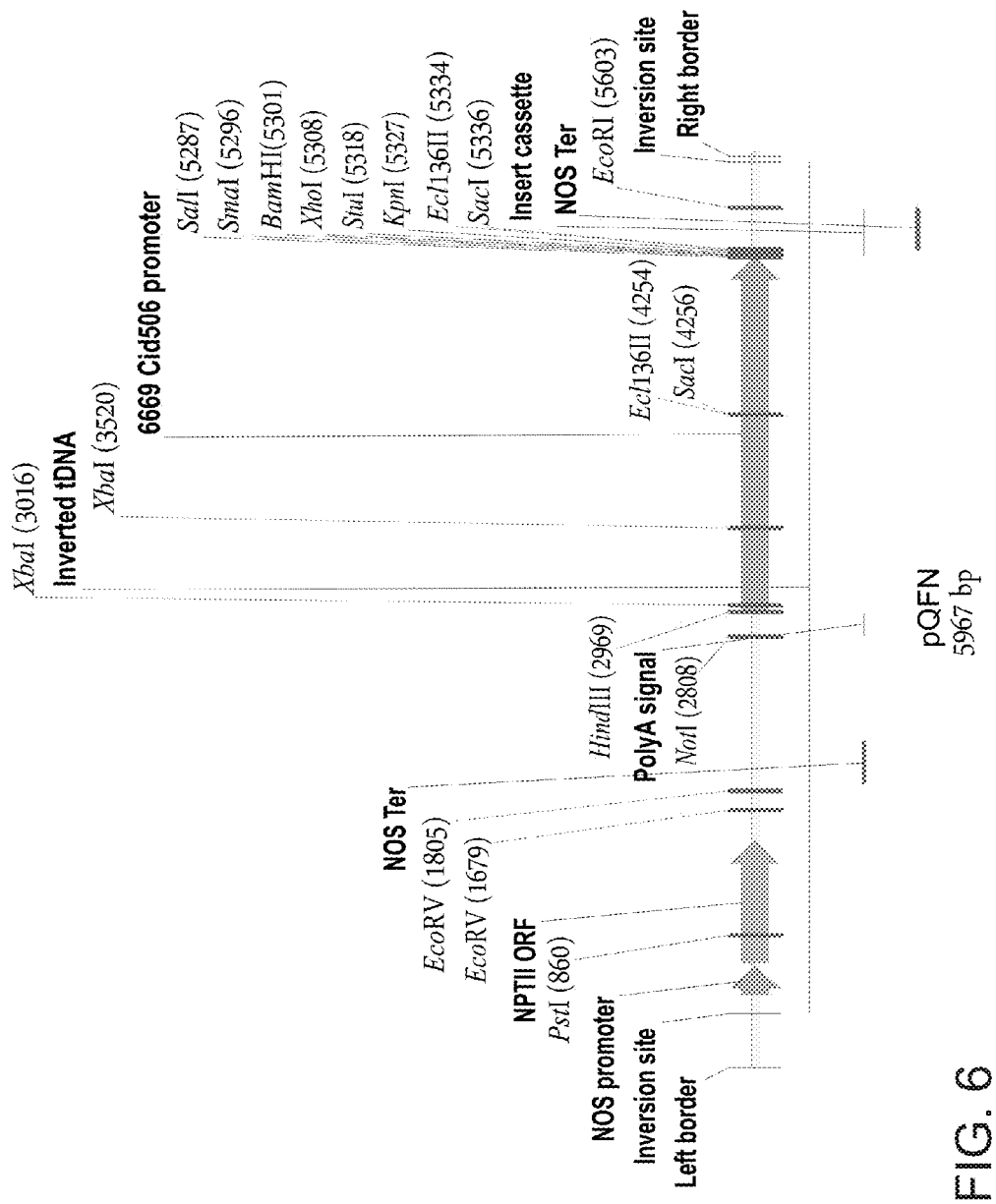
FIG. 6 is a schematic illustration of the pQFN plasmid (5967 bp).
Figure 7:
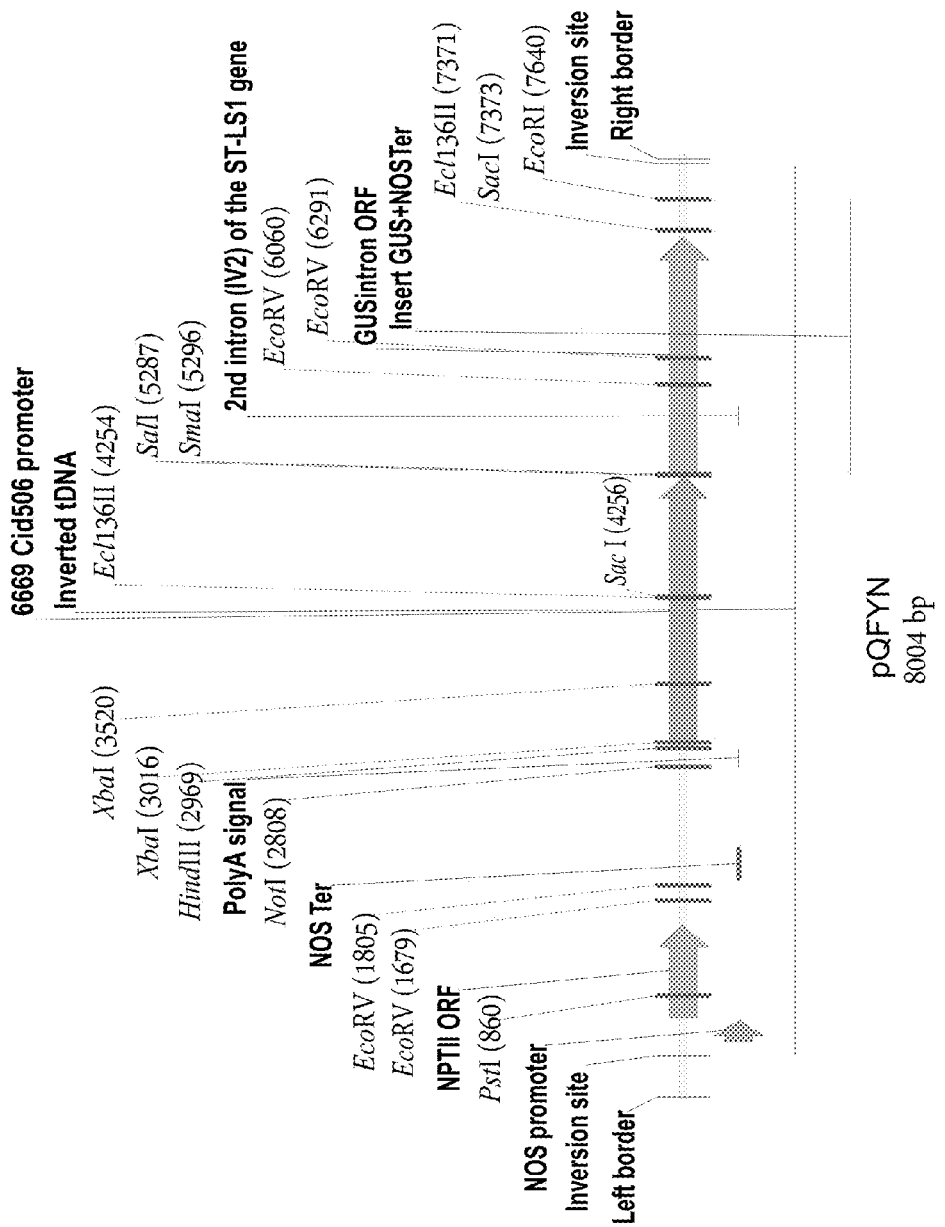
FIG. 7 is a schematic illustration of the pQFYN plasmid (8004 bp).
Figure 8:
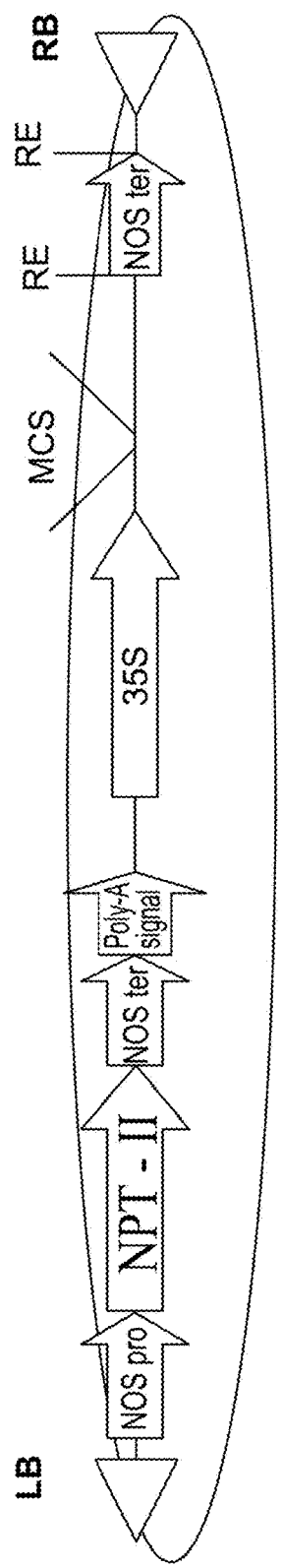
FIG. 8 is a schematic illustration of pQXNc plasmid, which is a modified pGI binary plasmid used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (SEQ ID NO: 9401). The isolated polynucleotide sequences of some embodiments of the invention were cloned into the MCS (Multiple cloning site) of the vector.

The modified pGI vectors [pQXNc (FIG. 8); or pQFN (FIG. 2), pQFNc (FIG. 2) or pQYN_6669 (FIG. 1)] were modified versions of the pGI vector in which the cassette was inverted between the left and right borders so the gene and its corresponding promoter were close to the right border and the NPTII gene was close to the left border.

At6669, the *Arabidopsis thaliana* promoter sequence (SEQ ID NO: 9405) was inserted in the modified pGI binary vector, upstream to the cloned genes, followed by DNA ligation and binary plasmid extraction from positive *E. coli* colonies, as described above.

Colonies were analyzed by PCR using the primers covering the insert which are designed to span the introduced promoter and gene. Positive plasmids were identified, isolated and sequenced.

Selected genes cloned by the present inventors are provided in Table 54 below.

TABLE 54

Genes cloned in high copy number plasmids

| Gene Name | High copy plasmid | Organism | Primers used SEQ ID NOs: | Polyn. SEQ ID NO: | Polyp. SEQ ID NO: |
|---|---|---|---|---|---|
| LAB259 | pKSJ_LAB259 | rice | | 9700 | 9708 |
| LYM320 | pUC19c_LYM320 | barley | | 9697 | 9706 |
| LYM332 | pUC19c_LYM332 | barley | | 9698 | 9707 |
| LYM350_GA | pMA-RQ_LYM350_GA | GeneArt | | 9699 | 9705 |
| LYM90 | pGXN_LYM90 | barley | | 9695 | 9701 |
| LYM91 | pGXN_LYM91 | barley | | 9696 | 9702 |
| WYM113 | pMA-RQ_WYM113_GA | GeneArt | | 219 | 318 |
| WYM112 | pUC19c_WYM112 | wheat | 9649, 9434, 9434, 9434 | 218 | 366 |
| WYM109 | pUC19c_WYM109 | rice | 9514, 9432, 9432, 9432 | 216 | 315 |
| WYM108 | pUC19c_WYM108 | maize | 9513, 9431, 9431, 9431 | 215 | 314 |
| WYM107 | pUC19c_WYM107 | maize | 9648, 9592, 9592, 9592 | 214 | 313 |
| WYM106 | pUC19_WYM106 | maize | 9647, 9591, 9591, 9591 | 213 | 312 |
| WYM105 | pUC19c_WYM105 | maize | 9510, 9428, 9428, 9428 | 212 | 311 |
| WYM104 | pUC19c_WYM104 | maize | 9646, 9590, 9590, 9590 | 211 | 310 |
| WYM103 | pUC19c_WYM103 | foxtail_millet | 9645, 9589, 9589, 9589 | 210 | 309 |
| WYM101 | pUC19c_WYM101 | brachypodium | 9644, 9588, 9588, 9588 | 209 | 365 |
| WYM100 | pQFNc_WYM100 | brachypodium | 9643, 9587, 9587, 9587 | 208 | 306 |
| WYM99 | pUC19c_WYM99 | brachypodium | 9583, 9640, 9640, 9640 | 207 | 364 |
| WYM98 | pUC19_WYM98 | maize | 9687, 9639, 9639, 9639 | 206 | 304 |
| WYM96 | pUC19c_WYM96 | wheat | 9581, 9638, 9638, 9638 | 205 | 363 |
| WYM95 | pUC19d_WYM95 | wheat | 9580, 9637, 9637, 9637 | 204 | 362 |
| WYM94 | pUC19c_WYM94 | wheat | 9686, 9636, 9636, 9636 | 203 | 301 |
| WYM93 | pUC19c_WYM93 | wheat | 9578, 9635, 9635, 9635 | 202 | 300 |
| WYM92 | pUC19c_WYM92 | wheat | 9685, 9634, 9634, 9634 | 201 | 299 |
| WYM91 | pUC19c_WYM91 | wheat | 9684, 9633, 9633, 9633 | 200 | 361 |
| WYM90 | pUC19c_WYM90 | wheat | 9575, 9493, 9493, 9493 | 199 | 360 |
| WYM87 | pUC19c_WYM87 | soybean | 9573, 9491, 9491, 9491 | 198 | 359 |
| WYM86 | pUC19c_WYM86 | soybean | 9572, 9490, 9490, 9490 | 197 | 294 |
| WYM85 | pUC19c_WYM85 | soybean | 9682, 9632, 9632, 9632 | 196 | 293 |
| WYM84 | pUC19c_WYM84 | soybean | 9681, 9631, 9631, 9631 | 195 | 292 |
| WYM83 | pUC19c_WYM83 | sorghum | 9569, 9487, 9487, 9487 | 194 | 291 |
| WYM81 | pUC19c_WYM81 | sorghum | 9568, 9486, 9486, 9486 | 193 | 290 |
| WYM80 | pUC19c_WYM80 | sorghum | 9680, 9630, 9630, 9630 | 192 | 358 |
| WYM79 | pUC19c_WYM79 | sorghum | 9679, 9629, 9629, 9629 | 191 | 288 |
| WYM77 | pUC19c_WYM77 | sorghum | 9678, 9628, 9628, 9628 | 190 | 357 |
| WYM76 | pUC19_WYM76 | sorghum | 9564, 9627, 9627, 9627 | 189 | 286 |
| WYM74 | pUC19c_WYM74 | sorghum | 9677, 9626, 9626, 9626 | 188 | 285 |
| WYM72 | pQFNc_WYM72 | sorghum | 9676, 9625, 9625, 9625 | 187 | 356 |
| WYM71 | pUC19c_WYM71 | rice | 9562, 9480, 9480, 9480 | 186 | 283 |
| WYM70 | pQFNc_WYM70 | rice | 9675, 9624, 9624, 9624 | 185 | 282 |
| WYM69 | pUC19c_WYM69 | maize | 9560, 9478, 9478, 9478 | 184 | 281 |
| WYM67 | pUC19c_WYM67 | maize | 9674, 9477, 9477, 9477 | 183 | 280 |
| WYM66 | pUC19c_WYM66 | maize | 9673, 9622, 9622, 9622 | 182 | 279 |
| WYM65 | pUC19c_WYM65 | maize | 9672, 9621, 9621, 9621 | 181 | 278 |
| WYM64 | pMA-RQ_WYM64_GA | | | 180 | 277 |
| WYM63 | pUC19c_WYM63 | maize | 9671, 9620, 9620, 9620 | 179 | 276 |
| WYM62 | pUC19c_WYM62 | maize | 9556, 9474, 9474, 9474 | 178 | 355 |
| WYM61 | pUC19c_WYM61 | maize | 9670, 9619, 9619, 9619 | 177 | 354 |
| WYM60 | pQFNc_WYM60 | maize | 9669, 9618, 9618, 9618 | 176 | 273 |
| WYM59 | pUC19c_WYM59 | maize | 9668, 9617, 9617, 9617 | 175 | 272 |
| WYM58 | pUC19c_WYM58 | maize | 9667, 9616, 9616, 9616 | 174 | 353 |
| WYM57 | pUC19c_WYM57 | maize | 9666, 9615, 9615, 9615 | 173 | 352 |
| WYM56 | pMA-RQ_WYM56_GA | | | 172 | 269 |
| WYM55 | pUC19c_WYM55 | maize | 9665, 9614, 9614, 9614 | 171 | 268 |
| WYM52 | pUC19c_WYM52 | maize | 9549, 9613, 9613, 9613 | 170 | 267 |
| WYM51 | pUC19c_WYM51 | maize | 9548, 9466, 9466, 9466 | 169 | 266 |
| WYM48 | pUC19c_WYM48 | maize | 9547, 9465, 9465, 9465 | 168 | 351 |
| WYM47 | pUC19c_WYM47 | maize | 9664, 9612, 9612, 9612 | 167 | 264 |
| WYM46 | pUC19c_WYM46 | maize | 9663, 9463, 9463, 9463 | 166 | 263 |
| WYM44 | pUC19c_WYM44 | maize | 9662, 9611, 9611, 9611 | 165 | 262 |
| WYM43 | pUC19c_WYM43 | maize | 9544, 9610, 9610, 9610 | 164 | 350 |
| WYM42 | pUC19c_WYM42 | maize | 9661, 9609, 9609, 9609 | 163 | 260 |
| WYM40 | TopoB_WYM40 | foxtail_millet | 9542, 9460, 9460, 9460 | 162 | 349 |
| WYM38 | pUC19c_WYM38 | foxtail_millet | 9540, 9608, 9608, 9608 | 161 | 257 |
| WYM37 | pUC19c_WYM37 | foxtail_millet | 9660, 9607, 9607, 9607 | 160 | 256 |
| WYM36 | pUC19c_WYM36 | foxtail_millet | 9659, 9606, 9606, 9606 | 159 | 255 |
| WYM35 | pUC19c_WYM35 | brachypodium | 9658, 9605, 9605, 9605 | 158 | 348 |
| WYM34 | pQFNc_WYM34 | brachypodium | 9657, 9604, 9604, 9604 | 157 | 347 |
| WYM33 | pUC19c_WYM33 | brachypodium | 9535, 9453, 9453, 9453 | 156 | 252 |
| WYM32 | pUC19d_WYM32 | brachypodium | 9534, 9603, 9603, 9603 | 155 | 251 |
| WYM31 | pUC19c_WYM31 | brachypodium | 9656, 9602, 9602, 9602 | 154 | 346 |
| WYM30 | pUC19c_WYM30 | brachypodium | 9655, 9601, 9601, 9601 | 153 | 249 |

TABLE 54-continued

Genes cloned in high copy number plasmids

| Gene Name | High copy plasmid | Organism | Primers used SEQ ID NOs: | Polyn. SEQ ID NO: | Polyp. SEQ ID NO: |
|---|---|---|---|---|---|
| WYM29 | pUC19c_WYM29 | brachypodium | 9530, 9448, 9448, 9448 | 152 | 248 |
| WYM28 | pUC19c_WYM28 | brachypodium | 9529, 9600, 9600, 9600 | 151 | 247 |
| WYM27 | pUC19c_WYM27 | brachypodium | 9528, 9446, 9446, 9446 | 150 | 246 |
| WYM26 | pUC19c_WYM26 | brachypodium | 9527, 9599, 9599, 9599 | 149 | 245 |
| WYM25 | pUC19c_WYM25 | brachypodium | 9526, 9444, 9444, 9444 | 148 | 244 |
| WYM24 | pUC19c_WYM24 | brachypodium | 9525, 9443, 9443, 9443 | 147 | 345 |
| WYM23 | pUC19c_WYM23 | brachypodium | 9654, 9598, 9598, 9598 | 146 | 344 |
| WYM22 | pUC19c_WYM22 | brachypodium | 9524, 9597, 9597, 9597 | 145 | 241 |
| WYM21 | pUC19d_WYM21 | brachypodium | 9653, 9441, 9441, 9441 | 144 | 240 |
| WYM20 | pQFNc_WYM20 | barley | 9522, 9440, 9440, 9440 | 143 | 343 |
| WYM18 | pUC19c_WYM18 | barley | 9521, 9439, 9439, 9439 | 142 | 342 |
| WYM17 | pUC19c_WYM17 | barley | 9520, 9595, 9595, 9595 | 141 | 341 |
| WYM16 | pQFNc_WYM16 | barley | 9651, 9594, 9594, 9594 | 140 | 235 |
| WYM15 | pUC19c_WYM15 | barley | 9518, 9436, 9436, 9436 | 139 | 234 |
| WYM13 | pUC19c_WYM13 | barley | 9650, 9593, 9593, 9593 | 138 | 233 |
| WYM12 | pUC19c_WYM12 | barley | 9517, 9435, 9435, 9435 | 137 | 340 |
| WYM11 | pUC19c_WYM11 | barley | 9515, 9433, 9433, 9433 | 136 | 231 |
| WYM9 | pUC19c_WYM9 | barley | 9683, 9492, 9492, 9492 | 135 | 339 |
| WYM8 | pQFNc_WYM8 | barley | 9566, 9484, 9484, 9484 | 134 | 229 |
| WYM7 | pUC19_WYM7 | barley | 9561, 9623, 9623, 9623 | 133 | 338 |
| WYM4 | pUC19c_WYM4 | barley | 9541, 9459, 9459, 9459 | 132 | 337 |
| WYM3 | pUC19c_WYM3 | barley | 9531, 9449, 9449, 9449 | 131 | 336 |
| WYM2 | pUC19c_WYM2 | barley | 9652, 9596, 9596, 9596 | 130 | 225 |
| WYM1 | pUC19c_WYM1 | barley | 9505, 9586, 9586, 9586 | 129 | 224 |
| WYM110 | pMA-T_WYM110_GA | | | 217 | 316 |
| LYM490_H1 | pUC19c_LYM490H1 | maize | 9504, 9422, 9422, 9422 | 128 | 335 |
| LYM208_H4 | pUC19c_LYM208H4 | sorghum | 9642, 9585, 9585, 9585 | 127 | 334 |
| LNU74_H109 | pUC19c_LNU74H109 | maize | 9641, 9584, 9584, 9584 | 126 | 221 |
| LAB278_H0 | pUC19_LAB278H0 | maize | 9502, 9420, 9420, 9420 | 125 | 333 |

Table 54: "Polyn."—Polynucleotide; Polyp."—polypeptide. For cloning of each gene at least 2 primers were used: Forward (Fwd) or Reverse (Rev). In some cases, 4 primers were used: External forward (EF), External reverse (ER), nested forward (NF) or nested reverse (NR). The sequences of the primers used for cloning the genes are provided in the sequence listing. The genes were cloned from the same organism as identified in the list of genes provided in Table 52 above, except for the genes that were synthetically produced by GeneArt.

Example 14

Transforming *Agrobacterium* Tumefaciens Cells with Binary Vectors Harboring Putative Genes Each of the binary vectors described in Example 13 above were used to transform *Agrobacterium* cells. An additional binary construct was used as negative control containing empty vector carrying At6669 promoter and the selection marker.

For transformation in *Arabidopsis* plants, the binary vectors were introduced to *Agrobacterium tumefaciens* GV301, GV303 or LB4404 competent cells (about $10^9$ cells/mL) by electroporation.

For transformation into *Brachypodium*, the binary vectors were introduced into *Agrobacterium tumefaciens* AGL1.

The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. Abrobacterium colonies, which were developed on the selective media, were analyzed by PCR using the primers which were designed to span the inserted sequence in the pPI plasmid. The resulting PCR products were isolated and sequenced as described in Example 13 above, to verify that the correct nucleotide sequences were properly introduced to the *Agrobacterium* cells.

Example 15

Producing Transgenic *Arabidopsis* Plants Expressing Selected Genes According to Some Embodiments of the Invention Materials and Experimental Methods Plant Transformation—The *Arabidopsis thaliana* var Columbia ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues are the primary targets of *Agrobacterium*-mediated transformation by the *Arabidopsis* floral-dip method. Plant Physiol. 123(3): 895-904] with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Single colonies of *Agrobacterium* carrying the binary vectors harboring the yield genes were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contained half-strength (2.15 g/L) Murashige-Skoog (Duchefa); 0.044 μM benzylamino purine (Sigma); 112 μg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the above ground plant tissue was submerged for 3-5 seconds. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ *Arabidopsis* plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 16

Transformation of *Brachypodium* Distachyon Plants with the Polynucleotides of the Invention Similar to the *Arabidopsis* model plant, *Brachypodium distachyon* has several features that recommend it as a model plant for functional genomic studies, especially in the grasses. Traits that make it an ideal model include its small genome (~355 Mbp), small physical stature, a short life-cycle, and few growth requirements. *Brachypodium* is related to the major cereal grain species but is understood to be more closely related to the Triticeae (wheat, barley) than to the other cereals. *Brachypodium*, with its polyploidy accessions, can serve as an ideal model for these grains (whose genomics size and complexity is a major barrier to biotechnological improvement).

*Brachypodium distachyon* embryogenic calli were transformed using the procedure described by Vogel and Hill (2008) (High-efficiency *Agrobacterium*-mediated transformation of *Brachypodium distachyon* inbred line Bd21-3. Plant Cell Rep 27:471-478) and by Vain et al (2008) (Agrobacterium-mediated transformation of the temperate grass *Brachypodium distachyon* (genotypeBd21) for T-DNA insertional mutagenesis. Plant Biotechnology J 6: 236-245), each of which is fully incorporated herein by reference, with some minor modifications.

Briefly, compact embryogenic calli were derived from immature embryos of *Brachypodium distachyon* accession Bd21-3, an inbred diploid line. Appropriate immature bell-shaped embryos of size ~0.3 mm, were plated onto CIM medium+2,4-Dichlorophenoxyacetic acid (2.5 mg/l, SIGMA, Catalogue number: D7299)+$CuSO_4.5H_2O$ (0.6 mg/l, Sigma, Catalogue number: C3036). One liter (1 L) of CIM medium was prepared by adding the following components to a final volume of 1 liter water ($H_2O$): LS+vitamins 4.4 grams (Duchefa, Catalogue number: L0230); Sucrose 30 grams (Duchefa, Catalogue number: S0809); Phytagel 2 grams (SIGMA, Catalogue number: P8169). After two weeks in culture, the embryogenic calli were fragmented into 4 to 6 pieces each, and plated on the same CIM medium with 2, 4-Dichlorophenoxyacetic acid and $CuSO_4.5H_2O$. Two weeks later, the calli were fragmented and plated again (no more than 25 calli per plate). By 4 weeks in culture the calli were ready for infection with *Agrobacterium*.

Single colonies of *Agrobacterium* carrying the binary vectors harboring the yield genes were cultured over a plate of MGL medium containing 50 mg/l (milligrams per liter) kanamicin, 50 mg/l carbenicillin and acetosyringone 200 μM (micromolar) final. One liter (1 L) of MGL medium was prepared by adding the following components to a final volume of 1 liter water ($H_2O$): Yeast extract 2.5 grams (HIMEDIA, Catalogue number: RM027), Triptone 5 grams (Duchefa, Catalogue number: T1332), NaCl 5 grams (Bio-Lab, Catalogue number: 19030591), $MgSO_4 \times 7H_2O$ 204 milligrams (SIGMA, Catalogue number: M1880), D-Manitol 5 grams (Duchefa, Catalogue number: D0803), $KH_2PO_4$ 250 milligrams (Duchefa, Catalogue number: P0574), Glutamic Acid 1.2 grams (Duchefa, Catalogue number: G0707). After 24 hours at 28° C. the *Agrobacterium* layer which was scraped from plate was resuspended into 40 ml of MS medium (containing acetosyringone 200 μM), and placed on a shaker at 220 rpm for 45 minutes in a 28° C. incubator. Then, the *Agrobacterium* suspension was diluted to O.D. 1.0 with MS medium. Ten ml of the diluted *Agrobacterium* suspension were dispensed onto each of plates containing the embryonic calli and incubated for 5 minutes inoculation in a laminar flow hood at room temp. Then, the suspension was completely removed from the plates, calli pieces were handpicked onto a filter in a dry Petri dish, where they were dried by desiccation for several minutes. The blotted calli were then plated (25 pieces per plate) onto a filter wetted with 750 μl of MS medium, where they were co-cultivation with the *Agrobacterium* for 2 days at 25° C. in the dark.

Selection of transformed calli was done on plates containing 30 ml of CIM medium+2,4-Dichlorophenoxyacetic (2.5 mg/l) $CuSO_4.5H_2O$ (0.6 mg/l)+Ticarcillin disodium (400 mg/l)+Hygromycin Sulfate (40 mg/l) medium, that were cultured for 2 weeks in the dark. The surviving calli were then transferred to fresh medium where they were cultured for additional 2 weeks. Four weeks after transformation, the calli were transferred onto Shoot Induction Medium (SIM) medium (Linsmaier and Skoog Physiol. Plantarum, 18:100, 1965, which is fully incorporated herein by reference)+6-Benzylaminopurin riboside (1 mg/l)+IAA (0.25 mg/l)+$CuSO_4$ (0.6 mg/l)+ascorbic acid (20 mg/l)+Tic (200 mg/l)+HM (40 mg/l), where shoots of $T_0$ plants start to regenerate during 2 weeks at 25° C. under a 16 hour light/8 hour dark photoperiod. Regenerated shoots were transferred to maturation medium consist of Nitsch [Nitsch salts and vitamins 2.18 g/l+sucrose 15 g/l pH 5.8+phytagel 0.2%]+α-Naphthalene Acetic Acid (2 mg/l)+Indole-3-Acetic Acid (1 mg/l) medium, where they regenerate roots in 2 to 3 weeks.

Regenerated transgenic $T_0$ plants were grown in the greenhouse for ~3 months until seed maturation and spikelet drying. Seeds were harvested from plants and kept at 10° C. until sowing. For the generation of $T_1$ and $T_2$ transgenic plants that harbor the transformed genes, surface-sterilized seeds were collected from transgenic $T_0$ plants and placed in trays with sowing mix containing 0.3 ml/L BASTA selection with 60 mg/L DL-Phoshpinothricin active ingredient. The sowing trays were incubated at 4° C. for 72 hours and then transferred to a growth room at 25° C. for an additional 10-12 days of incubation. Vital $T_1$ brachypodium plants were transferred to growth mix in validation plots that were placed in the greenhouse, where they grow up to maturity. Seeds harvested from $T_1$ plants were germinated and grown to maturity as $T_2$ plants under the same conditions as described for $T_1$ plants.

Example 17

Transformation of Triticum Aestivum L Plants with the Polynucleotides of the Invention Triticum aestivum embryogenic calli were transformed using the procedure described in U.S. Pat. No. 7,238,862, which is fully incorporated herein by reference in its entirety. Briefly, immature embryos of wheat cv Bobwhite were isolated from the immature caryopsis (wheat spikelets) 12-15 days after pollination, and cultured on M7 medium for 4-6 days. The embryos without embryogenic callus were selected for Agrobacterium inoculation.

Agrobacterium is grown on solid medium at 28° C. for 3 days and then at 23° C. for 1 day. The Agrobacterium was then directly collected on the solid medium, diluted with 1/10 CM4C medium [MS basal salts with vitamins, sucrose, agar and supplemented with specific growth regulators; provided by BIOWORLD, Dublin, Ohio 43017, USA, Catalogue No. 30630121-1 (759995)] and used for inoculation. Explants were incubated with the washed and resuspended Agrobacterium cell suspension. The inoculation was generally performed at a temperature of 24° C.-26° C., from about 1 minute to about 3 hours. After the inoculation period, the inoculated immature embryos were placed in plates with filter paper Whatman No. 1 wetted with 200 μl sterile water 20-50 embryos X4/plate. Plates were parafilmed and incubated in the dark, 24-26° C. for 2-3 days. After such 3-day co-cultivation, the Agrobacterium-infected precultured immature embryos (PCIE) and embryogenic calli were transferred to CM4C medium supplemented with 500 mg/L carbenicillin and cultured for about seven days for selection and plant regeneration. This "delay" medium can also contain glyphosate (0.02 mM). The infected precultured immature embryos explants formed embryogenic callus on this medium.

The explants were then transferred to CM4C selection medium with 2 mM glyphosate and 500 mg/L carbenicillin for one week in the dark. All the calli were transferred to MMS0.2C medium (1×MS salts and Vitamins, 1.95 g/L MES, 0.2 mg/L 2,4-D, and 40 g/L maltose, pH 5.6, solidified by 2 g/L Gelrite; after autoclaving, adding 100 mg/L ascorbic acid) supplemented with 0.1 mM glyphosate and 250 mg/L carbenicillin (first regeneration medium) for an additional two weeks of selection with lighting conditions of about 80 μE. Green spots or shoots formed at the end of this culture period. All the embryogenic calli were transferred to the second regeneration medium MMSOC supplemented with 500 mg/L carbenicillin and 0.02 mM glyphosate. These tissues were transferred to fresh media every two weeks. Plantlets with elongated meristems and roots can be regenerated from embryogenic callus tissue any time during the culture period. Once the root system was established, the plants were transferred to soil and subsequently assayed. All the plants originating from the same infected precultured immature embryo or callus were considered as siblings from the same transgenic event.

Example 18

Evaluation of Transgenic Arabidopsis for Seed Yield and Plant Growth Rate Under Normal Conditions in Greenhouse Assays (GH-SM Assays)

Assay 1: Seed yield plant biomass and plant growth rate under normal greenhouse conditions—This assay follows seed yield production, the biomass formation and the rosette area growth of plants grown in the greenhouse at non-limiting nitrogen growth conditions. Transgenic Arabidopsis seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until mature seeds. Seeds were harvested, extracted and weighted. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying the At6669 promoter and the selection marker were used as control.

The plants were analyzed for their overall size, growth rate, flowering, seed yield, 1,000-seed weight, dry matter and harvest index (HI— seed yield/dry matter). Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was and is calculated, including leaf number, rosette area, rosette diameter, and leaf blade area.

Vegetative growth rate: the (GR) of leaf number [Formula VI (described above)], rosette area (Formula XIX below), plot coverage (Formula XX below) and harvest index (Formula IV above) was calculated with the indicated formulas.

Growth rate of rosette area=Regression coefficient of rosette area along time course.  Formula XIX:

Growth rate of plot coverage=Regression coefficient of plot coverage along time course Formula XX: GR plot coverage Growth rate (GR) rosette diameter—Regression coefficient of rosette diameter along time course.  Formula XXIV:

Seeds average weight—At the end of the experiment all seeds were collected. The seeds are scattered on a glass tray and a picture was taken. Using the digital analysis, the number of seeds in each sample was calculated.

Dry weight and seed yield—On about day 80 from sowing, the plants were harvested and left to dry at 30° C. in a drying chamber. The biomass and seed weight of each plot were measured and divided by the number of plants in each plot.

Dry weight=total weight of the vegetative portion above ground (excluding roots) after drying at 30° C. in a drying chamber;

Seed yield per plant=total seed weight per plant (gr.).

1000 seed weight (the weight of 1000 seeds) (gr.).

Oil percentage in seeds—At the end of the experiment all seeds from each plot were collected. Seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane is evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra-Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical analyses—To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Experimental results:

Tables 55-59 summarize the observed phenotypes of transgenic plants expressing the genes constructs using the GH-SM Assays.

The genes listed in Tables 55-59 improved plant performance when grown at normal conditions. These genes produced larger plants with a larger photosynthetic area, leaf number, biomass (dry weight, rosette diameter, rosette area and plot coverage, leaf blade area), growth rate (e.g., of leaf number, plot coverage and rosette diameter), blade relative area, yield (e.g., harvest index, seed yield, 1000 seed weight), as well as inflorescence emergence. The genes were cloned under the regulation of a constitutive At6669 promoter (SEQ ID NO:9405). The evaluation of each gene was performed by testing the performance of different number of events. Event with p-value<0.1 was considered statistically significant.

TABLE 55

Genes showing improved plant performance at normal growth conditions under regulation of At6669 promoter

| Gene Name | Event # | Dry Weight [mg] | | | Flowering [days] | | | Inflorescence Emergence [days] | | |
|---|---|---|---|---|---|---|---|---|---|---|
| | | Ave. | P-Val. | % Incr. | Ave. | P-Val. | % Incr. | Ave. | P-Val. | % Incr. |
| WYM7 | 71168.1 | — | — | — | 22.6 | 0.03 | −4 | 15.5 | 0.20 | −3 |
| WYM17 | 71315.1 | — | — | — | 23.1 | 0.20 | −2 | — | — | — |
| WYM52 | 71463.1 | 709.9 | 0.12 | 9 | 22.9 | 0.08 | −3 | — | — | — |
| WYM106 | 71687.6 | 677.1 | 0.25 | 4 | — | — | — | — | — | — |
| WYM110 | 71443.5 | — | — | — | 23.1 | 0.21 | −2 | — | — | — |
| WYM52 | 71461.2 | — | — | — | 22.5 | 0.02 | −5 | 15.6 | 0.23 | −3 |
| WYM77 | 70947.1 | 707.5 | 0.09 | 8 | — | — | — | — | — | — |
| WYM106 | 71685.3 | 697.5 | 0.13 | 7 | 23.1 | 0.19 | −2 | — | — | — |
| CONT. | — | 652.2 | — | — | 23.6 | — | — | 16.0 | — | — |
| WYM47 | 69683.5 | 724.6 | 0.23 | 3 | 22.2 | L | −5 | — | — | — |
| WYM80 | 69995.1 | 736.0 | 0.17 | 5 | 23.1 | 0.24 | −1 | — | — | — |
| WYM80 | 69994.1 | — | — | — | 22.8 | 0.08 | −2 | — | — | — |
| WYM77 | 70947.4 | 728.5 | 0.18 | 4 | — | — | — | 15.4 | 0.21 | 0 |
| WYM80 | 69995.4 | — | — | — | 22.7 | 0.06 | −3 | — | — | — |
| CONT. | — | 703.6 | — | — | 23.4 | — | — | 15.5 | — | — |
| WYM26 | 71627.6 | 774.2 | 0.03 | 11 | — | — | — | — | — | — |
| WYM110 | 71443.1 | 730.6 | 0.20 | 5 | — | — | — | — | — | — |
| WYM77 | 70949.3 | 747.0 | 0.16 | 7 | — | — | — | — | — | — |
| WYM77 | 70947.2 | — | — | — | 21.4 | L | −7 | 15.3 | 0.19 | −1 |
| WYM95 | 70178.4 | — | — | — | 22.6 | 0.24 | −1 | — | — | — |
| WYM17 | 71314.3 | 741.6 | 0.10 | 7 | 22.5 | 0.15 | −2 | — | — | — |
| CONT. | — | 695.5 | — | — | 22.9 | — | — | 15.4 | — | — |
| WYM17 | 71315.2 | 780.9 | 0.16 | 8 | 21.9 | 0.17 | −3 | — | — | — |

TABLE 55-continued

Genes showing improved plant performance at normal growth conditions under regulation of At6669 promoter

| Gene Name | Event # | Dry Weight [mg] | | | Flowering [days] | | | Inflorescence Emergence [days] | | |
|---|---|---|---|---|---|---|---|---|---|---|
| | | Ave. | P-Val. | % Incr. | Ave. | P-Val. | % Incr. | Ave. | P-Val. | % Incr. |
| WYM95 | 70180.2 | 786.8 | 0.11 | 9 | — | — | — | — | — | — |
| WYM7 | 71169.7 | — | — | — | 22.0 | 0.21 | −2 | — | — | — |
| WYM7 | 71170.1 | — | — | — | 22.1 | 0.23 | −2 | — | — | — |
| WYM95 | 70181.2 | — | — | — | 21.9 | 0.20 | −3 | 15.3 | 0.29 | −1 |
| CONT. | — | 721.4 | — | — | 22.5 | — | — | 15.4 | — | — |
| WYM80 | 69993.2 | 723.3 | 0.03 | 16 | — | — | — | 15.5 | 0.20 | −2 |
| WYM95 | 70182.3 | 655.4 | 0.17 | 5 | 21.5 | 0.02 | −5 | 15.5 | 0.20 | −2 |
| WYM17 | 71313.9 | 687.1 | 0.08 | 10 | — | — | — | 15.4 | 0.15 | −2 |
| WYM95 | 70182.5 | 710.0 | 0.02 | 14 | 21.9 | 0.07 | −3 | 15.5 | 0.20 | −2 |
| WYM47 | 69685.5 | 675.4 | 0.09 | 8 | 21.9 | 0.07 | −3 | 15.5 | 0.20 | −2 |
| WYM17 | 71316.2 | — | — | — | 21.4 | 0.03 | −5 | 15.3 | 0.12 | −3 |
| WYM95 | 70178.1 | 685.8 | 0.05 | 10 | 21.9 | 0.10 | −3 | 15.5 | 0.20 | −2 |
| CONT. | — | 625.0 | — | — | 22.6 | — | — | 15.8 | — | — |
| WYM106 | 71684.4 | 690.0 | 0.13 | 7 | — | — | — | — | — | — |
| WYM110 | 71442.5 | 739.5 | 0.03 | 14 | 21.1 | L | −7 | 15.3 | 0.05 | −1 |
| WYM47 | 69681.4 | — | — | — | 21.7 | 0.06 | −4 | 15.3 | 0.16 | −1 |
| WYM47 | 69685.3 | 677.4 | 0.20 | 5 | 21.6 | 0.02 | −5 | 15.5 | 0.20 | 0 |
| WYM26 | 71627.4 | 694.8 | 0.09 | 7 | — | — | — | — | — | — |
| WYM26 | 71626.6 | 699.2 | 0.08 | 8 | — | — | — | — | — | — |
| WYM110 | 71445.5 | 684.1 | 0.20 | 6 | — | — | — | — | — | — |
| WYM106 | 71687.1 | 697.5 | 0.08 | 8 | — | — | — | 15.5 | 0.20 | 0 |
| CONT. | — | 647.8 | — | — | 22.7 | — | — | 15.6 | — | — |
| WYM52 | 71463.4 | — | — | — | 22.6 | 0.02 | −5 | 15.6 | 0.11 | −5 |
| WYM110 | 71445.6 | — | — | — | 22.8 | 0.06 | −4 | 15.8 | 0.17 | −4 |
| WYM44 | 71321.3 | 704.2 | 0.28 | 3 | 22.8 | 0.04 | −4 | — | — | — |
| WYM77 | 70948.2 | — | — | — | 23.0 | 0.10 | −3 | — | — | — |
| WYM26 | 71623.2 | 749.0 | 0.07 | 9 | 23.3 | 0.26 | −2 | — | — | — |
| WYM80 | 69994.2 | 738.4 | 0.21 | 8 | 22.5 | 0.02 | −5 | 15.5 | 0.10 | −6 |
| WYM110 | 71443.6 | 720.3 | 0.23 | 5 | 23.1 | 0.11 | −3 | 15.7 | 0.13 | −5 |
| WYM17 | 71313.6 | — | — | — | 23.1 | 0.12 | −2 | 15.5 | 0.10 | −6 |
| CONT. | — | 685.7 | — | — | 23.7 | — | — | 16.4 | — | — |
| WYM95 | 70181.1 | — | — | — | 23.1 | 0.03 | −4 | — | — | — |
| WYM47 | 69685.1 | 712.9 | 0.03 | 7 | 22.6 | L | −6 | — | — | — |
| WYM95 | 70183.2 | 747.7 | 0.03 | 12 | 23.0 | 0.03 | −4 | — | — | — |
| WYM47 | 69683.3 | 683.9 | 0.12 | 2 | 22.4 | L | −7 | — | — | — |
| WYM95 | 70181.3 | — | — | — | 22.6 | L | −6 | — | — | — |
| WYM80 | 69994.4 | 738.4 | L | 10 | 23.0 | 0.02 | −5 | — | — | — |
| WYM26 | 71622.3 | 777.9 | 0.03 | 16 | 23.5 | 0.23 | −2 | — | — | — |
| WYM77 | 70949.1 | 703.4 | 0.19 | 5 | 23.6 | 0.12 | −2 | — | — | — |
| CONT. | — | 669.3 | — | — | 24.1 | — | — | 15.4 | — | — |
| WYM52 | 71465.5 | 820.0 | 0.24 | 3 | 22.0 | 0.04 | −3 | 15.4 | 0.21 | 0 |
| WYM44 | 71317.1 | — | — | — | 22.5 | 0.15 | −1 | — | — | — |
| CONT. | — | 794.2 | — | — | 22.8 | — | — | 15.5 | — | — |
| WYM7 | 71169.2 | 932.5 | 0.04 | 22 | 21.3 | L | −6 | 15.4 | 0.19 | −1 |
| WYM52 | 71461.6 | 806.4 | 0.21 | 5 | 22.3 | 0.22 | −1 | — | — | — |
| WYM17 | 71313.4 | — | — | — | 22.3 | 0.23 | −1 | — | — | — |
| WYM95 | 70181.6 | 840.0 | 0.15 | 10 | — | — | — | — | — | — |
| CONT. | — | 766.1 | — | — | 22.6 | — | — | 15.4 | — | — |
| WYM17 | 71315.4 | — | — | — | 22.1 | 0.22 | −2 | — | — | — |
| CONT. | — | 809.5 | — | — | 22.4 | — | — | 15.4 | — | — |
| WYM44 | 71322.4 | — | — | — | — | — | — | 15.4 | 0.12 | −1 |
| WYM110 | 71444.4 | — | — | — | 21.3 | 0.06 | −2 | — | — | — |
| WYM7 | 71170.5 | — | — | — | — | — | — | 15.4 | 0.23 | −1 |
| WYM7 | 71170.3 | — | — | — | 21.5 | 0.18 | −1 | — | — | — |
| WYM106 | 71685.6 | — | — | — | — | — | — | 15.4 | 0.12 | −1 |
| WYM52 | 71463.6 | 812.5 | 0.14 | 7 | 21.0 | 0.13 | −4 | 14.7 | 0.14 | −5 |
| WYM17 | 71314.4 | 812.0 | 0.11 | 7 | 21.6 | 0.27 | −1 | 15.5 | 0.20 | 0 |
| CONT. | — | 762.2 | — | — | 21.8 | — | — | 15.6 | — | — |
| WYM52 | 71461.5 | — | — | — | 21.5 | 0.18 | −3 | 15.2 | 0.06 | −4 |
| WYM106 | 71687.3 | — | — | — | 21.8 | 0.22 | −2 | 15.6 | 0.26 | −1 |
| WYM52 | 71465.2 | — | — | — | 21.5 | 0.13 | −3 | 15.4 | 0.15 | −2 |
| WYM7 | 71170.2 | — | — | — | 21.9 | 0.28 | −1 | 15.4 | 0.12 | −3 |
| WYM110 | 71445.1 | 792.1 | 0.05 | 7 | 21.3 | 0.10 | −4 | 15.3 | 0.09 | −3 |
| WYM52 | 71465.4 | 767.3 | 0.19 | 3 | 21.7 | 0.19 | −3 | 15.5 | 0.20 | −2 |
| WYM44 | 71321.5 | 774.6 | 0.19 | 4 | 20.7 | 0.03 | −7 | 15.4 | 0.15 | −2 |
| WYM44 | 71317.8 | — | — | — | 21.7 | 0.21 | −2 | 15.5 | 0.20 | −2 |
| CONT. | — | 741.5 | — | — | 22.2 | — | — | 15.8 | — | — |
| WYM44 | 71322.6 | — | — | — | 22.4 | 0.10 | −3 | — | — | — |
| WYM26 | 71626.4 | 871.9 | 0.08 | 11 | 22.8 | 0.25 | −2 | — | — | — |
| WYM47 | 69684.3 | — | — | — | 21.9 | 0.03 | −5 | — | — | — |
| WYM110 | 71445.2 | — | — | — | 22.6 | 0.14 | −2 | — | — | — |

TABLE 55-continued

Genes showing improved plant performance at normal growth conditions under regulation of At6669 promoter

| Gene Name | Event # | Dry Weight [mg] | | | Flowering [days] | | | Inflorescence Emergence [days] | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 782.8 | — | — | 23.1 | — | — | 15.4 | — | — |
| WYM92 | 70001.1 | — | — | — | 19.6 | 0.11 | −4 | — | — | — |
| WYM60 | 69869.3 | 577.4 | 0.19 | 8 | 20.2 | 0.28 | −2 | 15.3 | 0.07 | −4 |
| WYM63 | 69984.3 | — | — | — | 19.8 | 0.16 | −3 | 15.4 | 0.17 | −4 |
| CONT. | — | 535.4 | — | — | 20.5 | — | — | 16.0 | — | — |
| WYM37 | 70944.7 | — | — | — | 19.8 | 0.16 | −2 | — | — | — |
| WYM57 | 69512.7 | — | — | — | 19.9 | 0.05 | −2 | — | — | — |
| WYM37 | 70942.4 | — | — | — | 20.1 | 0.19 | −1 | — | — | — |
| WYM27 | 69935.2 | — | — | — | 19.7 | 0.12 | −3 | — | — | — |
| WYM58 | 69959.3 | — | — | — | 20.0 | 0.13 | −2 | — | — | — |
| WYM63 | 69984.2 | — | — | — | 19.2 | 0.07 | −5 | — | — | — |
| WYM60 | 69870.2 | — | — | — | 19.9 | 0.24 | −2 | — | — | — |
| CONT. | — | 544.7 | — | — | 20.3 | — | — | 15.1 | — | — |
| WYM63 | 69982.4 | — | — | — | 17.8 | L | −10 | 14.1 | 0.14 | −1 |
| WYM27 | 69936.2 | — | — | — | 18.5 | 0.01 | −6 | 14.1 | 0.20 | −1 |
| WYM51 | 69954.2 | — | — | — | 18.9 | 0.02 | −4 | 14.0 | 0.09 | −2 |
| WYM92 | 70003.1 | 553.8 | 0.22 | 5 | 19.0 | 0.18 | −3 | — | — | — |
| LYM90 | 69389.5 | — | — | — | 18.1 | L | −8 | 14.1 | 0.20 | −1 |
| WYM60 | 69870.8 | — | — | — | 19.2 | 0.10 | −2 | — | — | — |
| WYM51 | 69950.5 | — | — | — | 18.0 | L | −9 | 14.0 | 0.09 | −2 |
| WYM27 | 69937.5 | — | — | — | 19.4 | 0.23 | −2 | — | — | — |
| CONT. | — | 529.7 | — | — | 19.7 | — | — | 14.3 | — | — |
| WYM60 | 69869.2 | — | — | — | 19.9 | 0.14 | −3 | — | — | — |
| WYM58 | 69960.2 | 674.2 | 0.30 | 4 | 19.9 | 0.13 | −3 | — | — | — |
| WYM51 | 69950.1 | — | — | — | 19.6 | 0.07 | −5 | 14.9 | 0.12 | −8 |
| WYM92 | 70000.5 | — | — | — | 19.6 | 0.14 | −4 | 15.2 | 0.11 | −7 |
| WYM58 | 69961.10 | — | — | — | 20.1 | 0.19 | −2 | 15.5 | 0.13 | −5 |
| WYM63 | 69983.2 | — | — | — | 20.0 | 0.17 | −3 | — | — | — |
| WYM63 | 69980.3 | — | — | — | — | — | — | 15.5 | 0.22 | −5 |
| CONT. | — | 650.7 | — | — | 20.6 | — | — | 16.3 | — | — |
| WYM92 | 69998.2 | — | — | — | — | — | — | 15.9 | 0.20 | −3 |
| LYM90 | 69389.1 | 618.8 | 0.26 | 3 | — | — | — | — | — | — |
| WYM63 | 69982.1 | 625.2 | 0.12 | 4 | 19.3 | 0.02 | −7 | 14.9 | 0.02 | −9 |
| WYM37 | 70942.3 | 615.4 | 0.25 | 2 | — | — | — | — | — | — |
| WYM63 | 69984.6 | — | — | — | 20.0 | L | −4 | 15.7 | 0.01 | −4 |
| WYM51 | 69953.4 | — | — | — | 20.4 | 0.17 | −2 | — | — | — |
| WYM60 | 69868.3 | — | — | — | 20.1 | L | −4 | 15.8 | 0.08 | −3 |
| WYM66 | 70175.3 | — | — | — | 20.1 | L | −4 | 16.2 | 0.26 | −1 |
| CONT. | — | 600.7 | — | — | 20.9 | — | — | 16.3 | — | — |
| WYM37 | 70942.6 | 670.1 | 0.06 | 13 | 20.2 | 0.08 | −2 | — | — | — |
| WYM57 | 69514.2 | 666.7 | 0.05 | 12 | 18.1 | L | −12 | 14.0 | L | −13 |
| WYM66 | 70176.2 | 656.3 | 0.05 | 10 | 19.7 | 0.07 | −4 | 14.5 | 0.04 | −10 |
| WYM92 | 70000.3 | 633.4 | 0.12 | 7 | 18.8 | L | −9 | 14.6 | 0.04 | −10 |
| WYM60 | 69867.2 | 730.0 | L | 23 | — | — | — | — | — | — |
| WYM60 | 69870.3 | — | — | — | 19.3 | 0.06 | −6 | 14.7 | 0.04 | −9 |
| WYM33 | 69938.11 | — | — | — | 20.0 | 0.11 | −3 | — | — | — |
| CONT. | — | 594.1 | — | — | 20.6 | — | — | 16.2 | — | — |
| WYM57 | 69517.1 | 680.8 | 0.04 | 15 | 20.2 | 0.12 | −2 | 14.5 | 0.04 | −11 |
| WYM60 | 69868.5 | 643.0 | 0.02 | 9 | — | — | — | 16.1 | 0.15 | −1 |
| WYM58 | 69961.9 | 641.8 | 0.13 | 9 | 20.3 | 0.12 | −1 | 15.2 | 0.13 | −6 |
| WYM27 | 69935.9 | 615.4 | 0.17 | 4 | 20.2 | 0.08 | −2 | 15.8 | 0.10 | −3 |
| WYM66 | 70174.4 | — | — | — | — | — | — | 15.3 | 0.14 | −6 |
| WYM33 | 69942.2 | 640.4 | 0.12 | 8 | — | — | — | 15.6 | L | −4 |
| WYM33 | 69942.1 | 678.4 | 0.02 | 15 | 20.2 | 0.08 | −2 | 14.4 | L | −12 |
| WYM57 | 69515.4 | 618.0 | 0.23 | 5 | 18.5 | L | −10 | 14.0 | L | −14 |
| CONT. | — | 591.1 | — | — | 20.6 | — | — | 16.3 | — | — |
| WYM57 | 69514.3 | 667.9 | 0.19 | 6 | 19.7 | 0.06 | −4 | 15.6 | 0.20 | −4 |
| WYM57 | 69513.3 | 696.7 | 0.06 | 10 | 19.3 | 0.04 | −6 | 14.4 | L | −11 |
| LYM90 | 69388.2 | 677.9 | 0.21 | 7 | — | — | — | 15.4 | 0.09 | −5 |
| WYM60 | 69867.3 | 675.9 | 0.12 | 7 | 20.1 | 0.12 | −2 | 15.3 | 0.11 | −6 |
| WYM37 | 70939.4 | — | — | — | 20.3 | 0.24 | −1 | — | — | — |
| CONT. | — | 632.2 | — | — | 20.5 | — | — | 16.2 | — | — |
| WYM37 | 70942.5 | 669.2 | L | 9 | — | — | — | — | — | — |
| WYM33 | 69938.6 | 685.2 | 0.02 | 12 | — | — | — | — | — | — |
| WYM58 | 69959.5 | 635.0 | 0.23 | 3 | — | — | — | — | — | — |
| WYM58 | 69960.7 | 627.9 | 0.21 | 2 | 19.3 | L | −6 | 14.9 | 0.12 | −6 |
| WYM57 | 69515.1 | — | — | — | 20.4 | 0.20 | −1 | — | — | — |
| WYM27 | 69935.4 | 654.1 | 0.12 | 7 | 20.3 | 0.09 | −1 | — | — | — |
| CONT. | — | 614.1 | — | — | 20.5 | — | — | 15.9 | — | — |
| WYM66 | 70174.3 | — | — | — | 19.6 | 0.02 | −4 | — | — | — |
| WYM33 | 69943.2 | — | — | — | — | — | — | 15.2 | 0.05 | −4 |

TABLE 55-continued

Genes showing improved plant performance at normal growth conditions under regulation of At6669 promoter

| | | Dry Weight [mg] | | | Flowering [days] | | | Inflorescence Emergence [days] | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LYM90 | 69388.5 | 661.3 | 0.13 | 10 | 20.3 | 0.29 | −1 | 15.0 | L | −5 |
| WYM58 | 69960.3 | — | — | — | 19.7 | 0.08 | −3 | — | — | — |
| CONT. | — | 601.2 | — | — | 20.4 | — | — | 15.8 | — | — |
| WYM33 | 69938.7 | — | — | — | 20.2 | 0.04 | −2 | — | — | — |
| WYM92 | 69999.2 | — | — | — | 20.3 | 0.13 | −2 | — | — | — |
| LYM90 | 69389.3 | 578.3 | 0.27 | 3 | — | — | — | — | — | — |
| CONT. | — | 563.8 | — | — | 20.7 | — | — | 15.5 | — | — |
| LYM90 | 69386.2 | — | — | — | 19.7 | L | −3 | 15.0 | 0.21 | −3 |
| LYM90 | 69386.3 | — | — | — | 20.0 | 0.23 | −2 | 14.7 | 0.15 | −5 |
| WYM27 | 69936.1 | — | — | — | 19.1 | 0.06 | −6 | 14.7 | 0.19 | −5 |
| LYM90 | 69388.4 | — | — | — | 19.8 | 0.04 | −3 | 14.6 | 0.13 | −6 |
| WYM33 | 69939.1 | — | — | — | 20.2 | 0.25 | −1 | 14.9 | 0.24 | −4 |
| WYM66 | 70175.4 | 613.4 | 0.16 | 4 | 19.2 | 0.06 | −6 | 14.0 | 0.03 | −9 |
| CONT. | — | 589.0 | — | — | 20.4 | — | — | 15.5 | — | — |
| WYM60 | 69870.5 | 631.3 | 0.03 | 4 | 19.3 | 0.01 | −6 | 14.1 | 0.14 | −3 |
| WYM51 | 69954.4 | — | — | — | 19.3 | 0.02 | −6 | 14.1 | 0.14 | −3 |
| WYM66 | 70176.1 | — | — | — | 20.2 | 0.12 | −2 | — | — | — |
| WYM58 | 69961.3 | — | — | — | 20.0 | 0.08 | −3 | 14.0 | 0.10 | −4 |
| WYM58 | 69960.1 | — | — | — | 20.3 | 0.27 | −1 | — | — | — |
| CONT. | — | 609.6 | — | — | 20.5 | — | — | 14.6 | — | — |
| WYM58 | 69961.7 | — | — | — | 19.1 | 0.13 | −3 | — | — | — |
| WYM92 | 70000.4 | — | — | — | 18.4 | L | −7 | — | — | — |
| WYM51 | 69954.7 | — | — | — | 17.8 | L | −10 | 14.0 | 0.08 | −7 |
| WYM57 | 69513.2 | — | — | — | 18.2 | 0.02 | −8 | 14.0 | 0.08 | −7 |
| WYM66 | 70175.2 | — | — | — | 18.8 | 0.02 | −5 | 14.0 | 0.08 | −7 |
| WYM66 | 70173.1 | — | — | — | 18.4 | 0.01 | −7 | — | — | — |
| CONT. | — | 609.2 | — | — | 19.7 | — | — | 15.0 | — | — |
| WYM108 | 69633.1 | 764.7 | 0.02 | 18 | — | — | — | — | — | — |
| WYM4 | 69736.6 | 679.4 | 0.13 | 5 | — | — | — | — | — | — |
| WYM13 | 69646.1 | 716.7 | 0.01 | 11 | 18.4 | 0.02 | −11 | — | — | — |
| WYM98 | 70008.2 | 666.3 | 0.14 | 3 | 20.1 | 0.13 | −3 | — | — | — |
| LNU74_H109 | 69484.1 | 698.2 | 0.03 | 8 | 19.3 | L | −7 | — | — | — |
| WYM13 | 69647.3 | 691.3 | 0.02 | 7 | — | — | — | — | — | — |
| WYM99 | 70020.4 | 686.3 | 0.12 | 6 | 20.3 | 0.29 | −2 | — | — | — |
| CONT. | — | 648.5 | — | — | 20.8 | — | — | 15.0 | — | — |
| WYM108 | 69635.1 | — | — | — | — | — | — | 15.0 | 0.20 | 0 |
| WYM84 | 69860.1 | 678.0 | 0.17 | 7 | 20.0 | 0.18 | −2 | 15.0 | 0.20 | 0 |
| WYM11 | 69639.7 | 683.8 | 0.18 | 8 | — | — | — | — | — | — |
| WYM101 | 69715.3 | 680.0 | 0.18 | 8 | — | — | — | 15.0 | 0.20 | 0 |
| WYM11 | 69642.2 | 681.3 | 0.16 | 8 | — | — | — | 15.0 | 0.20 | 0 |
| WYM84 | 69865.2 | — | — | — | 19.7 | 0.08 | −4 | 15.0 | 0.20 | 0 |
| LNU74_H109 | 69485.3 | 760.0 | 0.02 | 20 | — | — | — | 15.0 | 0.20 | 0 |
| WYM11 | 69639.9 | 670.0 | 0.22 | 6 | 19.8 | 0.11 | −3 | 15.0 | 0.20 | 0 |
| CONT. | — | 632.5 | — | — | 20.4 | — | — | 15.0 | — | — |
| WYM99 | 70020.3 | — | — | — | 20.6 | 0.07 | −5 | — | — | — |
| WYM99 | 70016.3 | — | — | — | 20.5 | 0.12 | −5 | — | — | — |
| WYM109 | 69717.3 | — | — | — | 20.1 | 0.07 | −7 | — | — | — |
| WYM108 | 69634.1 | — | — | — | 20.4 | 0.06 | −5 | — | — | — |
| WYM84 | 69864.5 | — | — | — | 21.0 | 0.17 | −3 | — | — | — |
| CONT. | — | 700.0 | — | — | 21.6 | — | — | 15.0 | — | — |
| WYM98 | 70009.1 | — | — | — | 20.2 | 0.14 | −2 | — | — | — |
| WYM4 | 69737.3 | — | — | — | 20.3 | 0.26 | −1 | — | — | — |
| WYM99 | 70016.10 | 771.6 | 0.15 | 7 | — | — | — | — | — | — |
| CONT. | — | 722.2 | — | — | 20.6 | — | — | 15.0 | — | — |
| WYM109 | 69720.7 | 781.7 | 0.06 | 11 | 20.8 | 0.16 | −3 | — | — | — |
| LNU74_H109 | 69485.1 | — | — | — | 20.2 | 0.02 | −6 | — | — | — |
| WYM11 | 69640.1 | — | — | — | 20.7 | 0.10 | −3 | — | — | — |
| CONT. | — | 701.5 | — | — | 21.4 | — | — | 15.0 | — | — |
| WYM4 | 69734.2 | — | — | — | 19.9 | 0.05 | −4 | — | — | — |
| WYM4 | 69736.3 | — | — | — | 20.0 | 0.05 | −4 | — | — | — |
| WYM100 | 69872.5 | 771.7 | 0.22 | 5 | 20.0 | 0.06 | −3 | — | — | — |
| WYM13 | 69646.2 | — | — | — | 20.2 | 0.20 | −3 | — | — | — |
| WYM13 | 69645.2 | 760.9 | 0.28 | 4 | 19.7 | 0.02 | −5 | — | — | — |
| WYM99 | 70016.8 | — | — | — | 19.4 | L | −6 | — | — | — |
| WYM109 | 69716.3 | — | — | — | 20.3 | 0.20 | −2 | — | — | — |
| WYM109 | 69720.6 | — | — | — | 19.8 | 0.03 | −5 | — | — | — |
| CONT. | — | 734.7 | — | — | 20.7 | — | — | 15.0 | — | — |
| WYM109 | 69716.1 | — | — | — | 19.9 | 0.02 | −5 | — | — | — |
| WYM4 | 69735.3 | — | — | — | 19.8 | 0.01 | −6 | — | — | — |
| WYM101 | 69710.2 | 704.2 | 0.12 | 12 | 20.2 | 0.07 | −4 | — | — | — |
| LNU74_H109 | 69483.3 | 704.6 | L | 12 | 19.5 | 0.07 | −7 | — | — | — |

TABLE 55-continued

Genes showing improved plant performance at normal growth conditions under regulation of At6669 promoter

| Gene Name | Event # | Dry Weight [mg] | | | Flowering [days] | | | Inflorescence Emergence [days] | | |
|---|---|---|---|---|---|---|---|---|---|---|
| | | Ave. | P-Val. | % Incr. | Ave. | P-Val. | % Incr. | Ave. | P-Val. | % Incr. |
| WYM108 | 69636.5 | — | — | — | 20.1 | 0.03 | −4 | — | — | — |
| WYM101 | 69712.2 | — | — | — | 20.5 | 0.21 | −2 | — | — | — |
| WYM4 | 69736.1 | — | — | — | 20.0 | 0.03 | −5 | — | — | — |
| WYM98 | 70008.3 | — | — | — | 19.5 | L | −7 | — | — | — |
| CONT. | — | 626.6 | — | — | 21.0 | — | — | 15.0 | — | — |
| WYM11 | 69641.1 | — | — | — | 20.3 | 0.08 | −3 | — | — | — |
| WYM98 | 70009.3 | — | — | — | 19.6 | 0.02 | −6 | — | — | — |
| WYM13 | 69647.7 | 728.3 | 0.27 | 4 | — | — | — | — | — | — |
| CONT. | — | 700.1 | — | — | 21.0 | — | — | 15.0 | — | — |
| WYM13 | 69647.9 | 693.4 | 0.22 | 4 | 20.3 | 0.18 | −3 | — | — | — |
| WYM13 | 69644.2 | — | — | — | 20.4 | 0.19 | −3 | — | — | — |
| WYM98 | 70008.1 | — | — | — | 20.0 | 0.04 | −5 | — | — | — |
| WYM101 | 69715.5 | 732.5 | 0.06 | 10 | 19.8 | 0.02 | −6 | — | — | — |
| WYM98 | 70005.3 | — | — | — | 19.9 | 0.03 | −5 | — | — | — |
| CONT. | — | 663.8 | — | — | 21.0 | — | — | 15.0 | — | — |
| WYM11 | 69641.2 | — | — | — | 21.0 | 0.11 | −3 | — | — | — |
| WYM98 | 70005.2 | — | — | — | 20.3 | 0.02 | −6 | — | — | — |
| LNU74_H109 | 69483.4 | 732.5 | 0.26 | 4 | 19.9 | L | −8 | — | — | — |
| CONT. | — | 707.6 | — | — | 21.6 | — | — | 15.0 | — | — |
| LNU74_H109 | 69482.1 | 703.8 | 0.16 | 3 | — | — | — | — | — | — |
| LNU74_H109 | 69482.2 | — | — | — | 21.2 | 0.15 | −2 | — | — | — |
| WYM98 | 70008.4 | — | — | — | 21.0 | 0.16 | −3 | — | — | — |
| CONT. | — | 682.5 | — | — | 21.7 | — | — | 15.0 | — | — |
| WYM100 | 69876.2 | 712.1 | 0.13 | 4 | — | — | — | — | — | — |
| WYM13 | 69645.5 | — | — | — | 20.9 | 0.22 | −2 | — | — | — |
| WYM13 | 69647.1 | 732.5 | 0.03 | 7 | 21.0 | 0.22 | −1 | — | — | — |
| CONT. | — | 681.7 | — | — | 21.3 | — | — | 15.0 | — | — |
| WYM99 | 70016.9 | 726.4 | 0.27 | 5 | 21.3 | 0.07 | −2 | — | — | — |
| WYM13 | 69647.4 | — | — | — | 20.0 | 0.05 | −8 | — | — | — |
| WYM109 | 69719.2 | — | — | — | 21.0 | 0.14 | −3 | — | — | — |
| WYM101 | 69715.2 | — | — | — | 21.4 | 0.19 | −1 | — | — | — |
| WYM11 | 69638.1 | — | — | — | 21.0 | 0.02 | −3 | — | — | — |
| WYM99 | 70016.2 | — | — | — | 21.3 | 0.17 | −1 | — | — | — |
| WYM84 | 69864.1 | — | — | — | 21.3 | 0.15 | −2 | — | — | — |
| CONT. | — | 692.9 | — | — | 21.7 | — | — | 15.0 | — | — |
| WYM99 | 70017.4 | — | — | — | 19.6 | 0.03 | −6 | — | — | — |
| WYM108 | 69633.3 | — | — | — | 20.6 | 0.28 | −1 | — | — | — |
| CONT. | — | 717.5 | — | — | 20.9 | — | — | 15.0 | — | — |

Table 55. "CONT"—Control;
"Ave."—Average;
"% Incr." = % increment;
"p-val."—p-value,
L—p < 0.01.

TABLE 56

Genes showing improved plant performance at normal growth conditions under regulation of At6669 promoter

| Gene Name | Event # | Leaf Blade Area [cm²] | | | Leaf Number | | |
|---|---|---|---|---|---|---|---|
| | | Ave. | P-Val. | % Incr. | Ave. | P-Val. | % Incr. |
| WYM7 | 71168.1 | 1.2 | 0.06 | 13 | 11.3 | 0.03 | 7 |
| WYM17 | 71315.1 | 1.2 | 0.02 | 10 | 10.7 | 0.24 | 2 |
| WYM106 | 71687.6 | 1.1 | 0.15 | 6 | 11.2 | 0.02 | 6 |
| WYM52 | 71461.2 | 1.1 | 0.06 | 8 | — | — | — |
| WYM77 | 70947.1 | 1.1 | 0.24 | 5 | — | — | — |
| WYM106 | 71685.3 | 1.2 | 0.02 | 17 | 11.0 | 0.04 | 5 |
| CONT. | — | 1.1 | — | — | 10.5 | — | — |
| WYM47 | 69683.5 | 1.1 | 0.04 | 11 | — | — | — |
| CONT. | — | 1.0 | — | — | 10.3 | — | — |
| WYM26 | 71627.6 | 1.0 | 0.29 | 4 | — | — | — |
| CONT. | — | 1.0 | — | — | 10.3 | — | — |
| WYM17 | 71315.2 | — | — | — | 11.6 | L | 4 |
| WYM7 | 71169.7 | — | — | — | 11.5 | 0.11 | 3 |
| WYM77 | 70946.7 | — | — | — | 11.4 | 0.16 | 2 |
| WYM7 | 71170.1 | — | — | — | 11.4 | 0.28 | 3 |
| WYM95 | 70181.2 | 1.5 | 0.29 | 6 | — | — | — |
| CONT. | — | 1.4 | — | — | 11.1 | — | — |
| WYM95 | 70178.1 | — | — | — | 10.2 | 0.26 | 1 |
| CONT. | — | 1.0 | — | — | 10.1 | — | — |
| WYM106 | 71684.4 | 1.0 | 0.21 | 6 | — | — | — |
| WYM110 | 71442.5 | 1.1 | 0.03 | 24 | 11.1 | 0.03 | 15 |
| WYM47 | 69681.4 | 1.0 | 0.12 | 13 | 10.0 | 0.12 | 4 |
| WYM26 | 71627.4 | 1.0 | 0.27 | 7 | — | — | — |
| WYM26 | 71626.6 | 1.0 | 0.27 | 6 | 9.8 | 0.25 | 2 |
| WYM110 | 71445.5 | 1.0 | 0.15 | 8 | — | — | — |
| WYM106 | 71687.1 | 1.0 | 0.14 | 8 | — | — | — |

TABLE 56-continued

Genes showing improved plant performance at normal growth conditions under regulation of At6669 promoter

| Gene Name | Event # | Leaf Blade Area [cm²] | | | Leaf Number | | |
|---|---|---|---|---|---|---|---|
| | | Ave. | P-Val. | % Incr. | Ave. | P-Val. | % Incr. |
| CONT. | — | 0.9 | — | — | 9.6 | — | — |
| WYM52 | 71463.4 | 1.2 | 0.05 | 21 | 10.8 | 0.17 | 6 |
| WYM110 | 71445.6 | 1.2 | 0.09 | 14 | 11.3 | L | 10 |
| WYM44 | 71321.3 | 1.3 | 0.03 | 25 | 10.8 | L | 6 |
| WYM77 | 70948.2 | 1.2 | 0.07 | 20 | 11.2 | 0.06 | 10 |
| WYM26 | 71623.2 | 1.3 | 0.02 | 25 | 11.0 | L | 8 |
| WYM80 | 69994.2 | 1.3 | 0.01 | 32 | 11.3 | L | 11 |
| WYM110 | 71443.6 | 1.2 | 0.08 | 16 | 10.7 | 0.18 | 5 |
| WYM17 | 71313.6 | 1.2 | 0.09 | 15 | 10.8 | L | 6 |
| CONT. | — | 1.0 | — | — | 10.2 | — | — |
| WYM47 | 69685.1 | 1.1 | 0.23 | 7 | 10.3 | 0.28 | 3 |
| WYM95 | 70183.2 | — | — | — | 10.2 | 0.24 | 2 |
| WYM47 | 69683.3 | 1.1 | 0.28 | 4 | 10.3 | 0.25 | 4 |
| WYM95 | 70181.3 | — | — | — | 10.2 | 0.21 | 3 |
| WYM80 | 69994.4 | 1.1 | 0.16 | 9 | 10.8 | L | 9 |
| WYM26 | 71622.3 | — | — | — | 10.5 | 0.13 | 6 |
| CONT. | — | 1.0 | — | — | 9.9 | — | — |
| WYM26 | 71626.1 | 1.3 | 0.27 | 4 | 11.2 | 0.14 | 4 |
| WYM52 | 71465.5 | 1.3 | 0.11 | 8 | 11.3 | 0.12 | 5 |
| CONT. | — | 1.2 | — | — | 10.8 | — | — |
| WYM7 | 71169.2 | 1.3 | 0.10 | 13 | 11.4 | 0.22 | 3 |
| CONT. | — | 1.2 | — | — | 11.1 | — | — |
| WYM26 | 71626.2 | — | — | — | 10.8 | 0.19 | 3 |
| WYM77 | 70948.5 | — | — | — | 11.0 | 0.13 | 5 |
| WYM17 | 71315.4 | 1.2 | 0.23 | 7 | 10.7 | 0.24 | 2 |
| CONT. | — | 1.1 | — | — | 10.5 | — | — |
| WYM7 | 71170.3 | 1.2 | 0.16 | 11 | 10.8 | 0.20 | 2 |
| WYM106 | 71685.6 | 1.2 | 0.30 | 6 | — | — | — |
| WYM52 | 71463.6 | 1.3 | 0.19 | 13 | — | — | — |
| CONT. | — | 1.1 | — | — | 10.6 | — | — |
| WYM52 | 71461.5 | 1.1 | 0.18 | 10 | 10.4 | 0.26 | 4 |
| WYM106 | 71687.3 | 1.2 | 0.02 | 17 | 11.2 | 0.01 | 11 |
| WYM52 | 71465.2 | 1.1 | 0.18 | 6 | 11.2 | 0.03 | 11 |
| WYM7 | 71170.2 | 1.1 | 0.29 | 8 | — | — | — |
| WYM110 | 71445.1 | 1.2 | 0.02 | 20 | 10.7 | 0.05 | 6 |
| WYM52 | 71465.4 | 1.2 | 0.07 | 11 | 10.7 | 0.06 | 6 |
| WYM44 | 71321.5 | 1.4 | L | 32 | 11.0 | 0.02 | 9 |
| WYM44 | 71317.8 | 1.1 | 0.12 | 11 | 10.5 | 0.17 | 4 |
| CONT. | — | 1.0 | — | — | 10.1 | — | — |
| WYM44 | 71322.6 | 1.3 | 0.28 | 6 | — | — | — |
| WYM26 | 71626.4 | 1.3 | 0.08 | 11 | 11.3 | 0.11 | 7 |
| WYM47 | 69684.3 | 1.3 | 0.09 | 12 | 11.4 | 0.03 | 8 |
| CONT. | — | 1.2 | — | — | 10.6 | — | — |
| WYM92 | 70001.1 | 1.3 | 0.15 | 11 | — | — | — |
| WYM63 | 69983.1 | — | — | — | 10.3 | 0.08 | 2 |
| WYM60 | 69869.3 | 1.2 | 0.26 | 7 | 10.2 | 0.18 | 1 |
| WYM63 | 69982.7 | — | — | — | 10.3 | 0.08 | 2 |
| CONT. | — | 1.1 | — | — | 10.1 | — | — |
| WYM37 | 70944.7 | 1.3 | 0.11 | 12 | 10.6 | 0.01 | 7 |
| WYM57 | 69512.7 | 1.2 | 0.14 | 9 | 10.5 | 0.06 | 5 |
| WYM37 | 70942.4 | 1.3 | 0.04 | 16 | 10.9 | 0.02 | 10 |
| WYM27 | 69935.2 | 1.3 | 0.12 | 10 | 10.3 | 0.13 | 4 |
| WYM58 | 69959.3 | 1.2 | 0.26 | 5 | 10.5 | 0.22 | 6 |
| WYM63 | 69984.2 | 1.2 | 0.16 | 8 | 10.6 | 0.20 | 6 |
| WYM60 | 69870.2 | — | — | — | 10.3 | 0.05 | 4 |
| CONT. | — | 1.1 | — | — | 9.9 | — | — |
| WYM63 | 69982.4 | 1.5 | L | 35 | 10.6 | 0.17 | 5 |
| WYM27 | 69936.2 | 1.3 | L | 12 | 11.3 | L | 11 |
| WYM51 | 69954.2 | 1.3 | 0.07 | 14 | 10.9 | 0.01 | 7 |
| WYM92 | 70003.1 | 1.4 | L | 18 | 10.6 | 0.14 | 5 |
| LYM90 | 69389.5 | 1.3 | L | 16 | 11.0 | L | 9 |
| WYM60 | 69870.8 | 1.4 | L | 25 | — | — | — |
| WYM51 | 69950.5 | 1.3 | 0.08 | 9 | 10.7 | 0.21 | 5 |
| WYM27 | 69937.5 | 1.3 | 0.04 | 9 | 10.8 | 0.02 | 6 |
| CONT. | — | 1.2 | — | — | 10.1 | — | — |
| WYM51 | 69950.1 | 1.3 | 0.09 | 13 | 11.4 | 0.08 | 7 |
| CONT. | — | 1.2 | — | — | 10.7 | — | — |
| WYM92 | 69998.2 | 1.1 | 0.20 | 6 | 10.4 | 0.03 | 5 |
| WYM63 | 69982.1 | 1.3 | L | 18 | 10.9 | 0.04 | 10 |
| WYM37 | 70942.3 | 1.1 | 0.24 | 6 | — | — | — |
| WYM63 | 69984.6 | — | — | — | 10.2 | 0.20 | 3 |
| WYM60 | 69868.3 | 1.2 | 0.06 | 8 | 10.7 | L | 8 |
| WYM66 | 70175.3 | 1.2 | 0.23 | 8 | 10.3 | 0.06 | 4 |
| CONT. | — | 1.1 | — | — | 9.9 | — | — |
| WYM37 | 70942.6 | 1.6 | 0.04 | 26 | 11.3 | 0.02 | 7 |
| WYM57 | 69514.2 | 1.8 | L | 44 | 10.9 | 0.26 | 2 |
| WYM66 | 70176.2 | 1.6 | 0.02 | 24 | 11.2 | 0.05 | 5 |
| WYM92 | 70000.3 | 1.7 | 0.01 | 35 | 11.1 | 0.05 | 4 |
| WYM60 | 69867.2 | 1.8 | L | 38 | 11.6 | 0.02 | 9 |
| WYM60 | 69870.3 | 1.5 | 0.09 | 19 | 11.5 | 0.07 | 8 |
| WYM33 | 69938.11 | — | — | — | 10.9 | 0.27 | 2 |
| WYM66 | 70174.1 | 1.5 | 0.07 | 16 | 11.1 | 0.22 | 4 |
| CONT. | — | 1.3 | — | — | 10.6 | — | — |
| WYM57 | 69517.1 | 1.6 | L | 28 | 10.9 | 0.27 | 3 |
| WYM60 | 69868.5 | 1.6 | L | 26 | 11.1 | 0.16 | 5 |
| WYM58 | 69961.9 | 1.5 | 0.05 | 18 | 11.4 | 0.15 | 7 |
| WYM27 | 69935.9 | 1.5 | 0.04 | 19 | 11.1 | 0.11 | 5 |
| WYM66 | 70174.4 | 1.6 | 0.03 | 27 | 11.2 | 0.05 | 6 |
| WYM33 | 69942.2 | 1.5 | L | 17 | — | — | — |
| WYM33 | 69942.1 | 1.6 | 0.05 | 21 | 11.8 | L | 12 |
| WYM57 | 69515.4 | 1.8 | L | 41 | 10.9 | 0.29 | 3 |
| CONT. | — | 1.3 | — | — | 10.6 | — | — |
| WYM57 | 69514.3 | 1.3 | 0.12 | 17 | — | — | — |
| WYM57 | 69513.3 | 1.3 | 0.03 | 20 | — | — | — |
| LYM90 | 69388.2 | 1.4 | 0.03 | 26 | — | — | — |
| WYM51 | 69954.1 | 1.2 | 0.27 | 5 | — | — | — |
| WYM60 | 69867.3 | 1.3 | 0.05 | 18 | — | — | — |
| WYM27 | 69937.1 | 1.2 | 0.25 | 8 | — | — | — |
| LYM90 | 69389.6 | 1.2 | 0.27 | 5 | — | — | — |
| CONT. | — | 1.1 | — | — | 10.8 | — | — |
| WYM37 | 70942.5 | 1.5 | 0.03 | 18 | 11.2 | L | 8 |
| WYM58 | 69960.7 | 1.5 | 0.06 | 17 | 11.0 | L | 6 |
| WYM57 | 69515.1 | 1.3 | 0.24 | 6 | 10.6 | 0.04 | 3 |
| WYM27 | 69935.4 | — | — | — | 10.6 | 0.15 | 2 |
| CONT. | — | 1.3 | — | — | 10.3 | — | — |
| WYM92 | 70000.9 | — | — | — | 10.8 | 0.06 | 4 |
| WYM66 | 70174.3 | 1.4 | 0.26 | 6 | — | — | — |
| WYM33 | 69943.2 | — | — | — | 10.8 | 0.13 | 4 |
| LYM90 | 69388.5 | 1.6 | 0.04 | 18 | 11.0 | 0.17 | 6 |
| WYM51 | 69950.3 | 1.4 | 0.28 | 5 | 11.0 | 0.06 | 6 |
| CONT. | — | 1.3 | — | — | 10.4 | — | — |
| WYM66 | 70177.7 | — | — | — | 10.8 | 0.10 | 5 |
| CONT. | — | 1.2 | — | — | 10.3 | — | — |
| LYM90 | 69386.3 | 1.5 | 0.06 | 18 | — | — | — |
| LYM90 | 69388.4 | 1.4 | 0.13 | 11 | 11.3 | 0.28 | 1 |
| WYM66 | 70175.4 | 1.4 | 0.26 | 9 | — | — | — |
| CONT. | — | 1.3 | — | — | 11.1 | — | — |
| WYM92 | 70003.2 | — | — | — | 11.2 | 0.08 | 5 |
| WYM60 | 69870.5 | 1.5 | 0.10 | 11 | — | — | — |
| LYM90 | 69390.2 | — | — | — | 10.9 | 0.25 | 3 |
| WYM58 | 69961.3 | 1.4 | 0.22 | 6 | 11.0 | 0.22 | 4 |
| CONT. | — | 1.4 | — | — | 10.6 | — | — |
| WYM51 | 69953.5 | — | — | — | 10.4 | 0.21 | 2 |
| WYM58 | 69961.7 | 1.2 | 0.22 | 9 | 10.8 | 0.11 | 5 |
| WYM92 | 70000.4 | 1.2 | 0.19 | 8 | — | — | — |
| WYM51 | 69954.7 | 1.2 | 0.25 | 5 | 11.3 | L | 11 |
| WYM57 | 69513.2 | 1.2 | 0.13 | 8 | — | — | — |
| WYM37 | 70944.2 | 1.2 | 0.22 | 7 | — | — | — |
| WYM66 | 70175.2 | 1.2 | 0.20 | 6 | 11.1 | 0.03 | 8 |
| WYM66 | 70173.1 | 1.3 | 0.07 | 15 | 11.2 | 0.09 | 9 |
| CONT. | — | 1.1 | — | — | 10.3 | — | — |
| WYM108 | 69633.1 | 1.0 | 0.05 | 5 | 9.6 | 0.29 | 3 |
| WYM4 | 69736.6 | — | — | — | 9.6 | 0.19 | 3 |
| WYM13 | 69646.1 | 1.2 | L | 25 | 10.1 | 0.05 | 9 |
| WYM98 | 70008.2 | 1.1 | 0.01 | 11 | 9.8 | 0.06 | 5 |
| LNU74_H109 | 69484.1 | 1.0 | 0.04 | 7 | 9.7 | 0.09 | 4 |
| WYM99 | 70020.4 | 1.0 | 0.17 | 7 | 9.6 | 0.23 | 3 |
| CONT. | — | 1.0 | — | — | 9.3 | — | — |
| WYM108 | 69635.1 | 1.1 | 0.08 | 10 | — | — | — |
| WYM84 | 69860.1 | 1.2 | 0.02 | 15 | 10.0 | 0.18 | 5 |
| WYM101 | 69715.3 | 1.0 | 0.21 | 4 | — | — | — |
| WYM11 | 69642.2 | 1.1 | 0.08 | 11 | — | — | — |

TABLE 56-continued

Genes showing improved plant performance at normal growth conditions under regulation of At6669 promoter

| Gene Name | Event # | Leaf Blade Area [cm²] | | | Leaf Number | | |
|---|---|---|---|---|---|---|---|
| | | Ave. | P-Val. | % Incr. | Ave. | P-Val. | % Incr. |
| WYM84 | 69865.2 | 1.2 | 0.04 | 17 | 9.8 | 0.25 | 3 |
| LNU74_H109 | 69485.3 | 1.1 | 0.07 | 8 | — | — | — |
| WYM11 | 69639.9 | 1.3 | L | 31 | 10.3 | 0.07 | 8 |
| CONT. | — | 1.0 | — | — | 9.5 | — | — |
| WYM99 | 70020.3 | 1.0 | 0.02 | 14 | 9.5 | 0.20 | 2 |
| WYM99 | 70016.3 | 1.0 | L | 13 | 9.8 | 0.03 | 5 |
| WYM11 | 69640.3 | 1.0 | 0.29 | 4 | 9.5 | 0.27 | 2 |
| WYM101 | 69712.3 | 1.0 | 0.05 | 7 | 9.5 | 0.18 | 2 |
| WYM109 | 69717.3 | 1.1 | 0.05 | 19 | 9.8 | 0.03 | 5 |
| WYM84 | 69862.1 | — | — | — | 9.7 | 0.05 | 4 |
| WYM108 | 69634.1 | 1.0 | L | 11 | 9.7 | 0.08 | 4 |
| WYM84 | 69864.5 | 1.0 | L | 10 | — | — | — |
| CONT. | — | 0.9 | — | — | 9.3 | — | — |
| WYM11 | 69641.3 | 1.4 | 0.23 | 6 | — | — | — |
| WYM98 | 70009.1 | — | — | — | 10.8 | L | 15 |
| WYM4 | 69737.3 | — | — | — | 9.8 | 0.17 | 5 |
| LNU74_H109 | 69487.1 | — | — | — | 10.5 | 0.09 | 12 |
| WYM100 | 69873.2 | 1.4 | 0.29 | 6 | 10.3 | 0.03 | 10 |
| WYM101 | 69713.5 | — | — | — | 9.6 | 0.29 | 3 |
| WYM109 | 69720.8 | — | — | — | 10.2 | 0.04 | 9 |
| WYM99 | 70016.10 | — | — | — | 10.3 | 0.02 | 10 |
| CONT. | — | 1.3 | — | — | 9.3 | — | — |
| WYM109 | 69720.7 | — | — | — | 10.0 | 0.04 | 5 |
| WYM101 | 69715.8 | 1.3 | 0.05 | 16 | — | — | — |
| WYM108 | 69632.1 | 1.3 | 0.07 | 24 | 9.9 | 0.09 | 4 |
| WYM108 | 69636.6 | 1.2 | L | 15 | — | — | — |
| WYM4 | 69737.8 | 1.2 | 0.09 | 14 | — | — | — |
| WYM11 | 69640.1 | 1.3 | L | 23 | — | — | — |
| CONT. | — | 1.1 | — | — | 9.5 | — | — |
| WYM4 | 69736.3 | 1.3 | 0.20 | 8 | — | — | — |
| WYM100 | 69872.5 | 1.4 | 0.01 | 19 | 10.8 | 0.06 | 5 |
| WYM13 | 69645.2 | 1.5 | L | 25 | 10.4 | 0.26 | 1 |
| WYM99 | 70016.8 | 1.3 | 0.07 | 11 | 10.9 | 0.02 | 6 |
| CONT. | — | 1.2 | — | — | 10.3 | — | — |
| WYM109 | 69716.1 | — | — | — | 10.6 | 0.08 | 7 |
| WYM101 | 69710.2 | 1.3 | 0.03 | 10 | — | — | — |
| LNU74_H109 | 69483.3 | 1.4 | L | 15 | 10.6 | 0.07 | 7 |
| WYM108 | 69636.5 | 1.3 | 0.22 | 10 | 10.2 | 0.27 | 3 |
| WYM101 | 69712.2 | 1.3 | 0.09 | 6 | 10.3 | 0.20 | 4 |
| WYM98 | 70008.3 | 1.3 | 0.16 | 11 | — | — | — |
| CONT. | — | 1.2 | — | — | 9.9 | — | — |
| WYM109 | 69716.4 | 1.2 | 0.26 | 6 | — | — | — |
| WYM11 | 69640.7 | 1.2 | 0.19 | 5 | — | — | — |
| WYM11 | 69641.1 | 1.2 | 0.03 | 12 | — | — | — |
| WYM99 | 70017.5 | 1.3 | L | 21 | — | — | — |
| WYM98 | 70009.3 | 1.3 | 0.02 | 14 | — | — | — |
| CONT. | — | 1.1 | — | — | 9.8 | — | — |
| WYM98 | 70008.1 | 1.2 | 0.16 | 6 | 9.9 | 0.27 | 5 |
| WYM101 | 69715.5 | 1.2 | 0.10 | 7 | 10.3 | 0.15 | 9 |
| WYM84 | 69864.2 | — | — | — | 9.7 | 0.19 | 3 |
| WYM98 | 70005.3 | — | — | — | 10.1 | 0.04 | 8 |
| CONT. | — | 1.1 | — | — | 9.4 | — | — |
| WYM100 | 69874.1 | — | — | — | 9.3 | 0.10 | 3 |
| WYM11 | 69641.2 | — | — | — | 9.3 | 0.10 | 3 |
| WYM98 | 70005.2 | — | — | — | 9.5 | 0.11 | 4 |
| WYM98 | 70009.6 | — | — | — | 9.2 | 0.26 | 2 |
| LNU74_H109 | 69483.4 | 1.2 | 0.09 | 15 | 9.4 | 0.10 | 4 |
| CONT. | — | 1.1 | — | — | 9.1 | — | — |
| WYM4 | 69739.2 | 1.0 | 0.08 | 10 | 9.3 | 0.25 | 3 |
| LNU74_H109 | 69482.1 | 1.0 | 0.03 | 17 | 9.4 | 0.17 | 4 |
| LNU74_H109 | 69482.2 | 0.9 | 0.22 | 5 | — | — | — |
| WYM108 | 69635.3 | 0.9 | 0.26 | 5 | — | — | — |
| WYM100 | 69874.5 | 1.0 | 0.12 | 10 | — | — | — |
| WYM98 | 70008.4 | — | — | — | 9.4 | 0.18 | 3 |
| WYM99 | 70020.1 | 1.0 | 0.04 | 13 | — | — | — |
| CONT. | — | 0.9 | — | — | 9.1 | — | — |
| WYM101 | 69714.1 | — | — | — | 9.4 | 0.27 | 3 |
| WYM13 | 69647.1 | 1.1 | 0.14 | 2 | — | — | — |
| CONT. | — | 1.0 | — | — | 9.1 | — | — |
| WYM99 | 70016.9 | 1.1 | 0.25 | 7 | — | — | — |
| WYM13 | 69647.4 | 1.2 | 0.03 | 12 | — | — | — |
| WYM109 | 69719.2 | 1.2 | L | 16 | 9.8 | 0.28 | 4 |
| WYM101 | 69715.2 | 1.1 | 0.12 | 8 | — | — | — |
| WYM11 | 69638.1 | 1.2 | 0.10 | 13 | — | — | — |
| WYM84 | 69864.1 | 1.2 | 0.08 | 15 | 10.0 | 0.22 | 5 |
| CONT. | — | 1.0 | — | — | 9.5 | — | — |
| LNU74_H109 | 69483.5 | 1.1 | 0.20 | 7 | — | — | — |
| WYM99 | 70017.4 | 1.2 | 0.07 | 20 | — | — | — |
| WYM108 | 69635.2 | — | — | — | 9.7 | 0.10 | 2 |
| WYM109 | 69718.2 | 1.1 | 0.20 | 8 | — | — | — |
| CONT. | — | 1.0 | — | — | 9.5 | — | — |

Table 56. "CONT"—Control;
"Ave."—Average;
"% Incr." = % increment;
"p-val."—p-value,
L—p < 0.01.

TABLE 57

Genes showing improved plant performance at normal growth conditions under regulation of At6669 promoter

| Gene Name | Event # | GR Of Rosette Diameter [cm/day] | | |
|---|---|---|---|---|
| | | Ave. | P-Val. | % Incr. |
| WYM7 | 71168.1 | 0.5 | 0.06 | 13 |
| WYM17 | 71315.1 | 0.5 | 0.19 | 7 |
| WYM106 | 71687.6 | 0.5 | 0.05 | 10 |
| WYM110 | 71443.5 | 0.5 | 0.21 | 6 |
| WYM52 | 71461.2 | 0.5 | 0.12 | 8 |
| WYM106 | 71685.3 | 0.5 | L | 18 |
| CONT. | — | 0.5 | — | — |
| WYM47 | 69683.5 | 0.5 | 0.23 | 8 |
| WYM7 | 71172.5 | 0.5 | 0.26 | 8 |
| CONT. | — | 0.4 | — | — |
| WYM26 | 71627.6 | 0.5 | 0.27 | 12 |
| CONT. | — | 0.4 | — | — |
| WYM110 | 71442.5 | 0.5 | 0.05 | 19 |
| WYM47 | 69681.4 | 0.4 | 0.27 | 11 |
| WYM110 | 71445.5 | 0.5 | 0.19 | 12 |
| WYM106 | 71687.1 | 0.4 | 0.17 | 11 |
| CONT. | — | 0.4 | — | — |
| WYM44 | 71321.3 | 0.6 | 0.07 | 15 |
| WYM77 | 70948.2 | 0.5 | 0.23 | 11 |
| WYM26 | 71623.2 | 0.5 | 0.13 | 12 |
| WYM80 | 69994.2 | 0.6 | 0.04 | 17 |
| CONT. | — | 0.5 | — | — |
| WYM47 | 69683.3 | 0.5 | 0.26 | 12 |
| CONT. | — | 0.4 | — | — |
| WYM7 | 71169.2 | 0.6 | 0.19 | 12 |
| CONT. | — | 0.5 | — | — |
| WYM52 | 71461.5 | 0.5 | 0.16 | 13 |
| WYM106 | 71687.3 | 0.5 | 0.08 | 15 |
| WYM52 | 71465.2 | 0.5 | 0.17 | 12 |
| WYM110 | 71445.1 | 0.5 | 0.20 | 11 |
| WYM44 | 71321.5 | 0.6 | L | 26 |
| WYM44 | 71317.8 | 0.5 | 0.17 | 12 |
| CONT. | — | 0.4 | — | — |
| WYM44 | 71322.6 | 0.6 | 0.29 | 9 |
| WYM26 | 71626.4 | 0.5 | 0.29 | 8 |
| CONT. | — | 0.5 | — | — |
| WYM92 | 70001.1 | 0.5 | 0.19 | 12 |
| CONT. | — | 0.4 | — | — |
| WYM37 | 70944.7 | 0.4 | 0.13 | 9 |
| WYM57 | 69512.7 | 0.4 | 0.25 | 8 |
| WYM37 | 70942.4 | 0.5 | 0.08 | 12 |

TABLE 57-continued

Genes showing improved plant performance at normal growth conditions under regulation of At6669 promoter

| Gene Name | Event # | GR Of Rosette Diameter [cm/day] Ave. | P-Val. | % Incr. |
|---|---|---|---|---|
| CONT. | — | 0.4 | — | — |
| WYM63 | 69982.4 | 0.5 | L | 22 |
| WYM27 | 69936.2 | 0.5 | 0.08 | 10 |
| WYM92 | 70003.1 | 0.5 | 0.06 | 9 |
| LYM90 | 69389.5 | 0.5 | 0.04 | 9 |
| WYM60 | 69870.8 | 0.5 | 0.04 | 11 |
| CONT. | — | 0.4 | — | — |
| WYM51 | 69950.1 | 0.5 | 0.28 | 7 |
| CONT. | — | 0.4 | — | — |
| WYM63 | 69982.1 | 0.4 | 0.05 | 12 |
| CONT. | — | 0.4 | — | — |
| WYM37 | 70942.6 | 0.6 | 0.06 | 18 |
| WYM57 | 69514.2 | 0.6 | L | 20 |
| WYM66 | 70176.2 | 0.6 | 0.04 | 17 |
| WYM92 | 70000.3 | 0.6 | L | 25 |
| WYM60 | 69867.2 | 0.6 | L | 24 |
| WYM60 | 69870.3 | 0.5 | 0.06 | 16 |
| WYM66 | 70174.1 | 0.5 | 0.19 | 10 |
| CONT. | — | 0.5 | — | — |
| WYM57 | 69517.1 | 0.5 | 0.02 | 13 |
| WYM60 | 69868.5 | 0.6 | L | 21 |
| WYM58 | 69961.9 | 0.5 | 0.09 | 12 |
| WYM27 | 69935.9 | 0.5 | 0.06 | 13 |
| WYM66 | 70174.4 | 0.5 | 0.01 | 17 |
| WYM33 | 69942.2 | 0.5 | 0.03 | 13 |
| WYM33 | 69942.1 | 0.5 | 0.04 | 13 |
| WYM57 | 69515.4 | 0.6 | L | 21 |
| CONT. | — | 0.5 | — | — |
| WYM57 | 69513.3 | 0.5 | 0.14 | 12 |
| LYM90 | 69388.2 | 0.5 | 0.12 | 13 |
| WYM60 | 69867.3 | 0.5 | 0.17 | 11 |
| CONT. | — | 0.4 | — | — |
| WYM37 | 70942.5 | 0.5 | 0.15 | 9 |
| WYM58 | 69960.7 | 0.5 | 0.20 | 8 |
| CONT. | — | 0.5 | — | — |
| LYM90 | 69388.5 | 0.5 | 0.21 | 9 |
| CONT. | — | 0.5 | — | — |
| LYM90 | 69388.4 | 0.5 | 0.28 | 7 |
| CONT. | — | 0.5 | — | — |
| WYM66 | 70175.2 | 0.5 | 0.10 | 10 |
| WYM66 | 70173.1 | 0.5 | 0.18 | 9 |
| CONT. | — | 0.4 | — | — |
| WYM13 | 69646.1 | 0.5 | L | 15 |
| WYM98 | 70008.2 | 0.4 | 0.02 | 10 |
| LNU74_H109 | 69484.1 | 0.4 | 0.20 | 5 |
| WYM99 | 70020.4 | 0.4 | 0.11 | 10 |
| CONT. | — | 0.4 | — | — |
| WYM108 | 69635.1 | 0.5 | 0.26 | 6 |
| WYM84 | 69860.1 | 0.5 | 0.02 | 14 |
| WYM11 | 69642.2 | 0.5 | 0.18 | 9 |
| WYM84 | 69865.2 | 0.5 | 0.17 | 9 |
| LNU74_H109 | 69485.3 | 0.5 | 0.18 | 8 |
| WYM11 | 69639.9 | 0.5 | 0.01 | 14 |
| CONT. | — | 0.4 | — | — |
| WYM99 | 70020.3 | 0.5 | L | 16 |
| WYM99 | 70016.3 | 0.4 | 0.02 | 12 |
| WYM11 | 69640.3 | 0.4 | 0.07 | 8 |
| WYM101 | 69712.3 | 0.4 | 0.16 | 7 |
| WYM109 | 69717.3 | 0.5 | L | 17 |
| WYM84 | 69862.1 | 0.4 | 0.25 | 6 |
| WYM108 | 69634.1 | 0.4 | 0.01 | 11 |
| WYM84 | 69864.5 | 0.4 | L | 12 |
| CONT. | — | 0.4 | — | — |
| WYM100 | 69873.2 | 0.5 | 0.18 | 10 |
| CONT. | — | 0.5 | — | — |
| WYM101 | 69715.8 | 0.5 | 0.17 | 9 |
| WYM108 | 69632.1 | 0.5 | 0.16 | 11 |
| WYM108 | 69636.6 | 0.5 | 0.11 | 9 |
| WYM4 | 69737.8 | 0.5 | 0.19 | 10 |
| WYM11 | 69640.1 | 0.5 | L | 16 |
| CONT. | — | 0.4 | — | — |
| WYM100 | 69872.5 | 0.5 | 0.13 | 11 |
| WYM13 | 69645.2 | 0.5 | 0.10 | 14 |
| WYM99 | 70016.8 | 0.5 | 0.23 | 9 |
| CONT. | — | 0.5 | — | — |
| LNU74_H109 | 69483.3 | 0.5 | 0.16 | 9 |
| CONT. | — | 0.5 | — | — |
| WYM99 | 70017.5 | 0.5 | 0.19 | 7 |
| WYM13 | 69647.7 | 0.5 | 0.23 | 7 |
| CONT. | — | 0.4 | — | — |
| WYM11 | 69641.2 | 0.5 | 0.22 | 6 |
| WYM98 | 70009.2 | 0.5 | 0.16 | 7 |
| LNU74_H109 | 69483.4 | 0.5 | 0.02 | 13 |
| CONT. | — | 0.4 | — | — |
| WYM4 | 69739.2 | 0.4 | 0.05 | 10 |
| LNU74_H109 | 69482.1 | 0.4 | 0.06 | 10 |
| WYM100 | 69874.5 | 0.4 | 0.23 | 6 |
| WYM99 | 70020.1 | 0.4 | 0.26 | 6 |
| CONT. | — | 0.4 | — | — |
| WYM13 | 69647.4 | 0.5 | 0.07 | 10 |
| WYM109 | 69719.2 | 0.5 | L | 15 |
| WYM11 | 69638.1 | 0.5 | 0.27 | 7 |
| WYM84 | 69864.1 | 0.5 | 0.26 | 8 |
| CONT. | — | 0.4 | — | — |
| WYM99 | 70017.4 | 0.4 | 0.16 | 11 |
| CONT. | — | 0.4 | — | — |

Table 57. "CONT."—Control;
"Ave."—Average;
"% Incr." = % increment;
"p-val."—p-value,
L—p < 0.01.

TABLE 58

Genes showing improved plant performance at normal growth conditions under regulation of At6669 promoter

| Gene Name | Event # | Harvest Index Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| WYM7 | 71168.1 | 0.3 | 0.07 | 14 | 9.6 | 0.07 | 17 | 5.5 | 0.05 | 11 |
| WYM17 | 71315.1 | — | — | — | 9.1 | 0.05 | 11 | 5.4 | 0.03 | 8 |
| WYM106 | 71687.6 | — | — | — | 9.1 | 0.02 | 10 | 5.3 | L | 7 |
| WYM110 | 71443.5 | — | — | — | — | — | — | 5.1 | 0.09 | 2 |
| WYM52 | 71461.2 | 0.3 | 0.10 | 9 | 8.6 | 0.21 | 4 | 5.3 | 0.04 | 6 |
| WYM106 | 71685.3 | 0.3 | 0.09 | 8 | 9.9 | 0.02 | 20 | 5.5 | 0.03 | 11 |

TABLE 58-continued

Genes showing improved plant performance at normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 0.3 | — | — | 8.2 | — | — | 5.0 | — | — |
| WYM47 | 69683.5 | — | — | — | 8.7 | 0.03 | 12 | 5.1 | 0.05 | 7 |
| WYM7 | 71172.5 | — | — | — | — | — | — | 5.0 | 0.18 | 4 |
| CONT. | — | 0.3 | — | — | 7.7 | — | — | 4.8 | — | — |
| WYM26 | 71627.6 | — | — | — | 8.1 | 0.15 | 10 | 4.9 | 0.29 | 3 |
| WYM77 | 70949.3 | 0.3 | 0.17 | 13 | — | — | — | — | — | — |
| WYM77 | 70947.2 | — | — | — | 7.7 | 0.26 | 5 | — | — | — |
| WYM17 | 71314.3 | — | — | — | 7.6 | 0.27 | 4 | — | — | — |
| CONT. | — | 0.2 | — | — | 7.4 | — | — | 4.7 | — | — |
| WYM7 | 71172.1 | 0.3 | 0.24 | 10 | — | — | — | — | — | — |
| WYM7 | 71169.7 | — | — | — | 11.6 | 0.22 | 9 | 6.0 | 0.28 | 4 |
| WYM7 | 71170.1 | 0.3 | 0.22 | 9 | — | — | — | — | — | — |
| WYM95 | 70181.2 | 0.3 | 0.14 | 15 | 11.7 | 0.21 | 10 | 6.1 | 0.22 | 5 |
| CONT. | — | 0.3 | — | — | 10.7 | — | — | 5.7 | — | — |
| WYM80 | 69993.2 | 0.3 | 0.06 | 20 | — | — | — | — | — | — |
| WYM95 | 70182.3 | — | — | — | 7.5 | 0.27 | 6 | 4.7 | 0.24 | 3 |
| WYM17 | 71313.9 | 0.3 | 0.09 | 20 | — | — | — | 4.7 | 0.20 | 3 |
| WYM95 | 70182.5 | 0.3 | 0.08 | 9 | — | — | — | 4.7 | 0.23 | 2 |
| WYM47 | 69685.5 | — | — | — | 7.4 | 0.27 | 4 | 4.7 | 0.22 | 3 |
| WYM17 | 71316.2 | 0.3 | L | 22 | — | — | — | — | — | — |
| WYM95 | 70178.1 | 0.3 | 0.09 | 8 | — | — | — | — | — | — |
| CONT. | — | 0.2 | — | — | 7.1 | — | — | 4.6 | — | — |
| WYM106 | 71684.4 | — | — | — | 7.4 | 0.18 | 9 | 4.6 | 0.21 | 4 |
| WYM110 | 71442.5 | — | — | — | 8.9 | L | 32 | 5.2 | 0.02 | 16 |
| WYM47 | 69681.4 | — | — | — | 8.1 | 0.08 | 20 | 4.9 | 0.04 | 11 |
| WYM26 | 71627.4 | — | — | — | 7.4 | 0.21 | 9 | 4.7 | 0.20 | 5 |
| WYM26 | 71626.6 | — | — | — | 7.4 | 0.22 | 9 | 4.7 | 0.20 | 5 |
| WYM110 | 71445.5 | — | — | — | 7.3 | 0.25 | 7 | 4.8 | 0.13 | 7 |
| WYM106 | 71687.1 | — | — | — | 7.4 | 0.15 | 9 | 4.8 | 0.07 | 7 |
| CONT. | — | 0.3 | — | — | 6.8 | — | — | 4.5 | — | — |
| WYM52 | 71463.4 | 0.3 | 0.15 | 17 | 9.5 | 0.08 | 20 | 5.5 | 0.08 | 10 |
| WYM110 | 71445.6 | 0.3 | 0.02 | 35 | 9.1 | 0.05 | 15 | 5.3 | 0.10 | 7 |
| WYM44 | 71321.3 | 0.3 | 0.05 | 24 | 9.8 | 0.02 | 25 | 5.7 | 0.02 | 14 |
| WYM77 | 70948.2 | 0.3 | 0.04 | 30 | 9.9 | 0.04 | 25 | 5.6 | 0.04 | 12 |
| WYM26 | 71623.2 | 0.3 | 0.01 | 25 | 10.1 | L | 28 | 5.6 | 0.02 | 13 |
| WYM80 | 69994.2 | 0.3 | L | 30 | 10.8 | L | 37 | 5.8 | 0.01 | 17 |
| WYM110 | 71443.6 | 0.3 | 0.03 | 35 | 9.0 | 0.09 | 14 | 5.3 | 0.10 | 7 |
| WYM17 | 71313.6 | 0.3 | 0.02 | 39 | 9.4 | 0.03 | 19 | 5.4 | 0.07 | 9 |
| CONT. | — | 0.2 | — | — | 7.9 | — | — | 5.0 | — | — |
| WYM95 | 70181.1 | 0.3 | 0.07 | 23 | — | — | — | — | — | — |
| WYM47 | 69685.1 | 0.3 | 0.01 | 34 | 8.4 | 0.15 | 13 | 5.1 | 0.17 | 7 |
| WYM95 | 70183.2 | 0.3 | 0.16 | 13 | 8.1 | 0.19 | 9 | 5.0 | 0.19 | 5 |
| WYM47 | 69683.3 | 0.3 | 0.04 | 23 | 8.3 | 0.16 | 11 | 5.1 | 0.14 | 8 |
| WYM95 | 70181.3 | 0.3 | 0.09 | 19 | — | — | — | — | — | — |
| WYM80 | 69994.4 | — | — | — | 8.9 | 0.07 | 20 | 5.1 | 0.18 | 7 |
| WYM26 | 71622.3 | 0.3 | 0.16 | 11 | 8.4 | 0.12 | 13 | 5.0 | 0.18 | 5 |
| CONT. | — | 0.2 | — | — | 7.4 | — | — | 4.7 | — | — |
| WYM26 | 71626.1 | — | — | — | 10.0 | 0.17 | 8 | 5.5 | 0.11 | 4 |
| WYM52 | 71465.5 | — | — | — | 10.7 | 0.06 | 16 | 5.6 | 0.09 | 6 |
| WYM106 | 71685.5 | 0.3 | 0.22 | 8 | — | — | — | — | — | — |
| CONT. | — | 0.3 | — | — | 9.2 | — | — | 5.3 | — | — |
| WYM7 | 71169.2 | — | — | — | 10.6 | 0.05 | 18 | 5.7 | 0.04 | 12 |
| WYM52 | 71461.6 | 0.3 | 0.18 | 21 | — | — | — | 5.3 | 0.25 | 4 |
| CONT. | — | 0.3 | — | — | 9.0 | — | — | 5.1 | — | — |
| WYM26 | 71626.2 | — | — | — | 9.3 | 0.25 | 6 | 5.2 | 0.30 | 2 |
| WYM17 | 71315.4 | — | — | — | 9.3 | 0.25 | 7 | — | — | — |
| CONT. | — | 0.3 | — | — | 8.7 | — | — | 5.1 | — | — |
| WYM7 | 71170.5 | — | — | — | 9.1 | 0.25 | 8 | 5.4 | 0.12 | 8 |
| WYM7 | 71170.3 | 0.3 | 0.24 | 12 | 9.5 | 0.16 | 12 | 5.3 | 0.13 | 8 |
| WYM106 | 71685.6 | — | — | — | — | — | — | 5.1 | 0.27 | 4 |
| WYM52 | 71463.6 | — | — | — | 10.0 | 0.21 | 17 | 5.4 | 0.21 | 9 |
| CONT. | — | 0.3 | — | — | 8.5 | — | — | 5.0 | — | — |
| WYM52 | 71461.5 | 0.3 | 0.29 | 3 | 9.0 | 0.18 | 13 | 5.2 | 0.15 | 7 |
| WYM106 | 71687.3 | — | — | — | 9.8 | 0.02 | 23 | 5.4 | 0.03 | 11 |
| WYM52 | 71465.2 | 0.4 | 0.02 | 17 | 8.7 | 0.09 | 10 | 5.2 | 0.06 | 8 |
| WYM7 | 71170.2 | — | — | — | 8.7 | 0.28 | 9 | 5.2 | 0.20 | 8 |
| WYM110 | 71445.1 | — | — | — | 9.7 | L | 22 | 5.4 | 0.03 | 11 |
| WYM52 | 71465.4 | — | — | — | 9.1 | 0.03 | 15 | 5.3 | 0.05 | 9 |
| WYM44 | 71321.5 | 0.4 | 0.07 | 16 | 11.1 | L | 39 | 5.8 | L | 20 |
| WYM44 | 71317.8 | 0.3 | 0.10 | 9 | 9.0 | 0.06 | 13 | 5.2 | 0.05 | 9 |
| CONT. | — | 0.3 | — | — | 7.9 | — | — | 4.8 | — | — |

TABLE 58-continued

Genes showing improved plant performance at normal growth conditions under regulation of At6669 promoter

| | | Harvest Index | | | Rosette Area [cm²] | | | Rosette Diameter [cm] | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| WYM44 | 71322.6 | 0.3 | 0.14 | 11 | — | — | — | 5.5 | 0.18 | 6 |
| WYM26 | 71626.4 | 0.3 | 0.08 | 15 | 10.6 | 0.06 | 14 | 5.5 | 0.07 | 6 |
| WYM7 | 71169.5 | 0.3 | 0.11 | 13 | — | — | — | — | — | — |
| WYM47 | 69684.3 | 0.3 | 0.03 | 24 | 10.4 | 0.13 | 12 | 5.6 | 0.04 | 8 |
| WYM110 | 71445.2 | 0.3 | 0.29 | 5 | — | — | — | — | — | — |
| WYM110 | 71442.2 | 0.3 | 0.27 | 7 | — | — | — | — | — | — |
| CONT. | — | 0.3 | — | — | 9.3 | — | — | 5.2 | — | — |
| WYM92 | 70001.1 | — | — | — | 9.0 | 0.11 | 15 | 5.1 | 0.10 | 8 |
| WYM60 | 69869.3 | — | — | — | 8.4 | 0.25 | 8 | — | — | — |
| CONT. | — | 0.3 | — | — | 7.8 | — | — | 4.8 | — | — |
| WYM37 | 70944.7 | 0.3 | 0.29 | 2 | 9.4 | 0.02 | 21 | 5.2 | 0.04 | 8 |
| WYM57 | 69512.7 | 0.4 | 0.01 | 9 | 8.8 | 0.06 | 13 | 5.0 | 0.12 | 5 |
| WYM37 | 70942.4 | — | — | — | 9.5 | 0.02 | 23 | 5.2 | 0.06 | 10 |
| WYM27 | 69935.2 | 0.4 | 0.09 | 13 | 8.8 | 0.10 | 13 | 5.0 | 0.17 | 5 |
| WYM58 | 69959.3 | 0.3 | 0.28 | 4 | 8.4 | 0.17 | 8 | — | — | — |
| WYM63 | 69984.2 | 0.3 | 0.27 | 5 | 8.8 | 0.08 | 14 | 5.0 | 0.09 | 6 |
| WYM60 | 69870.2 | 0.4 | 0.09 | 11 | 8.5 | 0.26 | 10 | — | — | — |
| CONT. | — | 0.3 | — | — | 7.8 | — | — | 4.8 | — | — |
| WYM63 | 69982.4 | 0.4 | 0.30 | 4 | 10.9 | L | 33 | 6.0 | L | 20 |
| WYM27 | 69936.2 | — | — | — | 9.4 | L | 16 | 5.4 | 0.03 | 9 |
| WYM51 | 69954.2 | — | — | — | 9.8 | 0.02 | 20 | 5.3 | L | 8 |
| WYM92 | 70003.1 | — | — | — | 9.9 | 0.01 | 21 | 5.4 | 0.02 | 9 |
| LYM90 | 69389.5 | — | — | — | 10.1 | L | 24 | 5.5 | L | 10 |
| WYM60 | 69870.8 | — | — | — | 10.1 | L | 24 | 5.5 | 0.01 | 10 |
| WYM51 | 69950.5 | — | — | — | 9.2 | 0.05 | 13 | 5.4 | 0.07 | 8 |
| WYM27 | 69937.5 | — | — | — | 9.1 | 0.02 | 11 | 5.3 | 0.02 | 7 |
| CONT. | — | 0.3 | — | — | 8.2 | — | — | 5.0 | — | — |
| WYM60 | 69869.2 | 0.3 | L | 30 | — | — | — | — | — | — |
| WYM58 | 69960.2 | 0.3 | 0.20 | 9 | — | — | — | — | — | — |
| WYM51 | 69950.1 | 0.3 | 0.04 | 22 | 10.2 | 0.03 | 20 | 5.4 | 0.05 | 8 |
| WYM92 | 70000.5 | 0.3 | L | 18 | — | — | — | — | — | — |
| WYM58 | 69961.10 | 0.3 | L | 27 | — | — | — | — | — | — |
| WYM63 | 69983.2 | 0.3 | L | 29 | — | — | — | — | — | — |
| WYM37 | 70944.8 | 0.3 | 0.05 | 17 | — | — | — | — | — | — |
| WYM63 | 69980.3 | 0.3 | L | 21 | — | — | — | — | — | — |
| CONT. | — | 0.2 | — | — | 8.5 | — | — | 5.0 | — | — |
| WYM92 | 69998.2 | — | — | — | 8.1 | 0.09 | 10 | 4.7 | 0.11 | 3 |
| WYM63 | 69982.1 | — | — | — | 8.9 | L | 20 | 5.1 | 0.01 | 10 |
| WYM37 | 70942.3 | — | — | — | — | — | — | 4.8 | 0.07 | 5 |
| WYM63 | 69984.6 | — | — | — | 7.8 | 0.25 | 6 | 4.7 | 0.18 | 2 |
| WYM60 | 69868.3 | — | — | — | 8.4 | 0.03 | 14 | 4.9 | 0.03 | 7 |
| WYM66 | 70175.3 | — | — | — | 8.3 | 0.17 | 12 | 4.8 | 0.19 | 6 |
| CONT. | — | 0.3 | — | — | 7.4 | — | — | 4.6 | — | — |
| WYM37 | 70942.6 | 0.4 | 0.05 | 15 | 11.4 | 0.03 | 27 | 6.0 | 0.04 | 15 |
| WYM57 | 69514.2 | — | — | — | 12.8 | L | 43 | 6.3 | L | 21 |
| WYM66 | 70176.2 | 0.3 | 0.26 | 4 | 11.7 | 0.01 | 30 | 5.9 | 0.01 | 14 |
| WYM92 | 70000.3 | 0.4 | 0.10 | 13 | 12.1 | L | 35 | 6.2 | L | 20 |
| WYM60 | 69867.2 | 0.4 | 0.04 | 17 | 12.7 | L | 41 | 6.2 | L | 19 |
| WYM60 | 69870.3 | 0.4 | 0.05 | 15 | 10.7 | 0.06 | 19 | 5.8 | 0.05 | 11 |
| WYM66 | 70174.1 | — | — | — | 10.1 | 0.10 | 13 | 5.6 | 0.07 | 8 |
| CONT. | — | 0.3 | — | — | 9.0 | — | — | 5.2 | — | — |
| WYM57 | 69517.1 | — | — | — | 11.6 | L | 30 | 6.0 | L | 15 |
| WYM60 | 69868.5 | — | — | — | 11.8 | 0.02 | 32 | 6.1 | 0.01 | 16 |
| WYM58 | 69961.9 | — | — | — | 11.0 | L | 23 | 5.7 | 0.03 | 10 |
| WYM27 | 69935.9 | 0.4 | 0.03 | 17 | 11.0 | 0.01 | 24 | 5.8 | 0.04 | 11 |
| WYM66 | 70174.4 | 0.3 | 0.27 | 4 | 11.8 | 0.02 | 33 | 6.0 | 0.03 | 16 |
| WYM33 | 69942.2 | 0.3 | 0.12 | 8 | 10.5 | L | 18 | 5.8 | L | 11 |
| WYM33 | 69942.1 | — | — | — | 11.5 | 0.01 | 29 | 5.9 | 0.02 | 14 |
| WYM57 | 69515.4 | — | — | — | 13.5 | L | 52 | 6.3 | L | 21 |
| CONT. | — | 0.3 | — | — | 8.9 | — | — | 5.2 | — | — |
| WYM57 | 69514.3 | 0.3 | 0.25 | 8 | 9.1 | 0.15 | 16 | 5.2 | 0.16 | 7 |
| WYM57 | 69513.3 | — | — | — | 9.6 | 0.02 | 22 | 5.4 | 0.02 | 12 |
| LYM90 | 69388.2 | 0.3 | 0.15 | 9 | 9.4 | 0.07 | 19 | 5.3 | 0.06 | 9 |
| WYM60 | 69867.3 | 0.3 | 0.03 | 23 | 9.3 | 0.07 | 18 | 5.3 | 0.04 | 10 |
| WYM27 | 69937.1 | 0.3 | 0.11 | 14 | 8.3 | 0.29 | 6 | 5.0 | 0.25 | 4 |
| LYM90 | 69389.6 | 0.3 | 0.14 | 10 | — | — | — | — | — | — |
| WYM37 | 70939.4 | 0.3 | 0.08 | 14 | — | — | — | — | — | — |
| CONT. | — | 0.2 | — | — | 7.9 | — | — | 4.8 | — | — |
| WYM37 | 70942.5 | 0.3 | 0.27 | 5 | 10.9 | L | 25 | 5.7 | L | 10 |
| WYM33 | 69938.6 | — | — | — | 9.2 | 0.27 | 4 | — | — | — |
| WYM58 | 69960.7 | 0.3 | 0.22 | 9 | 10.4 | 0.04 | 19 | 5.6 | 0.02 | 7 |

TABLE 58-continued

Genes showing improved plant performance at normal growth conditions under regulation of At6669 promoter

| | | Harvest Index | | | Rosette Area [cm²] | | | Rosette Diameter [cm] | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| WYM57 | 69515.1 | 0.3 | 0.28 | 6 | 9.8 | 0.09 | 12 | 5.4 | 0.19 | 4 |
| WYM27 | 69935.4 | — | — | — | 9.3 | 0.29 | 6 | — | — | — |
| CONT. | — | 0.3 | — | — | 8.8 | — | — | 5.2 | — | — |
| WYM66 | 70174.3 | 0.3 | 0.16 | 6 | 9.8 | 0.23 | 6 | 5.5 | 0.16 | 5 |
| WYM92 | 69999.3 | 0.3 | 0.17 | 6 | — | — | — | — | — | — |
| WYM33 | 69943.2 | 0.3 | 0.07 | 13 | — | — | — | — | — | — |
| LYM90 | 69388.5 | — | — | — | 11.0 | 0.02 | 18 | 5.8 | 0.03 | 10 |
| WYM58 | 69960.3 | 0.3 | 0.23 | 5 | — | — | — | — | — | — |
| WYM51 | 69950.3 | 0.3 | 0.19 | 9 | 9.9 | 0.22 | 6 | — | — | — |
| CONT. | — | 0.3 | — | — | 9.3 | — | — | 5.3 | — | — |
| LYM90 | 69386.3 | 0.4 | 0.03 | 14 | 10.3 | 0.13 | 10 | 5.7 | 0.09 | 9 |
| WYM27 | 69936.1 | 0.4 | 0.14 | 9 | — | — | — | 5.6 | 0.11 | 7 |
| LYM90 | 69388.4 | 0.4 | 0.17 | 8 | 10.2 | 0.16 | 9 | 5.7 | 0.06 | 8 |
| WYM33 | 69939.1 | 0.4 | 0.14 | 7 | — | — | — | 5.5 | 0.29 | 4 |
| WYM57 | 69512.2 | 0.4 | 0.06 | 12 | — | — | — | — | — | — |
| WYM66 | 70175.4 | 0.4 | 0.02 | 17 | 10.1 | 0.27 | 7 | 5.7 | 0.16 | 9 |
| CONT. | — | 0.4 | — | — | 9.4 | — | — | 5.3 | — | — |
| WYM60 | 69870.5 | — | — | — | 10.6 | 0.15 | 9 | 5.8 | 0.14 | 5 |
| WYM58 | 69961.3 | — | — | — | 10.2 | 0.27 | 5 | — | — | — |
| CONT. | — | 0.4 | — | — | 9.7 | — | — | 5.5 | — | — |
| WYM51 | 69953.5 | 0.3 | 0.20 | 10 | — | — | — | — | — | — |
| WYM58 | 69961.7 | 0.3 | 0.17 | 4 | 9.0 | 0.18 | 8 | 5.2 | 0.12 | 5 |
| WYM92 | 70000.4 | 0.3 | 0.26 | 2 | 8.6 | 0.26 | 4 | 5.1 | 0.18 | 3 |
| WYM51 | 69954.7 | 0.3 | 0.22 | 6 | 9.5 | 0.04 | 14 | 5.2 | 0.08 | 6 |
| WYM57 | 69513.2 | — | — | — | — | — | — | 5.2 | 0.11 | 5 |
| WYM66 | 70175.2 | 0.3 | 0.23 | 9 | 9.2 | 0.05 | 10 | 5.3 | 0.03 | 8 |
| WYM66 | 70173.1 | — | — | — | 9.8 | 0.02 | 18 | 5.4 | 0.04 | 10 |
| CONT. | — | 0.3 | — | — | 8.3 | — | — | 4.9 | — | — |
| WYM108 | 69633.1 | — | — | — | 7.4 | 0.15 | 9 | 4.9 | 0.02 | 7 |
| WYM13 | 69646.1 | — | — | — | 9.0 | L | 33 | 5.3 | L | 16 |
| WYM98 | 70008.2 | 0.3 | 0.22 | 6 | 7.6 | 0.03 | 11 | 5.0 | 0.05 | 9 |
| LNU74_H109 | 69484.1 | — | — | — | 7.7 | 0.02 | 13 | 4.9 | 0.01 | 6 |
| WYM99 | 70020.4 | — | — | — | 7.7 | 0.12 | 13 | 4.8 | 0.13 | 6 |
| WYM109 | 69717.2 | 0.3 | 0.20 | 9 | — | — | — | — | — | — |
| CONT. | — | 0.2 | — | — | 6.8 | — | — | 4.6 | — | — |
| WYM108 | 69635.1 | — | — | — | 7.7 | 0.15 | 9 | 5.0 | 0.14 | 5 |
| WYM84 | 69860.1 | — | — | — | 8.4 | 0.02 | 18 | 5.2 | 0.03 | 11 |
| WYM11 | 69642.2 | — | — | — | 7.7 | 0.14 | 9 | 5.0 | 0.14 | 5 |
| WYM84 | 69865.2 | — | — | — | 8.3 | 0.05 | 17 | 5.2 | 0.04 | 10 |
| LNU74_H109 | 69485.3 | — | — | — | 7.4 | 0.27 | 5 | 5.0 | 0.16 | 5 |
| WYM11 | 69639.9 | — | — | — | 9.7 | L | 37 | 5.6 | L | 17 |
| CONT. | — | 0.3 | — | — | 7.1 | — | — | 4.7 | — | — |
| WYM99 | 70020.3 | 0.2 | 0.15 | 10 | 7.3 | L | 17 | 4.8 | L | 9 |
| WYM99 | 70016.3 | 0.3 | 0.03 | 17 | 7.2 | 0.02 | 15 | 4.8 | 0.01 | 9 |
| WYM11 | 69640.3 | 0.2 | 0.20 | 6 | 6.6 | 0.10 | 6 | 4.5 | 0.07 | 4 |
| WYM101 | 69712.3 | — | — | — | — | — | — | 4.5 | 0.20 | 3 |
| WYM109 | 69717.3 | 0.2 | 0.26 | 5 | 7.7 | 0.04 | 24 | 5.0 | 0.03 | 14 |
| WYM84 | 69862.1 | — | — | — | — | — | — | 4.5 | 0.25 | 2 |
| WYM108 | 69634.1 | 0.2 | 0.12 | 9 | 7.3 | L | 17 | 4.8 | L | 10 |
| WYM84 | 69864.5 | 0.2 | 0.13 | 10 | 6.8 | 0.02 | 8 | 4.7 | 0.01 | 7 |
| CONT. | — | 0.2 | — | — | 6.2 | — | — | 4.4 | — | — |
| WYM11 | 69641.3 | — | — | — | 9.9 | 0.02 | 11 | 5.6 | 0.07 | 6 |
| WYM98 | 70009.1 | — | — | — | 9.5 | 0.16 | 6 | 5.4 | 0.30 | 2 |
| WYM4 | 69737.3 | — | — | — | 9.3 | 0.20 | 4 | — | — | — |
| LNU74_H109 | 69487.1 | — | — | — | 9.4 | 0.15 | 5 | 5.4 | 0.22 | 3 |
| WYM100 | 69873.2 | — | — | — | 10.3 | 0.11 | 15 | 5.7 | 0.12 | 7 |
| WYM101 | 69713.5 | — | — | — | 9.3 | 0.30 | 4 | — | — | — |
| WYM109 | 69720.8 | — | — | — | 9.5 | 0.19 | 6 | — | — | — |
| WYM99 | 70016.10 | — | — | — | 9.4 | 0.25 | 5 | 5.5 | 0.29 | 3 |
| CONT. | — | 0.3 | — | — | 8.9 | — | — | 5.3 | — | — |
| WYM109 | 69720.7 | — | — | — | 8.0 | 0.25 | 7 | — | — | — |
| WYM100 | 69875.4 | 0.3 | 0.14 | 9 | — | — | — | — | — | — |
| WYM101 | 69715.8 | 0.3 | 0.10 | 11 | 8.5 | 0.09 | 13 | 5.1 | 0.09 | 6 |
| WYM108 | 69632.1 | — | — | — | 9.5 | 0.08 | 27 | 5.4 | 0.06 | 13 |
| WYM108 | 69636.6 | 0.3 | 0.28 | 5 | 8.5 | 0.03 | 14 | 5.2 | 0.03 | 8 |
| WYM4 | 69737.8 | 0.3 | 0.08 | 13 | 8.4 | 0.12 | 12 | 5.2 | 0.16 | 7 |
| WYM11 | 69640.1 | — | — | — | 9.4 | 0.02 | 26 | 5.4 | L | 12 |
| CONT. | — | 0.3 | — | — | 7.5 | — | — | 4.8 | — | — |
| WYM4 | 69734.2 | 0.3 | 0.24 | 8 | — | — | — | — | — | — |
| WYM4 | 69736.3 | 0.3 | 0.28 | 8 | 9.7 | 0.14 | 11 | 5.4 | 0.21 | 4 |
| WYM100 | 69872.5 | 0.3 | 0.29 | 6 | 10.5 | 0.02 | 21 | 5.6 | 0.04 | 8 |

TABLE 58-continued

Genes showing improved plant performance at normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| WYM13 | 69645.2 | — | — | — | 10.8 | 0.01 | 24 | 6.0 | L | 15 |
| WYM99 | 70016.8 | 0.3 | 0.09 | 11 | 10.4 | 0.03 | 19 | 5.6 | 0.04 | 7 |
| WYM109 | 69716.3 | 0.3 | 0.09 | 20 | — | — | — | — | — | — |
| CONT. | — | 0.3 | — | — | 8.7 | — | — | 5.2 | — | — |
| WYM109 | 69716.1 | 0.3 | 0.07 | 23 | 9.4 | 0.16 | 9 | 5.4 | 0.21 | 4 |
| WYM4 | 69735.3 | 0.3 | 0.07 | 18 | — | — | — | — | — | — |
| WYM101 | 69710.2 | 0.3 | 0.24 | 9 | 9.7 | 0.05 | 13 | 5.5 | 0.10 | 5 |
| LNU74_H109 | 69483.3 | 0.3 | 0.15 | 11 | 10.2 | 0.02 | 19 | 5.8 | 0.02 | 10 |
| WYM108 | 69636.5 | 0.3 | 0.05 | 19 | 9.5 | 0.23 | 11 | 5.5 | 0.20 | 6 |
| WYM101 | 69712.2 | 0.3 | 0.19 | 9 | 9.5 | 0.08 | 10 | 5.4 | 0.15 | 4 |
| WYM98 | 70008.3 | 0.3 | 0.07 | 19 | 9.4 | 0.20 | 10 | 5.5 | 0.18 | 5 |
| CONT. | — | 0.2 | — | — | 8.6 | — | — | 5.2 | — | — |
| WYM109 | 69716.4 | 0.3 | 0.16 | 8 | — | — | — | 5.2 | 0.24 | 4 |
| WYM11 | 69640.7 | — | — | — | — | — | — | 5.2 | 0.18 | 3 |
| WYM11 | 69641.1 | 0.3 | 0.02 | 13 | 8.8 | 0.02 | 11 | 5.2 | 0.08 | 4 |
| WYM99 | 70017.5 | — | — | — | — | — | — | 5.1 | 0.24 | 2 |
| WYM98 | 70009.3 | — | — | — | 8.6 | 0.04 | 9 | 5.4 | 0.02 | 7 |
| CONT. | — | 0.2 | — | — | 7.9 | — | — | 5.0 | — | — |
| WYM84 | 69860.6 | 0.3 | 0.09 | 13 | — | — | — | — | — | — |
| WYM13 | 69647.9 | 0.2 | 0.27 | 4 | 8.0 | 0.09 | 4 | — | — | — |
| WYM100 | 69875.3 | 0.2 | 0.15 | 8 | — | — | — | — | — | — |
| WYM13 | 69644.2 | 0.2 | 0.22 | 5 | 8.0 | 0.17 | 5 | 5.2 | 0.13 | 3 |
| WYM98 | 70008.1 | 0.3 | 0.05 | 13 | 8.1 | 0.19 | 5 | 5.3 | 0.08 | 5 |
| WYM101 | 69715.5 | — | — | — | 8.6 | 0.02 | 12 | 5.3 | 0.03 | 6 |
| WYM84 | 69864.2 | 0.2 | 0.06 | 10 | 8.3 | 0.17 | 8 | 5.2 | 0.10 | 4 |
| WYM98 | 70005.3 | 0.3 | 0.02 | 13 | 8.1 | 0.03 | 6 | 5.1 | 0.27 | 2 |
| CONT. | — | 0.2 | — | — | 7.7 | — | — | 5.0 | — | — |
| WYM100 | 69874.1 | 0.3 | 0.10 | 17 | — | — | — | 4.9 | 0.14 | 2 |
| WYM11 | 69641.2 | 0.3 | 0.17 | 7 | — | — | — | 4.9 | 0.10 | 3 |
| WYM98 | 70005.2 | 0.3 | 0.03 | 15 | — | — | — | 4.8 | 0.24 | 2 |
| WYM98 | 70009.6 | 0.3 | 0.14 | 7 | — | — | — | 4.8 | 0.28 | 1 |
| WYM4 | 69737.5 | 0.3 | 0.12 | 6 | — | — | — | — | — | — |
| LNU74_H109 | 69483.4 | 0.3 | 0.04 | 17 | 9.2 | 0.04 | 23 | 5.3 | 0.03 | 12 |
| CONT. | — | 0.2 | — | — | 7.5 | — | — | 4.8 | — | — |
| WYM4 | 69739.2 | 0.3 | 0.02 | 16 | 6.8 | L | 16 | 4.7 | L | 8 |
| LNU74_H109 | 69482.1 | 0.3 | 0.01 | 23 | 7.4 | L | 26 | 4.7 | 0.03 | 9 |
| LNU74_H109 | 69482.2 | 0.3 | 0.03 | 17 | 6.6 | 0.05 | 13 | 4.4 | 0.22 | 2 |
| WYM108 | 69635.3 | 0.2 | 0.30 | 6 | 6.3 | 0.15 | 7 | 4.4 | 0.18 | 2 |
| WYM100 | 69874.5 | 0.3 | 0.01 | 16 | 6.7 | 0.01 | 14 | 4.5 | 0.04 | 5 |
| WYM98 | 70008.4 | 0.3 | 0.13 | 16 | 6.2 | 0.26 | 6 | — | — | — |
| WYM99 | 70020.1 | 0.3 | 0.06 | 13 | 6.8 | L | 16 | 4.6 | 0.02 | 6 |
| CONT. | — | 0.2 | — | — | 5.9 | — | — | 4.3 | — | — |
| WYM108 | 69634.2 | 0.2 | 0.12 | 8 | — | — | — | — | — | — |
| WYM84 | 69860.2 | 0.3 | 0.03 | 12 | — | — | — | — | — | — |
| WYM13 | 69645.5 | 0.3 | L | 22 | 7.6 | 0.18 | 8 | 4.8 | 0.20 | 4 |
| WYM13 | 69647.1 | 0.3 | L | 20 | — | — | — | — | — | — |
| WYM4 | 69737.1 | 0.2 | 0.23 | 8 | — | — | — | — | — | — |
| CONT. | — | 0.2 | — | — | 7.1 | — | — | 4.6 | — | — |
| WYM99 | 70016.9 | — | — | — | 7.5 | 0.25 | 8 | — | — | — |
| WYM13 | 69647.4 | — | — | — | 8.5 | L | 22 | 5.3 | 0.01 | 10 |
| WYM109 | 69719.2 | 0.3 | 0.05 | 12 | 8.7 | 0.01 | 25 | 5.3 | L | 11 |
| WYM101 | 69715.2 | 0.3 | 0.17 | 5 | 8.0 | 0.07 | 15 | 5.0 | 0.13 | 4 |
| WYM11 | 69638.1 | 0.3 | 0.07 | 10 | 8.2 | 0.05 | 17 | 5.1 | 0.08 | 7 |
| WYM99 | 70016.2 | 0.3 | 0.30 | 3 | 7.4 | 0.20 | 6 | — | — | — |
| WYM84 | 69864.1 | — | — | — | 8.6 | 0.05 | 24 | 5.2 | 0.04 | 9 |
| CONT. | — | 0.3 | — | — | 7.0 | — | — | 4.8 | — | — |
| LNU74_H109 | 69483.5 | — | — | — | 7.4 | 0.28 | 5 | 4.7 | 0.15 | 2 |
| WYM101 | 69715.1 | 0.3 | 0.07 | 11 | — | — | — | — | — | — |
| WYM99 | 70017.4 | — | — | — | 8.8 | 0.06 | 24 | 5.2 | 0.03 | 13 |
| WYM108 | 69635.2 | 0.3 | 0.20 | 8 | — | — | — | — | — | — |
| WYM109 | 69718.2 | 0.3 | 0.10 | 9 | — | — | — | 4.8 | 0.17 | 4 |
| CONT. | — | 0.3 | — | — | 7.1 | — | — | 4.6 | — | — |

Table 58. "CONT."—Control;
"Ave."—Average;
"% Incr" = % increment;
"p-val."—p-value,
L—p < 0.01.

TABLE 59

Genes showing improved plant performance at normal growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| WYM7 | 71169.2 | — | — | — | 25.6 | L | 43 |
| WYM52 | 71461.6 | 266.5 | 0.13 | 28 | 18.7 | 0.22 | 4 |
| WYM95 | 70181.6 | — | — | — | 18.5 | 0.28 | 4 |
| CONT. | — | 208.8 | — | — | 17.9 | — | — |
| WYM47 | 69684.1 | — | — | — | 21.3 | 0.20 | 9 |
| WYM17 | 71315.4 | — | — | — | 22.3 | 0.02 | 14 |
| CONT. | — | 240.5 | — | — | 19.5 | — | — |
| WYM52 | 71465.5 | — | — | — | 21.4 | L | 14 |
| CONT. | — | 213.9 | — | — | 18.8 | — | — |
| WYM52 | 71463.4 | 186.2 | 0.23 | 19 | 19.2 | 0.28 | 4 |
| WYM110 | 71445.6 | 183.8 | 0.14 | 18 | — | — | — |
| WYM44 | 71321.3 | 198.0 | 0.04 | 27 | — | — | — |
| WYM77 | 70948.2 | 208.0 | 0.05 | 33 | — | — | — |
| WYM26 | 71623.2 | 212.5 | 0.01 | 36 | — | — | — |
| WYM80 | 69994.2 | 218.8 | 0.04 | 40 | — | — | — |
| WYM110 | 71443.6 | 221.4 | 0.06 | 42 | 18.9 | 0.12 | 2 |
| WYM17 | 71313.6 | 193.9 | 0.14 | 24 | — | — | — |
| CONT. | — | 156.4 | — | — | 18.5 | — | — |
| WYM110 | 71443.5 | — | — | — | 18.8 | 0.10 | 7 |
| WYM52 | 71461.2 | 183.1 | 0.25 | 8 | — | — | — |
| WYM77 | 70947.1 | — | — | — | 22.3 | L | 26 |
| WYM7 | 71168.1 | 184.7 | 0.19 | 8 | — | — | — |
| WYM106 | 71685.3 | 197.1 | 0.03 | 16 | — | — | — |
| CONT. | — | 170.3 | — | — | 17.7 | — | — |
| WYM47 | 69685.1 | 220.5 | 0.02 | 43 | — | — | — |
| WYM95 | 70181.1 | 180.8 | 0.18 | 17 | — | — | — |
| WYM95 | 70183.2 | 194.3 | 0.07 | 26 | 23.3 | 0.03 | 18 |
| WYM47 | 69683.3 | 193.2 | 0.04 | 25 | — | — | — |
| WYM80 | 69994.4 | — | — | — | 21.6 | 0.13 | 10 |
| WYM95 | 70181.3 | 178.6 | 0.14 | 16 | — | — | — |
| WYM26 | 71622.3 | 199.0 | 0.03 | 29 | 21.5 | 0.10 | 9 |
| WYM77 | 70949.1 | 167.7 | 0.24 | 9 | — | — | — |
| CONT. | — | 154.5 | — | — | 19.8 | — | — |
| WYM47 | 69682.4 | — | — | — | 31.1 | L | 62 |
| WYM47 | 69683.5 | — | — | — | 20.9 | 0.15 | 9 |
| CONT. | — | 185.7 | — | — | 19.2 | — | — |
| WYM26 | 71627.4 | — | — | — | 22.4 | L | 17 |
| WYM77 | 70949.3 | 187.4 | 0.02 | 20 | — | — | — |
| WYM110 | 71443.1 | 164.5 | 0.26 | 5 | — | — | — |
| WYM106 | 71685.2 | 166.0 | 0.28 | 6 | 19.8 | 0.17 | 4 |
| CONT. | — | 155.9 | — | — | 19.0 | — | — |
| WYM95 | 70182.5 | 182.0 | 0.04 | 24 | — | — | — |
| WYM17 | 71316.2 | 165.5 | 0.07 | 13 | — | — | — |
| WYM47 | 69685.5 | 169.9 | 0.21 | 16 | — | — | — |
| WYM26 | 71623.1 | — | — | — | 20.0 | 0.12 | 9 |
| WYM95 | 70178.1 | 173.8 | 0.06 | 19 | — | — | — |
| WYM80 | 69993.2 | 204.3 | 0.04 | 40 | — | — | — |
| WYM95 | 70182.3 | 152.0 | 0.21 | 4 | — | — | — |
| WYM17 | 71313.9 | 193.5 | 0.08 | 32 | — | — | — |
| CONT. | — | 146.2 | — | — | 18.4 | — | — |
| WYM110 | 71442.5 | — | — | — | 20.6 | 0.02 | 9 |
| CONT. | — | 178.8 | — | — | 18.9 | — | — |
| WYM52 | 71463.6 | 271.3 | 0.27 | 16 | — | — | — |
| WYM106 | 71685.6 | — | — | — | 20.1 | 0.08 | 8 |
| WYM80 | 69994.3 | — | — | — | 19.4 | 0.24 | 5 |
| WYM17 | 71314.4 | — | — | — | 22.0 | 0.19 | 19 |
| CONT. | — | 233.2 | — | — | 18.5 | — | — |
| WYM52 | 71465.2 | 270.0 | 0.04 | 16 | — | — | — |
| WYM52 | 71465.4 | 247.3 | 0.18 | 7 | — | — | — |
| WYM110 | 71445.1 | — | — | — | 20.5 | 0.03 | 10 |
| WYM44 | 71321.5 | 279.9 | 0.07 | 21 | — | — | — |
| WYM44 | 71317.8 | 249.4 | 0.17 | 8 | — | — | — |
| CONT. | — | 231.9 | — | — | 18.7 | — | — |
| WYM95 | 70181.2 | 245.9 | 0.21 | 14 | — | — | — |
| WYM17 | 71315.2 | — | — | — | 21.9 | 0.05 | 12 |
| CONT. | — | 215.5 | — | — | 19.5 | — | — |
| WYM26 | 71626.4 | 278.2 | 0.06 | 27 | — | — | — |
| WYM47 | 69684.3 | 267.9 | 0.13 | 22 | — | — | — |
| WYM77 | 70948.4 | — | — | — | 30.6 | L | 59 |
| CONT. | — | 218.9 | — | — | 19.3 | — | — |
| WYM13 | 69646.1 | — | — | — | 21.6 | L | 17 |
| WYM98 | 70008.2 | 168.7 | 0.07 | 9 | 19.3 | 0.16 | 5 |
| LNU74_H109 | 69484.1 | 166.9 | 0.22 | 8 | 19.9 | 0.03 | 8 |
| WYM99 | 70020.4 | 164.9 | 0.23 | 6 | — | — | — |
| WYM109 | 69717.2 | 163.3 | 0.30 | 5 | — | — | — |
| WYM108 | 69633.1 | 169.5 | 0.29 | 9 | 19.9 | 0.13 | 8 |
| WYM4 | 69736.6 | 160.9 | 0.24 | 4 | — | — | — |
| CONT. | — | 155.2 | — | — | 18.4 | — | — |
| WYM13 | 69645.2 | — | — | — | 22.7 | 0.04 | 10 |
| WYM99 | 70016.8 | 214.1 | 0.22 | 8 | — | — | — |
| WYM109 | 69716.3 | 238.0 | 0.17 | 20 | — | — | — |
| WYM100 | 69872.5 | 219.1 | 0.17 | 11 | — | — | — |
| CONT. | — | 197.7 | — | — | 20.6 | — | — |
| WYM98 | 70005.2 | 181.7 | 0.15 | 7 | — | — | — |
| WYM4 | 69737.5 | — | — | — | 19.5 | 0.03 | 3 |
| LNU74_H109 | 69483.4 | 205.1 | 0.07 | 21 | 21.1 | 0.03 | 12 |
| CONT. | — | 169.3 | — | — | 18.9 | — | — |
| WYM4 | 69739.2 | 174.8 | 0.12 | 13 | — | — | — |
| LNU74_H109 | 69482.1 | 195.7 | 0.01 | 27 | — | — | — |
| LNU74_H109 | 69482.2 | 179.0 | 0.03 | 16 | — | — | — |
| WYM100 | 69874.5 | 182.4 | 0.06 | 18 | — | — | — |
| WYM98 | 70008.4 | 168.6 | 0.24 | 9 | — | — | — |
| WYM99 | 70020.1 | 169.1 | 0.11 | 10 | — | — | — |
| CONT. | — | 154.4 | — | — | 18.9 | — | — |
| WYM99 | 70016.3 | 171.5 | 0.20 | 8 | — | — | — |
| WYM109 | 69717.3 | — | — | — | 20.4 | 0.16 | 7 |
| WYM84 | 69864.5 | 167.8 | 0.23 | 6 | — | — | — |
| CONT. | — | 158.1 | — | — | 19.1 | — | — |
| WYM108 | 69634.2 | — | — | — | 19.5 | 0.24 | 5 |
| WYM84 | 69860.2 | 171.4 | 0.10 | 12 | — | — | — |
| WYM13 | 69645.5 | 185.5 | 0.02 | 21 | — | — | — |
| WYM13 | 69647.1 | 197.9 | L | 29 | — | — | — |
| CONT. | — | 152.9 | — | — | 18.6 | — | — |
| LNU74_H109 | 69483.5 | — | — | — | 22.2 | L | 14 |
| WYM99 | 70017.4 | — | — | — | 21.0 | 0.06 | 8 |
| LNU74_H109 | 69485.2 | — | — | — | 21.4 | 0.07 | 10 |
| CONT. | — | 189.6 | — | — | 19.4 | — | — |
| WYM11 | 69638.1 | 202.2 | 0.23 | 9 | 27.0 | 0.28 | 21 |
| WYM99 | 70016.9 | 198.3 | 0.30 | 7 | — | — | — |
| WYM109 | 69719.2 | 210.1 | 0.15 | 13 | — | — | — |
| CONT. | — | 185.9 | — | — | 22.2 | — | — |
| WYM101 | 69715.3 | 191.0 | 0.29 | 11 | — | — | — |
| WYM11 | 69642.2 | 184.9 | 0.29 | 7 | — | — | — |
| WYM11 | 69639.9 | — | — | — | 22.1 | L | 14 |
| WYM84 | 69860.1 | — | — | — | 22.0 | L | 14 |
| CONT. | — | 172.5 | — | — | 19.4 | — | — |
| WYM13 | 69644.2 | 160.0 | 0.13 | 7 | — | — | — |
| WYM98 | 70008.1 | 162.6 | 0.05 | 9 | — | — | — |
| WYM101 | 69715.5 | 163.8 | 0.12 | 10 | 22.6 | L | 14 |
| WYM84 | 69864.2 | 164.5 | 0.09 | 10 | — | — | — |
| WYM98 | 70005.3 | 164.7 | 0.10 | 10 | — | — | — |
| WYM84 | 69860.6 | 172.4 | 0.08 | 16 | — | — | — |
| WYM13 | 69647.9 | 162.4 | 0.06 | 9 | — | — | — |
| WYM100 | 69875.3 | 163.2 | 0.12 | 9 | — | — | — |
| CONT. | — | 149.1 | — | — | 19.8 | — | — |
| WYM98 | 70008.3 | 178.4 | 0.15 | 13 | — | — | — |
| WYM109 | 69716.1 | 177.6 | 0.22 | 13 | — | — | — |
| WYM4 | 69735.3 | 183.3 | 0.10 | 17 | — | — | — |
| WYM101 | 69710.2 | 189.1 | 0.06 | 20 | — | — | — |
| LNU74_H109 | 69483.3 | 196.5 | 0.06 | 25 | 21.8 | 0.05 | 14 |
| WYM108 | 69636.5 | 189.3 | 0.07 | 20 | — | — | — |
| WYM101 | 69712.2 | 171.9 | 0.24 | 9 | 19.5 | 0.21 | 2 |
| CONT. | — | 157.2 | — | — | 19.2 | — | — |
| WYM109 | 69716.4 | 182.2 | 0.24 | 5 | — | — | — |
| WYM98 | 70009.3 | — | — | — | 22.0 | 0.11 | 9 |
| WYM11 | 69641.1 | 186.4 | 0.06 | 8 | — | — | — |
| WYM99 | 70017.5 | — | — | — | 30.6 | L | 51 |
| CONT. | — | 172.8 | — | — | 20.3 | — | — |
| WYM99 | 70016.10 | — | — | — | 22.2 | L | 18 |
| CONT. | — | 242.4 | — | — | 18.9 | — | — |
| WYM109 | 69720.7 | — | — | — | 20.6 | 0.04 | 8 |
| WYM101 | 69715.8 | 191.4 | 0.18 | 9 | — | — | — |

TABLE 59-continued

Genes showing improved plant performance at normal growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| WYM108 | 69636.6 | 189.6 | 0.17 | 8 | — | — | — |
| WYM4 | 69737.8 | 191.0 | 0.15 | 8 | — | — | — |
| CONT. | — | 176.3 | — | — | 19.2 | — | — |
| WYM37 | 70942.5 | 206.7 | 0.04 | 15 | 18.5 | 0.02 | 6 |
| WYM57 | 69515.1 | 190.9 | 0.27 | 6 | — | — | — |
| WYM27 | 69935.4 | 195.4 | 0.14 | 9 | 18.7 | L | 7 |
| WYM58 | 69960.7 | 200.9 | 0.12 | 12 | — | — | — |
| WYM57 | 69513.8 | — | — | — | 17.8 | 0.25 | 2 |
| CONT. | — | 179.7 | — | — | 17.5 | — | — |
| WYM37 | 70944.8 | 180.4 | 0.10 | 15 | — | — | — |
| WYM63 | 69980.3 | 175.8 | 0.08 | 12 | — | — | — |
| WYM92 | 70000.5 | 187.2 | 0.02 | 20 | 21.6 | L | 20 |
| WYM58 | 69961.10 | 181.6 | 0.03 | 16 | — | — | — |
| WYM63 | 69983.2 | 187.5 | 0.03 | 20 | — | — | — |
| WYM60 | 69869.2 | 183.5 | 0.03 | 17 | — | — | — |
| WYM58 | 69960.2 | 176.2 | 0.08 | 13 | 19.5 | L | 8 |
| WYM51 | 69950.1 | 194.0 | L | 24 | 20.3 | 0.02 | 12 |
| CONT. | — | 156.5 | — | — | 18.1 | — | — |
| WYM63 | 69982.1 | — | — | — | 17.9 | 0.19 | 2 |
| CONT. | — | 178.6 | — | — | 17.5 | — | — |
| LYM90 | 69388.2 | 175.0 | 0.06 | 16 | 18.1 | 0.30 | 3 |
| WYM60 | 69867.3 | 197.1 | 0.01 | 31 | — | — | — |
| WYM27 | 69937.1 | 170.1 | 0.15 | 13 | — | — | — |
| LYM90 | 69389.6 | 169.2 | 0.16 | 12 | — | — | — |
| WYM37 | 70939.4 | 178.4 | 0.08 | 18 | — | — | — |
| WYM57 | 69514.3 | 173.2 | 0.20 | 15 | — | — | — |
| WYM57 | 69513.3 | 172.4 | 0.14 | 14 | 19.0 | 0.09 | 8 |
| CONT. | — | 151.0 | — | — | 17.7 | — | — |
| WYM51 | 69954.7 | — | — | — | 18.7 | 0.06 | 4 |
| WYM37 | 70944.2 | 176.7 | 0.17 | 6 | — | — | — |
| CONT. | — | 166.6 | — | — | 18.0 | — | — |
| WYM60 | 69870.2 | 197.2 | 0.21 | 8 | — | — | — |
| WYM57 | 69512.7 | 197.0 | 0.05 | 8 | — | — | — |
| WYM27 | 69935.2 | 206.3 | 0.16 | 13 | — | — | — |
| CONT. | — | 182.3 | — | — | 18.2 | — | — |
| WYM37 | 70942.6 | 253.7 | 0.04 | 29 | — | — | — |
| WYM57 | 69514.2 | 216.5 | 0.17 | 10 | 21.0 | 0.05 | 12 |
| WYM66 | 70176.2 | 224.2 | 0.11 | 14 | — | — | — |
| WYM92 | 70000.3 | 236.2 | 0.09 | 21 | — | — | — |
| WYM60 | 69867.2 | 281.5 | 0.02 | 44 | 19.2 | 0.13 | 3 |
| WYM60 | 69870.3 | 229.0 | 0.12 | 17 | — | — | — |
| CONT. | — | 196.0 | — | — | 18.7 | — | — |
| WYM57 | 69515.4 | — | — | — | 19.0 | 0.08 | 6 |
| WYM33 | 69942.1 | 210.6 | 0.01 | 18 | 20.5 | 0.05 | 14 |
| WYM57 | 69517.1 | — | — | — | 21.9 | L | 22 |
| WYM60 | 69868.5 | 197.9 | 0.04 | 11 | — | — | — |
| WYM27 | 69935.9 | 217.9 | 0.03 | 22 | — | — | — |
| WYM66 | 70174.4 | 191.8 | 0.28 | 8 | — | — | — |
| WYM33 | 69942.2 | 209.4 | 0.07 | 18 | 18.9 | 0.06 | 5 |
| CONT. | — | 178.0 | — | — | 18.0 | — | — |
| WYM63 | 69982.4 | 191.5 | 0.06 | 7 | — | — | — |
| WYM92 | 70003.1 | 184.7 | 0.21 | 3 | — | — | — |
| WYM60 | 69870.8 | — | — | — | 18.8 | 0.17 | 3 |
| CONT. | — | 179.1 | — | — | 18.2 | — | — |
| LYM90 | 69386.3 | 258.2 | 0.01 | 15 | — | — | — |
| WYM27 | 69936.1 | 241.9 | 0.22 | 8 | 19.2 | 0.17 | 8 |
| LYM90 | 69388.4 | 239.7 | 0.21 | 7 | 18.4 | 0.26 | 4 |
| WYM33 | 69939.1 | 242.6 | 0.13 | 8 | 19.7 | 0.04 | 10 |
| WYM57 | 69512.2 | 258.7 | 0.12 | 16 | — | — | — |
| WYM66 | 70175.4 | 273.9 | L | 22 | — | — | — |
| CONT. | — | 223.7 | — | — | 17.8 | — | — |
| WYM60 | 69869.3 | — | — | — | 21.9 | 0.03 | 16 |
| CONT. | — | 178.6 | — | — | 18.9 | — | — |
| WYM60 | 69870.5 | — | — | — | 20.9 | 0.05 | 11 |
| WYM58 | 69960.1 | — | — | — | 20.6 | 0.02 | 10 |
| CONT. | — | 225.9 | — | — | 18.8 | — | — |
| WYM33 | 69943.2 | 198.2 | 0.21 | 8 | — | — | — |
| LYM90 | 69388.5 | — | — | — | 21.5 | 0.02 | 18 |
| WYM51 | 69950.3 | 189.4 | 0.29 | 3 | — | — | — |
| CONT. | — | 183.9 | — | — | 18.2 | — | — |
| LYM90 | 69389.3 | 197.1 | 0.25 | 5 | — | — | — |
| WYM66 | 70177.7 | — | — | — | 18.1 | 0.28 | 2 |
| CONT. | — | 188.3 | — | — | 17.8 | — | — |

Table 59. "CONT."—Control;
"Ave."—Average;
"% Incr" = % increment;
"p-val."—p-value,
L—p < 0.01.

Example 19

Evaluation of Transgenic *Arabidopsis* for Seed Yield and Plant Growth Rate Under Normal Conditions in Greenhouse Assays Until Bolting (GH-SB Assays)

Assay 2: Plant Performance Improvement Measured Until Bolting Stage: Plant Biomass and Plant Growth Rate Under Normal Greenhouse Conditions (GH-SB Assays)

This assay follows the plant biomass formation and the rosette area growth of plants grown in the greenhouse under normal growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing of 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until bolting stage. Plant biomass (the above ground tissue) was weight in directly after harvesting the rosette (plant fresh weight [FW]). Following plants were dried in an oven at 50° C. for 48 hours and weighted (plant dry weight [DW]).

Each construct was validated at its $T_2$ generation. Transgenic plants transformed with a construct conformed by an empty vector carrying the 35S promoter and the selectable marker were used as control.

The plants were analyzed for their overall size, growth rate, fresh weight and dry matter. Transgenic plants performance was compared to control plants grown in parallel under the same conditions. Mock—transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital Imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf Analysis—Using the digital analysis leaves data was and is calculated, including leaf number, rosette area, rosette diameter, and leaf blade area.

Vegetative Growth Rate: the relative growth rate (GR) of leaf number (Formula IX, described above), rosette area (Formula XIX described above) and plot coverage (Formula XX, described above) were calculated using the indicated formulas.

Plant Fresh and Dry Weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical Analyses—To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Experimental Results:

Tables 60-62 summarize the observed phenotypes of transgenic plants expressing the genes constructs using the GH-SB Assays.

The genes listed in Tables 60-62 improved plant performance when grown at normal conditions. These genes produced larger plants with a larger photosynthetic area, biomass (fresh weight, dry weight, leaf number, rosette diameter, and rosette area), and growth rate. The genes were cloned under the regulation of a constitutive At6669 promoter (SEQ ID NO:9405). The evaluation of each gene was performed by testing the performance of different number of events. Event with p-value<0.1 was considered statistically significant.

TABLE 60

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LAB259 | 69401.8 | 70.0 | 0.06 | 17 | 836.9 | 0.01 | 18 | 10.0 | 0.01 | 9 |
| WYM18 | 70938.3 | 73.4 | 0.02 | 22 | 923.2 | L | 30 | 9.7 | 0.02 | 6 |
| WYM86 | 70919.5 | 69.5 | 0.07 | 16 | — | — | — | 9.4 | 0.26 | 2 |
| WYM30 | 69672.2 | 74.1 | 0.05 | 23 | 888.7 | L | 25 | 10.0 | 0.05 | 8 |
| WYM83 | 70956.7 | 69.2 | 0.06 | 15 | 837.5 | 0.08 | 18 | 9.6 | 0.11 | 5 |
| WYM83 | 70953.1 | 79.2 | 0.02 | 32 | 912.5 | 0.01 | 28 | 10.7 | L | 16 |
| WYM105 | 70931.3 | 63.4 | 0.26 | 6 | 776.8 | 0.28 | 9 | 9.5 | 0.13 | 3 |
| WYM83 | 70955.6 | — | — | — | — | — | — | 9.6 | 0.04 | 4 |
| CONT. | — | 60.0 | — | — | 711.5 | — | — | 9.2 | — | — |
| WYM48 | 69972.5 | 61.9 | 0.04 | 26 | 711.9 | 0.07 | 19 | 9.9 | L | 8 |
| WYM86 | 70917.3 | 73.7 | 0.02 | 50 | 861.9 | 0.04 | 44 | 10.0 | 0.01 | 10 |
| WYM32 | 70412.2 | 63.0 | 0.11 | 28 | 663.7 | 0.25 | 11 | — | — | — |
| LAB259 | 69400.1 | 65.0 | 0.02 | 32 | 700.0 | 0.07 | 17 | 9.4 | 0.02 | 3 |
| WYM30 | 69668.2 | — | — | — | 650.0 | 0.27 | 8 | — | — | — |
| LYM91 | 69394.5 | 52.8 | 0.28 | 7 | — | — | — | — | — | — |
| CONT. | — | 49.2 | — | — | 600.6 | — | — | 9.1 | — | — |
| WYM61 | 69974.2 | 80.8 | 0.01 | 31 | 850.6 | 0.05 | 18 | — | — | — |
| WYM83 | 70951.3 | 70.0 | 0.13 | 14 | 776.2 | 0.25 | 7 | — | — | — |
| WYM86 | 70918.6 | 70.9 | 0.03 | 15 | 900.0 | L | 24 | 10.1 | 0.11 | 6 |
| WYM105 | 70930.2 | 69.0 | 0.14 | 12 | 819.0 | 0.04 | 13 | — | — | — |
| WYM32 | 70415.2 | 72.1 | 0.04 | 17 | 787.5 | 0.07 | 9 | — | — | — |
| WYM18 | 70938.6 | 80.0 | L | 30 | 895.8 | L | 24 | 9.8 | 0.30 | 2 |
| WYM83 | 70951.4 | 82.5 | L | 34 | 950.0 | L | 31 | 10.4 | 0.10 | 8 |
| CONT. | — | 61.6 | — | — | 723.2 | — | — | 9.6 | — | — |
| WYM86 | 70919.2 | 66.7 | 0.02 | 24 | 758.3 | 0.03 | 18 | — | — | — |
| WYM61 | 69978.1 | 56.2 | 0.29 | 4 | 710.1 | 0.03 | 11 | — | — | — |
| WYM87 | 70960.8 | 63.1 | 0.09 | 17 | 781.5 | L | 22 | 9.7 | 0.17 | 4 |
| WYM32 | 70414.3 | 69.5 | L | 29 | 809.5 | L | 26 | 10.0 | 0.04 | 7 |
| WYM32 | 70413.2 | 70.9 | 0.06 | 32 | 791.7 | 0.01 | 23 | 9.6 | 0.22 | 3 |
| WYM83 | 70956.5 | 62.1 | 0.09 | 15 | 766.7 | 0.09 | 19 | — | — | — |
| WYM30 | 69672.4 | 68.2 | 0.14 | 27 | 798.8 | 0.02 | 24 | 10.0 | 0.04 | 7 |
| LYM91 | 69395.2 | 58.8 | 0.06 | 9 | 834.5 | 0.02 | 30 | — | — | — |
| CONT. | — | 53.9 | — | — | 641.7 | — | — | 9.3 | — | — |
| WYM18 | 70938.7 | 87.5 | 0.19 | 12 | 1179.2 | 0.07 | 15 | 10.9 | 0.03 | 8 |
| WYM87 | 70960.3 | — | — | — | 1091.7 | 0.17 | 7 | — | — | — |
| WYM32 | 70416.3 | — | — | — | — | — | — | 11.0 | 0.06 | 9 |
| CONT. | — | 77.9 | — | — | 1025.0 | — | — | 10.1 | — | — |
| WYM105 | 70932.10 | 60.7 | 0.07 | 20 | 617.9 | 0.07 | 14 | — | — | — |
| WYM105 | 70932.9 | 56.3 | 0.16 | 12 | 608.3 | 0.09 | 12 | — | — | — |
| LYM91 | 69395.1 | — | — | — | 583.3 | 0.28 | 8 | — | — | — |

TABLE 60-continued

Genes showing improved plant performance at normal growth conditions under regulation of At6669 promoter

| | | Dry Weight [mg] | | | Fresh Weight [mg] | | | Leaf Number | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| WYM87 | 70961.7 | 54.4 | 0.07 | 8 | 605.6 | 0.10 | 12 | — | — | — |
| WYM105 | 70930.1 | 57.5 | 0.06 | 14 | 616.7 | 0.07 | 14 | — | — | — |
| WYM30 | 69672.1 | — | — | — | 591.7 | 0.16 | 9 | — | — | — |
| LAB259 | 69401.1 | 61.3 | 0.03 | 21 | 650.0 | 0.03 | 20 | — | — | — |
| CONT. | — | 50.5 | — | — | 541.5 | — | — | 9.8 | — | — |
| WYM32 | 70417.1 | 66.7 | L | 13 | 804.2 | L | 11 | 9.8 | L | 8 |
| WYM61 | 69978.3 | — | — | — | 748.4 | 0.22 | 4 | 9.4 | 0.23 | 4 |
| WYM86 | 70919.1 | — | — | — | — | — | — | 9.3 | 0.10 | 3 |
| WYM83 | 70953.2 | 65.7 | 0.19 | 12 | — | — | — | 9.7 | 0.09 | 7 |
| WYM83 | 70956.1 | 62.7 | 0.27 | 7 | 774.4 | 0.03 | 7 | 9.3 | L | 3 |
| WYM86 | 70920.1 | 67.5 | L | 15 | 856.9 | 0.01 | 19 | 9.5 | 0.06 | 5 |
| CONT. | — | 58.9 | — | — | 721.4 | — | — | 9.0 | — | — |
| WYM48 | 69972.3 | 71.3 | 0.04 | 15 | 912.5 | 0.13 | 8 | 10.0 | 0.26 | 3 |
| LYM91 | 69392.6 | 75.2 | 0.08 | 21 | 952.4 | 0.13 | 13 | — | — | — |
| WYM18 | 70936.3 | 67.1 | 0.14 | 8 | — | — | — | — | — | — |
| WYM48 | 69968.1 | 80.0 | L | 29 | 987.5 | 0.02 | 17 | 10.3 | 0.14 | 6 |
| LAB259 | 69399.7 | 73.8 | 0.02 | 19 | 979.2 | 0.04 | 16 | 10.0 | 0.21 | 3 |
| LAB259 | 69401.6 | 73.8 | 0.02 | 19 | 987.5 | 0.03 | 17 | 10.3 | 0.17 | 6 |
| CONT. | — | 62.0 | — | — | 845.5 | — | — | 9.8 | — | — |
| WYM48 | 69968.4 | 86.3 | L | 28 | 883.9 | 0.02 | 25 | 10.1 | 0.19 | 5 |
| WYM32 | 70415.3 | 80.4 | 0.02 | 19 | 829.2 | 0.06 | 17 | 10.0 | 0.24 | 3 |
| WYM18 | 70937.6 | — | — | — | 779.2 | 0.27 | 10 | — | — | — |
| WYM48 | 69973.4 | — | — | — | — | — | — | 10.0 | 0.22 | 4 |
| CONT. | — | 67.5 | — | — | 706.5 | — | — | 9.6 | — | — |
| WYM18 | 70937.3 | 77.5 | 0.04 | 17 | 858.3 | 0.16 | 6 | 10.5 | 0.11 | 5 |
| WYM32 | 70416.11 | 87.4 | 0.02 | 32 | 1097.0 | 0.01 | 35 | 11.0 | 0.04 | 9 |
| WYM30 | 69670.3 | 73.4 | 0.13 | 11 | — | — | — | — | — | — |
| WYM83 | 70952.1 | 70.9 | 0.21 | 7 | — | — | — | — | — | — |
| WYM61 | 69978.2 | 79.1 | 0.06 | 20 | 947.6 | 0.14 | 17 | — | — | — |
| WYM18 | 70938.5 | 80.8 | 0.08 | 22 | 945.2 | 0.10 | 16 | 10.5 | 0.10 | 5 |
| WYM61 | 69974.1 | 70.0 | 0.19 | 6 | — | — | — | — | — | — |
| WYM87 | 70962.4 | 72.7 | 0.16 | 10 | — | — | — | — | — | — |
| CONT. | — | 66.1 | — | — | 813.0 | — | — | 10.1 | — | — |
| WYM105 | 70931.1 | 74.6 | 0.27 | 9 | 945.8 | 0.24 | 12 | — | — | — |
| WYM48 | 69970.4 | 78.1 | 0.10 | 15 | 981.0 | 0.13 | 16 | — | — | — |
| LAB259 | 69402.1 | 73.4 | 0.20 | 8 | 948.4 | 0.11 | 12 | — | — | — |
| LYM91 | 69395.3 | 89.8 | L | 32 | 1130.9 | 0.01 | 33 | 10.3 | 0.11 | 4 |
| WYM32 | 70416.4 | — | — | — | 887.5 | 0.29 | 5 | — | — | — |
| WYM87 | 70962.5 | 83.0 | 0.02 | 22 | 1107.1 | 0.01 | 31 | 10.7 | 0.06 | 8 |
| WYM61 | 69979.4 | 82.5 | 0.08 | 21 | 1070.8 | 0.03 | 26 | 10.2 | 0.26 | 3 |
| WYM87 | 70960.2 | 78.6 | 0.05 | 15 | 968.5 | 0.11 | 14 | — | — | — |
| CONT. | — | 68.2 | — | — | 848.2 | — | — | 9.9 | — | — |
| WYM83 | 70956.4 | 64.6 | 0.11 | 10 | 675.0 | 0.19 | 6 | — | — | — |
| WYM86 | 70917.2 | 66.2 | 0.04 | 13 | 704.8 | L | 10 | 9.5 | 0.24 | 2 |
| WYM61 | 69977.1 | — | — | — | — | — | — | 9.8 | 0.23 | 4 |
| WYM30 | 69670.2 | — | — | — | 679.8 | 0.10 | 7 | 9.6 | 0.20 | 3 |
| LAB259 | 69399.6 | 74.2 | L | 27 | 833.3 | L | 31 | 9.9 | 0.10 | 6 |
| WYM61 | 69977.4 | 67.5 | 0.05 | 15 | 747.6 | L | 17 | — | — | — |
| WYM30 | 69670.1 | 72.1 | L | 23 | 812.5 | L | 27 | 10.2 | 0.02 | 9 |
| LYM91 | 69394.2 | 60.9 | 0.19 | 4 | 683.3 | 0.07 | 7 | — | — | — |
| CONT. | — | 58.6 | — | — | 637.9 | — | — | 9.3 | — | — |
| WYM105 | 70928.2 | 69.0 | 0.01 | 17 | 769.0 | 0.01 | 22 | 9.9 | 0.09 | 6 |
| WYM18 | 70936.4 | — | — | — | — | — | — | 9.7 | 0.21 | 4 |
| WYM86 | 70917.1 | — | — | — | — | — | — | 9.7 | 0.22 | 4 |
| WYM86 | 70918.7 | 64.6 | 0.07 | 9 | 929.2 | 0.13 | 48 | 9.8 | 0.16 | 5 |
| LAB259 | 69403.2 | 62.6 | 0.27 | 6 | 715.5 | 0.09 | 14 | 10.1 | 0.15 | 9 |
| WYM61 | 69977.3 | — | — | — | 670.2 | 0.26 | 7 | — | — | — |
| WYM18 | 70937.11 | 71.7 | L | 21 | 812.5 | L | 29 | 9.8 | 0.17 | 5 |
| CONT. | — | 59.1 | — | — | 628.1 | — | — | 9.3 | — | — |
| WYM48 | 69973.1 | 63.4 | 0.24 | 10 | 800.0 | 0.16 | 10 | 10.0 | 0.04 | 10 |
| WYM87 | 70962.2 | — | — | — | 768.1 | 0.24 | 5 | 9.3 | 0.07 | 3 |
| WYM86 | 70920.4 | — | — | — | — | — | — | 10.0 | 0.02 | 11 |
| LYM91 | 69392.2 | — | — | — | — | — | — | 9.6 | 0.04 | 6 |
| WYM48 | 69973.5 | 60.9 | 0.26 | 6 | 812.5 | 0.08 | 12 | 9.8 | 0.02 | 8 |
| WYM32 | 70416.6 | — | — | — | — | — | — | 10.2 | L | 12 |
| LYM91 | 69392.4 | 64.2 | 0.14 | 12 | 820.8 | 0.09 | 13 | 9.8 | 0.02 | 8 |
| LYM91 | 69393.1 | — | — | — | — | — | — | 9.8 | L | 8 |
| CONT. | — | 57.6 | — | — | 728.1 | — | — | 9.1 | — | — |
| WYM62 | 71467.5 | — | — | — | — | — | — | 11.5 | 0.04 | 9 |
| LYM490_H1 | 71155.4 | 200.0 | 0.23 | 5 | 2829.2 | 0.24 | 4 | 11.3 | 0.08 | 7 |
| WYM46 | 71151.5 | — | — | — | 2825.0 | 0.14 | 4 | — | — | — |
| CONT. | — | 191.0 | — | — | 2709.4 | — | — | 10.6 | — | — |

TABLE 60-continued

Genes showing improved plant performance at normal growth conditions under regulation of At6669 promoter

| | | Dry Weight [mg] | | | Fresh Weight [mg] | | | Leaf Number | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| WYM28 | 71456.2 | 208.4 | 0.09 | 8 | — | — | — | — | — | — |
| WYM46 | 71154.6 | 229.2 | 0.03 | 18 | — | — | — | — | — | — |
| LYM490_H1 | 71158.3 | — | — | — | — | — | — | 10.6 | 0.03 | 7 |
| WYM96 | 71173.2 | — | — | — | — | — | — | 10.1 | 0.13 | 2 |
| WYM46 | 71150.5 | 206.3 | 0.25 | 6 | — | — | — | — | — | — |
| WYM71 | 72157.7 | 218.9 | 0.20 | 13 | — | — | — | — | — | — |
| CONT. | — | 193.8 | — | — | 2625.0 | — | — | 9.9 | — | — |
| WYM35 | 71163.1 | 172.9 | 0.27 | 2 | — | — | — | — | — | — |
| WYM90 | 71891.2 | 181.3 | 0.12 | 7 | 2550.0 | 0.07 | 6 | 10.4 | L | 5 |
| CONT. | — | 169.4 | — | — | 2406.3 | — | — | 9.9 | — | — |
| LYM490_H1 | 71157.1 | 188.3 | 0.11 | 6 | — | — | — | — | — | — |
| WYM46 | 71151.1 | 189.2 | 0.17 | 6 | 2366.7 | 0.17 | 4 | — | — | — |
| WYM21 | 71762.4 | 186.3 | 0.10 | 5 | — | — | — | — | — | — |
| WYM71 | 72158.1 | 188.8 | 0.08 | 6 | 2345.8 | 0.27 | 3 | 9.8 | 0.24 | 3 |
| CONT. | — | 178.0 | — | — | 2270.8 | — | — | 9.5 | — | — |
| WYM112 | 69928.3 | 171.7 | 0.01 | 14 | 2354.2 | 0.02 | 11 | 9.9 | 0.12 | 5 |
| LYM490_H1 | 71155.2 | 169.2 | L | 13 | 2416.7 | 0.01 | 14 | 10.3 | 0.01 | 10 |
| WYM34 | 71768.2 | 158.8 | 0.07 | 6 | 2254.2 | 0.08 | 7 | 9.9 | 0.06 | 6 |
| WYM90 | 71891.6 | — | — | — | — | — | — | 9.7 | 0.23 | 3 |
| WYM28 | 71457.6 | — | — | — | — | — | — | 9.8 | 0.13 | 4 |
| WYM34 | 71769.1 | 170.4 | L | 13 | 2520.8 | L | 19 | 10.0 | 0.07 | 6 |
| WYM28 | 71457.2 | 158.4 | 0.07 | 5 | 2187.5 | 0.23 | 4 | 9.6 | 0.21 | 3 |
| WYM71 | 72162.1 | 154.6 | 0.17 | 3 | 2254.2 | 0.08 | 7 | 9.6 | 0.26 | 3 |
| CONT. | — | 150.2 | — | — | 2113.0 | — | — | 9.4 | — | — |
| WYM35 | 71166.2 | 183.8 | 0.17 | 7 | 2675.0 | 0.11 | 5 | — | — | — |
| WYM71 | 72162.3 | 189.6 | 0.08 | 10 | 2620.8 | 0.23 | 3 | — | — | — |
| WYM71 | 72157.3 | 181.7 | 0.29 | 5 | — | — | — | 10.7 | 0.03 | 6 |
| CONT. | — | 172.5 | — | — | 2548.8 | — | — | 10.1 | — | — |
| WYM34 | 71767.6 | — | — | — | — | — | — | 9.9 | 0.30 | 1 |
| WYM96 | 71176.3 | — | — | — | — | — | — | 10.2 | 0.19 | 4 |
| WYM71 | 72157.10 | 199.2 | 0.11 | 5 | 2779.2 | 0.10 | 4 | 9.9 | 0.23 | 2 |
| CONT. | — | 190.0 | — | — | 2662.5 | — | — | 9.8 | — | — |
| WYM46 | 71150.6 | 187.1 | 0.06 | 7 | 2612.5 | 0.15 | 5 | 10.0 | 0.29 | 2 |
| WYM21 | 71763.3 | — | — | — | 2616.7 | 0.17 | 5 | 10.3 | 0.09 | 4 |
| CONT. | — | 174.5 | — | — | 2492.5 | — | — | 9.8 | — | — |
| WYM112 | 69931.2 | — | — | — | — | — | — | 10.2 | 0.07 | 3 |
| WYM35 | 71166.1 | 189.8 | 0.23 | 2 | 2578.6 | 0.20 | 2 | — | — | — |
| WYM62 | 71467.7 | — | — | — | — | — | — | 10.1 | 0.24 | 2 |
| WYM96 | 71178.1 | 190.0 | 0.23 | 2 | 2608.3 | 0.11 | 3 | — | — | — |
| WYM21 | 71761.1 | — | — | — | 2608.3 | 0.21 | 3 | 10.1 | 0.18 | 2 |
| WYM35 | 71161.1 | — | — | — | 2625.6 | 0.08 | 4 | — | — | — |
| CONT. | — | 186.0 | — | — | 2521.9 | — | — | 9.9 | — | — |
| WYM21 | 71762.6 | 183.4 | L | 10 | 2650.0 | L | 11 | — | — | — |
| WYM46 | 71149.5 | 170.4 | 0.22 | 2 | — | — | — | — | — | — |
| CONT. | — | 167.2 | — | — | 2397.9 | — | — | 10.2 | — | — |
| WYM96 | 71178.3 | — | — | — | 2504.2 | 0.12 | 7 | 10.6 | 0.02 | 8 |
| WYM90 | 71889.1 | 185.0 | 0.13 | 8 | 2683.3 | 0.02 | 14 | 10.5 | 0.03 | 7 |
| WYM112 | 69926.4 | — | — | — | — | — | — | 10.3 | 0.15 | 4 |
| CONT. | — | 171.9 | — | — | 2346.9 | — | — | 9.8 | — | — |
| WYM35 | 71162.9 | — | — | — | — | — | — | 10.0 | 0.12 | 3 |
| WYM90 | 71888.2 | 189.2 | 0.02 | 12 | 2587.5 | 0.04 | 9 | — | — | — |
| WYM112 | 69929.1 | — | — | — | — | — | — | 10.0 | 0.12 | 3 |
| CONT. | — | 169.1 | — | — | 2378.1 | — | — | 9.8 | — | — |
| LYM490_H1 | 71156.2 | — | — | — | — | — | — | 9.7 | 0.29 | 2 |
| WYM96 | 71174.1 | — | — | — | — | — | — | 10.0 | 0.06 | 6 |
| WYM96 | 71176.2 | — | — | — | — | — | — | 9.9 | 0.04 | 5 |
| WYM62 | 71466.2 | — | — | — | — | — | — | 9.8 | 0.15 | 3 |
| WYM90 | 71888.1 | 196.5 | 0.08 | 6 | 2648.8 | 0.06 | 6 | 10.2 | 0.03 | 8 |
| WYM71 | 72160.5 | — | — | — | — | — | — | 9.7 | 0.16 | 2 |
| CONT. | — | 185.3 | — | — | 2495.1 | — | — | 9.5 | — | — |
| WYM34 | 71766.6 | — | — | — | — | — | — | 10.0 | 0.17 | 3 |
| WYM71 | 72162.2 | — | — | — | — | — | — | 10.2 | 0.08 | 5 |
| WYM96 | 71173.3 | — | — | — | — | — | — | 10.2 | 0.06 | 5 |
| WYM28 | 71456.1 | — | — | — | — | — | — | 9.9 | 0.29 | 2 |
| WYM62 | 71466.4 | 222.5 | 0.25 | 5 | — | — | — | 10.0 | 0.18 | 4 |
| CONT. | — | 211.3 | — | — | 2660.0 | — | — | 9.7 | — | — |
| WYM79 | 69537.4 | 198.4 | 0.05 | 18 | 2808.3 | 0.08 | 14 | 9.7 | 0.06 | 8 |
| WYM70 | 70034.6 | 192.1 | 0.03 | 14 | 2612.5 | 0.27 | 6 | 9.9 | 0.05 | 10 |
| WYM79 | 69537.3 | 190.2 | 0.03 | 13 | 2542.9 | 0.19 | 3 | 9.5 | 0.20 | 6 |
| WYM24 | 69663.3 | 211.3 | L | 26 | 2979.2 | L | 21 | — | — | — |
| LYM320 | 69406.3 | 188.5 | L | 12 | 2567.9 | 0.24 | 4 | — | — | — |
| WYM79 | 69537.2 | 175.9 | 0.22 | 5 | — | — | — | — | — | — |

TABLE 60-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| WYM93 | 69690.2 | 182.1 | 0.08 | 8 | — | — | — | — | — | — |
| WYM94 | 69628.3 | 183.5 | 0.07 | 9 | 2535.1 | 0.25 | 3 | 9.3 | 0.19 | 3 |
| CONT. | — | 167.9 | — | — | 2466.7 | — | — | 9.0 | — | — |
| WYM24 | 69667.7 | 202.1 | 0.24 | 6 | — | — | — | 9.3 | 0.14 | 5 |
| WYM79 | 69536.2 | — | — | — | — | — | — | 9.3 | 0.01 | 5 |
| WYM15 | 69495.5 | — | — | — | — | — | — | 9.3 | 0.11 | 4 |
| WYM70 | 70034.2 | 204.2 | 0.19 | 7 | — | — | — | 9.4 | L | 6 |
| WYM31 | 69730.7 | — | — | — | — | — | — | 9.1 | 0.20 | 2 |
| CONT. | — | 190.5 | — | — | 2662.5 | — | — | 8.9 | — | — |
| WYM94 | 69629.2 | — | — | — | — | — | — | 9.3 | 0.17 | 3 |
| WYM15 | 69495.4 | — | — | — | 2708.3 | 0.28 | 3 | 9.1 | 0.28 | 1 |
| CONT. | — | 181.3 | — | — | 2634.4 | — | — | 9.0 | — | — |
| LYM320 | 69405.2 | — | — | — | — | — | — | 9.3 | 0.20 | 4 |
| WYM70 | 70038.4 | — | — | — | — | — | — | 9.4 | 0.21 | 5 |
| CONT. | — | 221.0 | — | — | 2490.6 | — | — | 9.0 | — | — |
| WYM31 | 69731.1 | 201.2 | 0.05 | 12 | 2769.0 | 0.06 | 16 | — | — | — |
| WYM94 | 69631.2 | 197.9 | 0.02 | 10 | 2666.7 | L | 12 | — | — | — |
| WYM31 | 69730.4 | 187.7 | 0.09 | 4 | 2523.8 | 0.10 | 6 | — | — | — |
| LYM320 | 69409.1 | 199.6 | L | 11 | 2704.2 | 0.01 | 13 | 9.3 | 0.21 | 3 |
| WYM65 | 69521.1 | 200.9 | 0.02 | 12 | 2891.7 | 0.03 | 21 | — | — | — |
| WYM65 | 69520.1 | — | — | — | 2420.8 | 0.30 | 2 | — | — | — |
| WYM70 | 70038.1 | 195.0 | L | 8 | 2695.8 | 0.02 | 13 | — | — | — |
| WYM31 | 69729.2 | 186.3 | 0.12 | 4 | 2562.5 | 0.02 | 7 | — | — | — |
| CONT. | — | 179.9 | — | — | 2383.9 | — | — | 9.1 | — | — |
| WYM55 | 69509.6 | 202.8 | 0.24 | 8 | 2512.5 | 0.17 | 10 | — | — | — |
| WYM15 | 69497.2 | — | — | — | — | — | — | 9.3 | 0.17 | 6 |
| WYM93 | 69686.1 | 203.8 | 0.22 | 8 | — | — | — | 9.3 | 0.05 | 6 |
| WYM15 | 69495.2 | — | — | — | — | — | — | 9.3 | 0.07 | 6 |
| WYM70 | 70039.2 | — | — | — | — | — | — | 9.1 | 0.14 | 3 |
| WYM79 | 69541.2 | — | — | — | — | — | — | 9.7 | L | 9 |
| WYM55 | 69509.5 | — | — | — | — | — | — | 9.0 | 0.14 | 2 |
| CONT. | — | 188.4 | — | — | 2287.5 | — | — | 8.8 | — | — |
| WYM22 | 69501.2 | — | — | — | 2762.5 | 0.19 | 25 | — | — | — |
| WYM93 | 69686.2 | 190.8 | 0.11 | 4 | 2566.7 | L | 16 | — | — | — |
| WYM70 | 70039.7 | 202.5 | 0.07 | 10 | 2641.7 | L | 19 | 9.4 | 0.08 | 6 |
| LYM320 | 69406.1 | — | — | — | — | — | — | 9.9 | 0.01 | 12 |
| WYM65 | 69519.5 | 196.3 | 0.11 | 7 | 2429.2 | 0.03 | 9 | 9.4 | 0.11 | 6 |
| WYM65 | 69520.4 | 203.8 | L | 11 | 2495.8 | 0.09 | 12 | 9.5 | 0.04 | 8 |
| CONT. | — | 183.5 | — | — | 2218.8 | — | — | 8.8 | — | — |
| WYM24 | 69664.1 | 177.5 | 0.29 | 3 | 2641.7 | 0.27 | 3 | 9.3 | 0.21 | 5 |
| WYM22 | 69501.5 | 184.2 | 0.05 | 7 | 2912.5 | L | 14 | — | — | — |
| WYM79 | 69540.2 | 187.1 | 0.07 | 9 | 2858.3 | 0.03 | 11 | 9.2 | 0.10 | 4 |
| WYM22 | 69504.6 | — | — | — | — | — | — | 9.0 | 0.26 | 3 |
| WYM93 | 69686.4 | — | — | — | — | — | — | 9.4 | 0.04 | 7 |
| CONT. | — | 171.6 | — | — | 2565.6 | — | — | 8.8 | — | — |
| WYM15 | 69498.1 | — | — | — | 2341.7 | 0.17 | 6 | — | — | — |
| WYM93 | 69688.2 | — | — | — | — | — | — | 9.1 | 0.25 | 3 |
| WYM94 | 69626.6 | — | — | — | — | — | — | 9.1 | 0.28 | 2 |
| CONT. | — | 203.5 | — | — | 2218.8 | — | — | 8.9 | — | — |
| WYM31 | 69729.3 | — | — | — | — | — | — | 9.1 | 0.17 | 3 |
| WYM94 | 69628.1 | — | — | — | — | — | — | 9.4 | 0.08 | 6 |
| WYM65 | 69519.3 | 188.8 | 0.17 | 4 | 2290.5 | 0.10 | 6 | 9.3 | 0.14 | 5 |
| WYM94 | 69629.3 | 197.5 | 0.07 | 9 | 2316.7 | 0.03 | 7 | 9.0 | 0.29 | 1 |
| CONT. | — | 180.8 | — | — | 2165.0 | — | — | 8.9 | — | — |
| WYM93 | 69687.3 | — | — | — | 2133.3 | 0.19 | 7 | — | — | — |
| WYM65 | 69519.1 | 158.6 | 0.20 | 6 | 2132.7 | 0.19 | 7 | — | — | — |
| WYM65 | 69523.2 | 165.9 | 0.11 | 11 | 2166.7 | 0.20 | 9 | — | — | — |
| WYM22 | 69500.5 | 159.2 | 0.24 | 7 | 2166.7 | 0.18 | 9 | — | — | — |
| WYM79 | 69538.3 | 166.3 | 0.12 | 12 | 2291.7 | 0.05 | 15 | 9.3 | 0.20 | 4 |
| WYM22 | 69504.5 | 159.2 | 0.20 | 7 | 2186.3 | 0.16 | 10 | — | — | — |
| WYM79 | 69538.1 | 164.6 | 0.11 | 11 | 2333.3 | 0.04 | 17 | 9.2 | 0.29 | 3 |
| CONT. | — | 149.0 | — | — | 1996.0 | — | — | 8.9 | — | — |
| WYM24 | 69662.2 | 214.2 | 0.05 | 12 | 2587.5 | 0.11 | 8 | 9.3 | 0.26 | 2 |
| WYM94 | 69630.1 | — | — | — | — | — | — | 9.3 | 0.29 | 2 |
| WYM24 | 69662.1 | 202.1 | 0.19 | 6 | 2516.7 | 0.22 | 5 | 9.3 | 0.23 | 2 |
| WYM93 | 69688.1 | 213.8 | 0.05 | 12 | — | — | — | 9.6 | 0.04 | 5 |
| WYM22 | 69500.8 | 210.0 | 0.09 | 10 | 2539.9 | 0.18 | 6 | — | — | — |
| WYM70 | 70034.7 | 200.7 | 0.22 | 5 | — | — | — | — | — | — |
| CONT. | — | 191.4 | — | — | 2399.7 | — | — | 9.1 | — | — |
| WYM55 | 69507.2 | — | — | — | — | — | — | 9.7 | 0.08 | 3 |
| WYM79 | 69536.1 | 206.7 | 0.02 | 10 | 2500.0 | L | 13 | 9.6 | 0.16 | 3 |
| WYM55 | 69510.2 | — | — | — | 2408.3 | 0.09 | 8 | — | — | — |

TABLE 60-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| WYM70 | 70039.6 | 200.4 | 0.10 | 7 | 2512.5 | 0.02 | 13 | 9.8 | 0.06 | 5 |
| WYM22 | 69504.3 | 204.0 | 0.25 | 9 | 2637.9 | 0.08 | 19 | — | — | — |
| WYM22 | 69504.2 | 207.9 | 0.02 | 11 | 2554.2 | L | 15 | — | — | — |
| LYM320 | 69405.3 | — | — | — | 2325.0 | 0.18 | 5 | 9.9 | 0.05 | 6 |
| WYM93 | 69690.3 | — | — | — | 2412.5 | 0.10 | 9 | — | — | — |
| CONT. | — | 187.5 | — | — | 2221.9 | — | — | 9.3 | — | — |
| WYM31 | 69730.5 | — | — | — | — | — | — | 9.1 | 0.19 | 1 |
| WYM15 | 69494.2 | — | — | — | 2287.5 | 0.27 | 6 | 9.2 | 0.24 | 2 |
| CONT. | — | 157.5 | — | — | 2162.5 | — | — | 9.0 | — | — |
| LYM208_H4 | 69488.5 | 135.9 | 0.11 | 8 | — | — | — | — | — | — |
| WYM16 | 69883.9 | 144.6 | 0.03 | 15 | 1683.3 | 0.05 | 12 | 10.2 | 0.22 | 1 |
| WYM16 | 69883.7 | 132.1 | 0.11 | 5 | — | — | — | — | — | — |
| WYM25 | 69725.4 | 133.3 | 0.23 | 6 | — | — | — | — | — | — |
| WYM16 | 69883.4 | 136.7 | 0.06 | 9 | 1570.8 | 0.23 | 4 | — | — | — |
| WYM25 | 69726.1 | — | — | — | 1554.2 | 0.27 | 3 | 10.7 | 0.08 | 6 |
| WYM81 | 69542.6 | 130.0 | 0.25 | 4 | — | — | — | — | — | — |
| LYM208_H4 | 69489.10 | 137.2 | 0.07 | 9 | 1615.8 | 0.21 | 7 | — | — | — |
| LYM208_H4 | 69490.1 | — | — | — | 1607.1 | 0.22 | 7 | — | — | — |
| LYM208_H4 | 69490.2 | — | — | — | — | — | — | 10.5 | 0.07 | 4 |
| WYM81 | 69542.3 | — | — | — | — | — | — | 10.3 | 0.23 | 2 |
| WYM25 | 69724.1 | 149.2 | L | 19 | 1854.2 | 0.07 | 23 | 10.3 | 0.20 | 2 |
| WYM25 | 69726.5 | 145.4 | 0.09 | 16 | 1779.2 | 0.03 | 18 | 10.6 | 0.13 | 5 |
| LYM208_H4 | 69489.5 | 132.5 | 0.19 | 6 | — | — | — | — | — | — |
| LYM208_H4 | 69488.1 | 142.9 | 0.19 | 14 | 1600.0 | 0.11 | 6 | — | — | — |
| CONT. | — | 125.6 | — | — | 1506.0 | — | — | 10.1 | — | — |
| WYM64 | 72486.1 | 259.2 | 0.08 | 9 | 4008.3 | 0.18 | 7 | — | — | — |
| WYM38 | 71688.4 | 262.9 | 0.07 | 10 | — | — | — | — | — | — |
| WYM38 | 71688.3 | 250.3 | 0.22 | 5 | — | — | — | — | — | — |
| WYM12 | 71897.1 | 261.3 | 0.09 | 9 | — | — | — | — | — | — |
| WYM85 | 71526.6 | 278.4 | 0.02 | 17 | 4145.8 | 0.10 | 11 | — | — | — |
| WYM103 | 71449.1 | 263.4 | 0.08 | 10 | — | — | — | — | — | — |
| WYM29 | 71879.3 | 277.9 | 0.03 | 16 | 4016.7 | 0.17 | 7 | — | — | — |
| WYM103 | 71450.3 | 263.9 | 0.06 | 11 | — | — | — | — | — | — |
| CONT. | — | 238.8 | — | — | 3743.8 | — | — | 10.8 | — | — |
| WYM103 | 71451.1 | 275.9 | 0.13 | 3 | 4033.3 | 0.13 | 5 | 10.5 | 0.29 | 4 |
| WYM113 | 72759.6 | — | — | — | 3991.7 | 0.17 | 4 | 11.0 | 0.14 | 8 |
| WYM113 | 72761.2 | 277.0 | 0.23 | 3 | — | — | — | 11.4 | 0.07 | 12 |
| CONT. | — | 268.4 | — | — | 3854.2 | — | — | 10.2 | — | — |
| WYM3 | 72479.5 | — | — | — | 4219.6 | 0.26 | 9 | — | — | — |
| WYM64 | 72486.2 | 360.0 | 0.11 | 8 | 4570.8 | 0.12 | 18 | — | — | — |
| WYM20 | 72487.2 | — | — | — | 4133.3 | 0.23 | 7 | — | — | — |
| WYM2 | 69654.2 | 345.0 | 0.25 | 4 | 4279.2 | 0.02 | 11 | — | — | — |
| WYM38 | 71693.5 | 356.7 | 0.17 | 7 | 4080.4 | 0.09 | 6 | 11.1 | 0.11 | 6 |
| WYM38 | 71689.4 | 353.0 | 0.25 | 6 | 4162.5 | 0.04 | 8 | — | — | — |
| WYM3 | 72475.3 | — | — | — | 4472.0 | 0.02 | 16 | — | — | — |
| WYM3 | 72476.1 | 364.6 | 0.07 | 10 | 4495.8 | L | 16 | — | — | — |
| CONT. | — | 331.9 | — | — | 3865.6 | — | — | 10.5 | — | — |
| LAB278_H0 | 71521.3 | — | — | — | — | — | — | 11.0 | 0.25 | 4 |
| WYM113 | 72762.7 | — | — | — | — | — | — | 10.8 | 0.29 | 3 |
| WYM85 | 71527.3 | 271.3 | 0.04 | 6 | 4133.3 | 0.15 | 5 | — | — | — |
| WYM29 | 71877.2 | 274.2 | 0.02 | 8 | — | — | — | 11.4 | 0.04 | 8 |
| WYM20 | 72492.1 | 280.0 | 0.06 | 10 | 4000.0 | 0.29 | 2 | 11.6 | 0.03 | 10 |
| WYM38 | 71690.2 | 276.7 | 0.02 | 9 | 4083.3 | 0.16 | 4 | 10.9 | 0.18 | 3 |
| WYM64 | 72485.8 | 282.1 | 0.06 | 11 | 4354.2 | 0.05 | 11 | 10.9 | 0.13 | 4 |
| CONT. | — | 254.7 | — | — | 3918.8 | — | — | 10.5 | — | — |
| WYM3 | 72477.1 | — | — | — | 3862.5 | 0.21 | 4 | — | — | — |
| WYM103 | 71451.2 | 276.3 | 0.25 | 4 | — | — | — | — | — | — |
| WYM3 | 72479.7 | 289.5 | 0.05 | 9 | 4072.0 | 0.05 | 10 | — | — | — |
| CONT. | — | 266.3 | — | — | 3706.2 | — | — | 11.2 | — | — |
| WYM20 | 72491.5 | — | — | — | 4475.0 | 0.25 | 4 | — | — | — |
| WYM113 | 72762.1 | — | — | — | 4687.5 | 0.11 | 9 | 11.1 | 0.06 | 8 |
| WYM12 | 71892.4 | — | — | — | 4626.2 | 0.15 | 7 | 10.6 | 0.23 | 4 |
| WYM85 | 71529.3 | — | — | — | 4791.7 | 0.02 | 11 | 10.7 | 0.18 | 4 |
| WYM12 | 71893.4 | — | — | — | 4783.3 | 0.05 | 11 | 10.6 | 0.22 | 4 |
| WYM85 | 71528.4 | — | — | — | 4695.8 | 0.16 | 9 | 10.8 | 0.15 | 6 |
| CONT. | — | 362.9 | — | — | 4312.5 | — | — | 10.2 | — | — |
| LAB278_H0 | 71522.4 | 294.2 | 0.14 | 9 | 4183.3 | 0.09 | 8 | — | — | — |
| WYM12 | 71893.9 | 301.5 | 0.01 | 12 | 4355.4 | 0.02 | 13 | — | — | — |
| WYM38 | 71690.3 | 310.0 | L | 15 | 4475.0 | L | 16 | 11.0 | 0.10 | 7 |
| WYM20 | 72491.6 | 298.8 | 0.01 | 11 | 4337.5 | L | 12 | — | — | — |
| WYM64 | 72481.7 | 325.7 | 0.02 | 21 | 4782.7 | 0.01 | 24 | — | — | — |
| WYM12 | 71895.1 | 282.1 | 0.07 | 5 | 4087.5 | 0.10 | 6 | — | — | — |

TABLE 60-continued

Genes showing improved plant performance at normal growth conditions under regulation of At6669 promoter

| | | Dry Weight [mg] | | | Fresh Weight [mg] | | | Leaf Number | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| WYM113 | 72761.4 | 287.1 | 0.17 | 7 | 4112.5 | 0.14 | 6 | — | — | — |
| CONT. | — | 269.5 | — | — | 3864.3 | — | — | 10.3 | — | — |
| WYM12 | 71892.3 | 306.7 | 0.18 | 3 | — | — | — | — | — | — |
| WYM38 | 71688.1 | 306.3 | 0.02 | 3 | — | — | — | — | — | — |
| CONT. | — | 298.8 | — | — | 4275.0 | — | — | 10.7 | — | — |
| WYM29 | 71876.3 | — | — | — | — | — | — | 10.2 | 0.28 | 2 |
| WYM3 | 72479.2 | 305.9 | 0.04 | 18 | 3941.7 | 0.24 | 5 | 10.9 | 0.07 | 10 |
| WYM3 | 72475.4 | 274.6 | 0.02 | 6 | 4100.0 | 0.07 | 9 | 10.1 | 0.23 | 2 |
| LAB278_H0 | 71521.5 | 291.7 | 0.07 | 13 | 4250.0 | L | 13 | — | — | — |
| LAB278_H0 | 71522.7 | 268.4 | 0.22 | 4 | 3941.7 | 0.20 | 5 | — | — | — |
| WYM38 | 71689.2 | 281.7 | L | 9 | 4054.2 | 0.05 | 8 | 10.9 | L | 9 |
| CONT. | — | 259.1 | — | — | 3765.6 | — | — | 10.0 | — | — |
| WYM3 | 72478.3 | 304.2 | L | 11 | 4537.5 | L | 15 | 10.7 | 0.26 | 3 |
| WYM38 | 71689.6 | 277.9 | 0.24 | 1 | 4029.2 | 0.28 | 2 | — | — | — |
| WYM85 | 71527.5 | 296.1 | 0.12 | 8 | 4216.1 | 0.07 | 7 | 10.5 | 0.20 | 1 |
| LAB278_H0 | 71521.2 | 282.1 | 0.11 | 3 | 4116.7 | 0.11 | 4 | — | — | — |
| CONT. | — | 274.4 | — | — | 3946.9 | — | — | 10.4 | — | — |
| LAB278_H0 | 71522.3 | — | — | — | 4283.3 | 0.06 | 8 | — | — | — |
| CONT. | — | 327.0 | — | — | 3970.0 | — | — | 10.7 | — | — |
| WYM29 | 71877.4 | — | — | — | — | — | — | 10.9 | L | 3 |
| WYM64 | 72485.4 | — | — | — | — | — | — | 11.1 | 0.09 | 5 |
| WYM64 | 72486.3 | — | — | — | — | — | — | 10.7 | 0.26 | 1 |
| WYM38 | 71688.2 | 372.5 | 0.05 | 11 | 4445.8 | 0.22 | 2 | — | — | — |
| CONT. | — | 334.4 | — | — | 4362.5 | — | — | 10.6 | — | — |
| WYM113 | 72762.5 | 573.8 | 0.22 | 78 | — | — | — | 11.1 | 0.02 | 16 |
| WYM20 | 72489.5 | — | — | — | — | — | — | 10.2 | 0.13 | 6 |
| WYM2 | 69650.2 | — | — | — | — | — | — | 10.1 | 0.16 | 5 |
| WYM29 | 71876.5 | — | — | — | — | — | — | 10.8 | 0.03 | 13 |
| WYM12 | 71896.5 | — | — | — | — | — | — | 10.9 | 0.06 | 13 |
| WYM64 | 72485.2 | — | — | — | — | — | — | 10.3 | 0.14 | 6 |
| WYM85 | 71526.3 | — | — | — | 4262.5 | 0.28 | 4 | 10.7 | 0.06 | 11 |
| WYM113 | 72762.4 | — | — | — | — | — | — | 10.5 | 0.17 | 9 |
| CONT. | — | 322.1 | — | — | 4107.2 | — | — | 9.6 | — | — |
| WYM103 | 71452.3 | — | — | — | 3991.7 | 0.19 | 4 | 11.3 | L | 12 |
| WYM64 | 72485.10 | — | — | — | — | — | — | 10.2 | 0.23 | 1 |
| WYM3 | 72479.9 | 294.2 | 0.22 | 11 | — | — | — | 11.2 | L | 11 |
| WYM113 | 72762.3 | — | — | — | — | — | — | 11.0 | 0.02 | 9 |
| WYM85 | 71526.5 | — | — | — | 3970.8 | 0.28 | 3 | 10.8 | 0.09 | 8 |
| WYM103 | 71450.5 | — | — | — | 3962.5 | 0.26 | 3 | 11.1 | L | 11 |
| CONT. | — | 266.0 | — | — | 3845.1 | — | — | 10.0 | — | — |
| WYM42 | 69677.3 | 150.1 | 0.29 | 14 | — | — | — | — | — | — |
| LYM350 | 69417.1 | 156.3 | 0.25 | 19 | 1354.2 | 0.23 | 9 | 11.0 | L | 6 |
| WYM42 | 69679.5 | 155.9 | 0.22 | 19 | 1420.8 | 0.26 | 14 | 10.7 | 0.16 | 3 |
| LYM350 | 69418.3 | 140.9 | 0.24 | 7 | — | — | — | — | — | — |
| LYM350 | 69418.6 | 144.2 | 0.24 | 10 | — | — | — | — | — | — |
| LYM350 | 69418.5 | — | — | — | — | — | — | 10.7 | 0.18 | 3 |
| WYM42 | 69677.1 | 141.3 | 0.18 | 7 | — | — | — | — | — | — |
| CONT. | — | 131.5 | — | — | 1244.6 | — | — | 10.4 | — | — |
| WYM72 | 70043.1 | 135.8 | 0.21 | 6 | 1533.3 | 0.27 | 6 | 10.1 | 0.09 | 4 |
| WYM91 | 70012.10 | 154.2 | 0.17 | 20 | 1733.3 | 0.09 | 20 | 10.2 | 0.21 | 5 |
| WYM72 | 70043.5 | 162.9 | L | 27 | 1718.5 | L | 19 | 10.0 | 0.12 | 3 |
| WYM43 | 69949.7 | 150.4 | L | 17 | 1679.2 | 0.11 | 16 | 10.0 | 0.12 | 3 |
| WYM91 | 70011.7 | 136.5 | 0.29 | 6 | 1513.9 | 0.25 | 5 | — | — | — |
| WYM72 | 70045.9 | — | — | — | — | — | — | 10.0 | 0.18 | 4 |
| WYM23 | 69658.2 | 145.7 | 0.03 | 13 | 1635.1 | 0.05 | 13 | 10.5 | L | 8 |
| WYM67 | 70023.2 | 171.7 | 0.03 | 33 | 1922.6 | L | 33 | 10.8 | L | 12 |
| WYM43 | 69947.4 | 139.2 | 0.22 | 8 | 1587.5 | 0.24 | 10 | 10.5 | 0.03 | 8 |
| WYM91 | 70012.4 | 142.1 | 0.28 | 10 | — | — | — | — | — | — |
| WYM43 | 69949.3 | 141.7 | 0.09 | 10 | 1695.8 | 0.12 | 17 | 10.1 | 0.02 | 4 |
| WYM91 | 70012.7 | 159.6 | 0.07 | 24 | 1845.8 | 0.07 | 28 | 10.6 | L | 9 |
| WYM72 | 70044.3 | 139.6 | 0.22 | 8 | 1570.8 | 0.22 | 9 | 10.2 | 0.10 | 5 |
| WYM23 | 69656.1 | — | — | — | — | — | — | 9.8 | 0.27 | 2 |
| WYM43 | 69947.5 | 138.8 | 0.29 | 8 | — | — | — | 10.2 | 0.08 | 5 |
| WYM72 | 70043.7 | 145.8 | 0.13 | 13 | 1716.7 | 0.09 | 19 | 10.5 | 0.03 | 8 |
| WYM67 | 70022.3 | — | — | — | — | — | — | 10.0 | 0.14 | 3 |
| WYM23 | 69658.4 | 145.4 | 0.30 | 13 | 1616.7 | 0.30 | 12 | 10.0 | 0.11 | 4 |
| WYM72 | 70045.2 | — | — | — | 1546.4 | 0.20 | 7 | — | — | — |
| WYM72 | 70044.1 | — | — | — | 1519.4 | 0.25 | 5 | 10.1 | L | 4 |
| WYM72 | 70045.3 | — | — | — | 1511.8 | 0.17 | 5 | 10.0 | 0.17 | 3 |
| WYM43 | 69944.4 | 138.8 | 0.25 | 8 | 1579.2 | 0.22 | 9 | 10.4 | L | 8 |
| WYM67 | 70022.10 | — | — | — | 1586.3 | 0.28 | 10 | — | — | — |
| WYM43 | 69949.10 | 140.9 | 0.06 | 9 | 1658.3 | 0.04 | 15 | 10.4 | L | 7 |

TABLE 60-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| WYM67 | 70023.1 | 157.0 | L | 22 | 1776.8 | 0.04 | 23 | 10.3 | 0.19 | 6 |
| WYM23 | 69657.4 | 151.3 | 0.04 | 18 | 1716.7 | 0.05 | 19 | 9.9 | 0.09 | 2 |
| WYM72 | 70043.2 | 148.3 | 0.19 | 15 | 1675.0 | 0.16 | 16 | 10.6 | 0.13 | 9 |
| WYM43 | 69949.6 | 132.5 | 0.29 | 3 | — | — | — | 10.3 | 0.12 | 7 |
| WYM67 | 70022.2 | — | — | — | 1591.7 | 0.27 | 10 | 10.0 | 0.18 | 3 |
| WYM67 | 70023.3 | — | — | — | 1595.8 | 0.15 | 10 | 10.0 | 0.08 | 4 |
| WYM23 | 69660.3 | — | — | — | 1591.7 | 0.20 | 10 | — | — | — |
| WYM23 | 69661.4 | — | — | — | — | — | — | 10.2 | 0.09 | 5 |
| WYM23 | 69661.7 | 142.1 | 0.10 | 10 | 1629.2 | 0.12 | 13 | 10.3 | 0.01 | 6 |
| WYM43 | 69949.11 | 169.4 | 0.17 | 32 | 1601.2 | 0.23 | 11 | — | — | — |
| CONT. | — | 128.7 | — | — | 1446.0 | — | — | 9.7 | — | — |
| WYM74 | 69531.2 | — | — | — | 1329.2 | 0.26 | 7 | — | — | — |
| WYM74 | 69531.3 | 128.3 | 0.21 | 7 | 1307.7 | 0.25 | 5 | — | — | — |
| WYM74 | 69535.2 | 123.8 | 0.26 | 3 | — | — | — | — | — | — |
| WYM69 | 69528.5 | 124.2 | 0.30 | 3 | — | — | — | — | — | — |
| WYM69 | 69529.2 | 127.5 | 0.11 | 6 | — | — | — | — | — | — |
| CONT. | — | 120.2 | — | — | 1246.7 | — | — | 10.6 | — | — |

Table 60. "CONT."—Control;
"Ave."—Average;
"% Incr." = % increment;
"p-val."—p-value,
L—p < 0.01.

TABLE 61

Genes showing improved plant performance at normal growth conditions under regulation of At6669 promoter

| Gene Name | Event # | Rosette Area [cm²] | | | Rosette Diameter [cm] | | |
|---|---|---|---|---|---|---|---|
| | | Ave. | P-Val. | % Incr. | Ave. | P-Val. | % Incr. |
| LAB259 | 69401.8 | 8.3 | 0.02 | 28 | 5.2 | L | 18 |
| WYM18 | 70938.3 | 9.0 | L | 39 | 5.3 | L | 20 |
| WYM86 | 70919.5 | 7.4 | 0.24 | 14 | 4.7 | 0.26 | 6 |
| WYM30 | 69672.2 | 8.4 | 0.05 | 29 | 5.1 | 0.05 | 14 |
| WYM83 | 70956.7 | 8.1 | 0.03 | 26 | 5.1 | 0.04 | 14 |
| WYM83 | 70953.1 | 9.2 | L | 42 | 5.4 | L | 21 |
| WYM105 | 70931.3 | 7.7 | 0.06 | 19 | 4.9 | 0.07 | 10 |
| CONT. | — | 6.5 | — | — | 4.4 | — | — |
| WYM48 | 69972.5 | 7.8 | L | 32 | 4.8 | 0.02 | 14 |
| WYM105 | 70928.1 | 6.3 | 0.23 | 6 | 4.4 | 0.26 | 4 |
| WYM86 | 70917.3 | 8.5 | L | 43 | 5.0 | 0.01 | 19 |
| WYM32 | 70412.2 | 6.5 | 0.10 | 10 | 4.4 | 0.22 | 5 |
| LAB259 | 69400.1 | 7.4 | 0.01 | 24 | 4.9 | 0.02 | 15 |
| WYM30 | 69668.2 | 6.4 | 0.17 | 8 | 4.5 | 0.15 | 6 |
| LYM91 | 69394.5 | 6.4 | 0.16 | 8 | 4.5 | 0.11 | 7 |
| CONT. | — | 5.9 | — | — | 4.2 | — | — |
| WYM61 | 69974.2 | 7.8 | 0.21 | 8 | 4.8 | 0.24 | 4 |
| WYM83 | 70951.3 | 7.7 | 0.28 | 7 | — | — | — |
| WYM86 | 70918.6 | 9.0 | 0.03 | 26 | 5.2 | 0.03 | 14 |
| WYM105 | 70930.2 | 8.6 | 0.06 | 20 | 5.0 | 0.09 | 9 |
| WYM32 | 70415.2 | 8.2 | 0.11 | 14 | — | — | — |
| WYM18 | 70938.6 | 8.8 | 0.04 | 23 | 5.1 | 0.07 | 10 |
| WYM83 | 70951.4 | 10.1 | L | 41 | 5.6 | L | 20 |
| CONT. | — | 7.2 | — | — | 4.6 | — | — |
| WYM86 | 70919.2 | 7.6 | 0.11 | 10 | 4.8 | 0.05 | 8 |
| WYM87 | 70960.8 | 7.6 | 0.11 | 11 | 4.9 | 0.08 | 10 |
| WYM32 | 70414.3 | 8.3 | 0.01 | 20 | 5.0 | L | 13 |
| WYM32 | 70413.2 | 8.0 | 0.03 | 17 | 4.9 | L | 10 |
| WYM83 | 70956.5 | 7.6 | 0.15 | 11 | 4.8 | 0.12 | 8 |
| WYM30 | 69672.4 | 8.2 | 0.01 | 20 | 5.0 | L | 13 |
| LYM91 | 69395.2 | 7.8 | 0.04 | 14 | 4.8 | 0.03 | 8 |
| CONT. | — | 6.9 | — | — | 4.4 | — | — |
| WYM30 | 69673.2 | — | — | — | 5.3 | 0.30 | 3 |
| WYM61 | 69977.2 | — | — | — | 5.3 | 0.19 | 3 |
| WYM18 | 70938.7 | 11.3 | 0.02 | 21 | 5.7 | 0.04 | 11 |
| WYM87 | 70960.3 | 9.8 | 0.23 | 5 | 5.4 | 0.11 | 4 |
| WYM32 | 70416.3 | — | — | — | 5.3 | 0.13 | 4 |
| CONT. | — | 9.3 | — | — | 5.1 | — | — |
| WYM105 | 70932.10 | 6.5 | 0.28 | 5 | 4.5 | 0.19 | 3 |
| WYM87 | 70961.6 | — | — | — | 4.4 | 0.25 | 2 |
| LYM91 | 69395.1 | — | — | — | 4.5 | 0.21 | 3 |
| WYM87 | 70961.7 | — | — | — | 4.5 | 0.18 | 3 |
| WYM105 | 70930.1 | 6.6 | 0.26 | 6 | — | — | — |
| WYM30 | 69672.1 | — | — | — | 4.5 | 0.23 | 3 |
| LAB259 | 69401.1 | 7.1 | 0.06 | 14 | 4.9 | L | 13 |
| CONT. | — | 6.2 | — | — | 4.3 | — | — |
| WYM32 | 70417.1 | 7.5 | 0.01 | 20 | 4.9 | 0.02 | 13 |
| WYM86 | 70919.1 | 6.8 | 0.10 | 8 | 4.7 | 0.06 | 8 |
| WYM83 | 70953.2 | 7.2 | 0.18 | 15 | 4.7 | 0.20 | 8 |
| WYM83 | 70956.1 | 7.1 | 0.03 | 14 | 4.7 | 0.06 | 8 |
| WYM86 | 70920.1 | 8.0 | L | 28 | 5.0 | L | 16 |
| CONT. | — | 6.2 | — | — | 4.3 | — | — |
| WYM48 | 69972.3 | 7.9 | 0.19 | 6 | 5.0 | 0.16 | 4 |
| LYM91 | 69392.6 | 8.0 | 0.28 | 9 | 5.0 | 0.26 | 4 |
| WYM48 | 69968.1 | 8.2 | 0.09 | 12 | 5.2 | 0.04 | 8 |
| LAB259 | 69399.7 | 8.3 | 0.06 | 13 | 5.1 | 0.11 | 6 |
| LAB259 | 69401.6 | 8.4 | 0.06 | 14 | 5.2 | 0.04 | 8 |
| CONT. | — | 7.4 | — | — | 4.8 | — | — |
| WYM48 | 69968.4 | 8.2 | 0.06 | 15 | 4.9 | 0.12 | 5 |
| WYM32 | 70415.3 | 8.1 | 0.11 | 14 | 5.0 | 0.18 | 6 |
| WYM87 | 70961.8 | 7.8 | 0.02 | 9 | 4.9 | 0.07 | 4 |
| WYM18 | 70938.1 | 7.4 | 0.11 | 4 | 4.8 | 0.14 | 2 |
| WYM48 | 69973.4 | 7.7 | 0.05 | 8 | 4.9 | 0.03 | 4 |
| CONT. | — | 7.1 | — | — | 4.7 | — | — |
| WYM18 | 70937.3 | 8.8 | 0.10 | 11 | 5.2 | 0.08 | 6 |
| WYM32 | 70416.11 | 10.3 | L | 31 | 5.7 | L | 16 |
| WYM30 | 69670.3 | 8.5 | 0.18 | 7 | 5.2 | 0.18 | 5 |
| WYM61 | 69978.2 | 9.3 | 0.03 | 17 | 5.5 | 0.04 | 12 |
| WYM18 | 70938.5 | 9.4 | 0.10 | 18 | 5.4 | 0.05 | 10 |
| CONT. | — | 7.9 | — | — | 4.9 | — | — |
| WYM105 | 70931.1 | 9.0 | 0.17 | 20 | 5.0 | 0.16 | 12 |
| WYM48 | 69970.4 | 8.5 | 0.19 | 14 | 4.9 | 0.18 | 9 |

TABLE 61-continued

Genes showing improved plant performance at normal growth conditions under regulation of At6669 promoter

| Gene Name | Event # | Rosette Area [cm²] Ave. | P-Val. | % Incr. | Rosette Diameter [cm] Ave. | P-Val. | % Incr. |
|---|---|---|---|---|---|---|---|
| LAB259 | 69402.1 | 8.0 | 0.18 | 7 | 4.7 | 0.13 | 4 |
| LYM91 | 69395.3 | 9.9 | 0.01 | 33 | 5.2 | 0.03 | 15 |
| WYM32 | 70416.4 | 8.9 | 0.05 | 20 | 5.0 | 0.03 | 11 |
| WYM87 | 70962.5 | 10.5 | 0.01 | 40 | 5.4 | 0.01 | 20 |
| WYM61 | 69979.4 | 9.7 | 0.04 | 30 | 5.3 | 0.03 | 18 |
| WYM87 | 70960.2 | 8.8 | 0.19 | 19 | 4.9 | 0.18 | 9 |
| CONT. | — | 7.5 | — | — | 4.5 | — | — |
| WYM83 | 70956.4 | 7.3 | 0.03 | 13 | 4.6 | 0.03 | 9 |
| WYM86 | 70917.2 | 7.0 | 0.11 | 10 | 4.6 | 0.05 | 10 |
| WYM61 | 69977.1 | 7.1 | 0.13 | 11 | 4.6 | 0.02 | 11 |
| WYM30 | 69670.2 | 7.4 | L | 16 | 4.6 | 0.03 | 9 |
| LAB259 | 69399.6 | 8.8 | L | 38 | 5.0 | L | 19 |
| WYM61 | 69977.4 | 7.8 | L | 21 | 4.7 | 0.02 | 12 |
| WYM30 | 69670.1 | 8.6 | L | 33 | 4.8 | L | 16 |
| LYM91 | 69394.2 | 7.0 | 0.12 | 9 | 4.4 | 0.07 | 6 |
| CONT. | — | 6.4 | — | — | 4.2 | — | — |
| WYM105 | 70928.2 | 8.1 | 0.11 | 14 | 5.0 | 0.12 | 9 |
| WYM86 | 70918.7 | 8.2 | 0.05 | 15 | 5.1 | 0.04 | 11 |
| LAB259 | 69403.2 | 7.5 | 0.21 | 6 | 4.7 | 0.26 | 3 |
| WYM18 | 70937.11 | 8.7 | 0.02 | 22 | 5.0 | 0.06 | 9 |
| CONT. | — | 7.1 | — | — | 4.6 | — | — |
| WYM48 | 69973.1 | 8.1 | 0.06 | 16 | 5.1 | 0.04 | 11 |
| WYM86 | 70920.4 | 7.3 | 0.28 | 4 | 4.8 | 0.14 | 4 |
| WYM48 | 69973.5 | 8.0 | 0.10 | 14 | 5.0 | 0.06 | 8 |
| WYM32 | 70416.6 | 7.7 | 0.10 | 10 | 4.8 | 0.13 | 4 |
| LYM91 | 69392.4 | 8.0 | 0.04 | 15 | 5.1 | 0.02 | 10 |
| CONT. | — | 7.0 | — | — | 4.6 | — | — |
| WYM62 | 71467.5 | 10.6 | 0.07 | 15 | 5.7 | 0.10 | 7 |
| LYM490_H1 | 71155.4 | 11.1 | 0.04 | 21 | 5.8 | 0.05 | 10 |
| CONT. | — | 9.2 | — | — | 5.3 | — | — |
| LYM490_H1 | 71158.3 | 8.5 | 0.29 | 4 | — | — | — |
| CONT. | — | 8.2 | — | — | 5.0 | — | — |
| WYM35 | 71163.1 | 8.8 | 0.04 | 15 | 5.3 | 0.04 | 8 |
| WYM90 | 71891.2 | 8.5 | 0.08 | 11 | 5.2 | 0.09 | 7 |
| CONT. | — | 7.6 | — | — | 4.9 | — | — |
| WYM46 | 71151.1 | — | — | — | 4.7 | 0.27 | 3 |
| WYM71 | 72158.1 | — | — | — | 4.6 | 0.15 | 2 |
| CONT. | — | 6.8 | — | — | 4.5 | — | — |
| WYM112 | 69928.3 | 9.3 | 0.03 | 28 | 5.3 | 0.01 | 15 |
| LYM490_H1 | 71155.2 | 7.8 | 0.25 | 7 | 4.8 | 0.18 | 4 |
| WYM34 | 71768.2 | 8.0 | 0.17 | 11 | 5.0 | 0.09 | 7 |
| WYM34 | 71769.1 | 9.1 | 0.03 | 25 | 5.2 | 0.02 | 12 |
| WYM28 | 71457.2 | 8.1 | 0.16 | 12 | 5.0 | 0.08 | 7 |
| WYM71 | 72162.1 | 7.9 | 0.21 | 9 | 5.0 | 0.05 | 8 |
| CONT. | — | 7.3 | — | — | 4.6 | — | — |
| WYM35 | 71166.2 | 8.9 | 0.29 | 5 | — | — | — |
| CONT. | — | 8.5 | — | — | 5.2 | — | — |
| WYM112 | 69928.1 | — | — | — | 5.3 | 0.26 | 4 |
| WYM21 | 71763.3 | 10.0 | 0.02 | 23 | 5.5 | 0.04 | 9 |
| CONT. | — | 8.1 | — | — | 5.1 | — | — |
| WYM62 | 71467.7 | 8.8 | 0.04 | 8 | 5.3 | 0.02 | 5 |
| WYM21 | 71761.1 | 8.8 | 0.07 | 7 | 5.3 | 0.11 | 4 |
| WYM35 | 71161.1 | — | — | — | 5.2 | 0.12 | 2 |
| CONT. | — | 8.2 | — | — | 5.1 | — | — |
| WYM21 | 71762.6 | 8.6 | 0.01 | 10 | 5.4 | L | 8 |
| WYM46 | 71150.8 | 8.2 | 0.29 | 4 | 5.1 | 0.21 | 2 |
| CONT. | — | 7.9 | — | — | 5.0 | — | — |
| WYM90 | 71889.1 | 9.0 | 0.06 | 11 | 5.4 | 0.09 | 5 |
| WYM112 | 69926.4 | 8.4 | 0.28 | 4 | 5.3 | 0.21 | 3 |
| CONT. | — | 8.1 | — | — | 5.1 | — | — |
| WYM35 | 71162.9 | 9.1 | 0.06 | 17 | 5.3 | 0.07 | 8 |
| WYM90 | 71888.2 | 8.2 | 0.27 | 5 | — | — | — |
| CONT. | — | 7.8 | — | — | 4.9 | — | — |
| LYM490_H1 | 71156.2 | 7.1 | 0.05 | 6 | 4.7 | 0.10 | 4 |
| WYM96 | 71174.1 | 7.5 | 0.06 | 11 | 4.7 | 0.12 | 4 |
| WYM34 | 71766.1 | 6.8 | 0.29 | 1 | — | — | — |
| WYM90 | 71888.0 | 8.0 | 0.02 | 20 | 4.9 | 0.20 | 8 |
| WYM71 | 72160.5 | 7.1 | 0.15 | 6 | — | — | — |
| CONT. | — | 6.7 | — | — | 4.5 | — | — |
| WYM71 | 72162.2 | 8.7 | 0.17 | 5 | 5.3 | 0.07 | 4 |
| CONT. | — | 8.2 | — | — | 5.1 | — | — |
| WYM79 | 69537.4 | 6.9 | 0.02 | 47 | 4.5 | 0.01 | 21 |
| WYM70 | 70034.6 | 6.1 | 0.03 | 30 | 4.2 | 0.02 | 13 |
| WYM79 | 69537.3 | 6.0 | L | 29 | 4.2 | L | 13 |
| WYM24 | 69663.3 | 5.7 | L | 22 | 4.3 | L | 14 |
| LYM320 | 69406.3 | 5.5 | 0.06 | 17 | 4.0 | 0.09 | 7 |
| WYM79 | 69537.2 | 5.3 | 0.11 | 14 | 4.1 | 0.02 | 10 |
| WYM93 | 69690.2 | 5.8 | L | 24 | 4.2 | L | 11 |
| WYM94 | 69628.3 | 5.9 | 0.05 | 26 | 4.3 | 0.05 | 14 |
| CONT. | — | 4.7 | — | — | 3.7 | — | — |
| WYM94 | 69631.1 | 5.1 | 0.21 | 5 | 3.9 | 0.08 | 3 |
| WYM24 | 69667.7 | 6.5 | 0.03 | 34 | 4.4 | 0.04 | 17 |
| WYM79 | 69536.2 | 5.4 | 0.06 | 13 | 4.1 | 0.05 | 9 |
| WYM31 | 69730.9 | 5.2 | 0.22 | 7 | 4.0 | 0.07 | 5 |
| WYM15 | 69495.5 | 5.6 | 0.07 | 17 | 4.1 | 0.09 | 8 |
| WYM70 | 70034.2 | 6.1 | L | 27 | 4.3 | L | 12 |
| WYM31 | 69730.7 | 5.6 | 0.02 | 16 | 4.2 | 0.02 | 10 |
| WYM15 | 69497.4 | 5.2 | 0.21 | 7 | 4.0 | 0.14 | 5 |
| CONT. | — | 4.8 | — | — | 3.8 | — | — |
| WYM94 | 69629.2 | 5.4 | 0.06 | 11 | 4.1 | 0.10 | 6 |
| WYM15 | 69495.4 | 5.3 | 0.11 | 9 | 4.1 | 0.13 | 5 |
| CONT. | — | 4.9 | — | — | 3.9 | — | — |
| WYM31 | 69731.1 | 5.3 | 0.17 | 9 | 4.0 | 0.24 | 4 |
| WYM94 | 69631.2 | 5.9 | 0.11 | 22 | 4.3 | 0.07 | 13 |
| WYM31 | 69730.4 | 5.3 | 0.13 | 9 | 4.1 | 0.05 | 7 |
| LYM320 | 69409.1 | 5.7 | 0.03 | 18 | 4.1 | 0.04 | 8 |
| WYM65 | 69521.1 | 5.1 | 0.21 | 6 | 3.9 | 0.19 | 3 |
| WYM65 | 69520.1 | — | — | — | 3.9 | 0.26 | 3 |
| WYM70 | 70038.1 | 5.3 | 0.12 | 9 | 4.0 | 0.11 | 4 |
| CONT. | — | 4.8 | — | — | 3.8 | — | — |
| WYM55 | 69509.6 | — | — | — | 4.0 | 0.28 | 2 |
| WYM15 | 69497.2 | 5.7 | 0.20 | 15 | 4.1 | 0.24 | 6 |
| WYM15 | 69499.5 | 5.5 | 0.14 | 11 | 4.2 | 0.06 | 8 |
| WYM93 | 69686.1 | 5.7 | 0.09 | 14 | 4.2 | 0.09 | 7 |
| WYM15 | 69495.2 | 6.5 | 0.03 | 31 | 4.5 | 0.02 | 16 |
| WYM70 | 70039.2 | 5.4 | 0.24 | 9 | 4.1 | 0.25 | 4 |
| WYM79 | 69541.2 | 6.7 | 0.02 | 34 | 4.5 | 0.01 | 16 |
| WYM55 | 69509.5 | 5.8 | 0.09 | 17 | 4.2 | 0.08 | 8 |
| CONT. | — | 5.0 | — | — | 3.9 | — | — |
| WYM31 | 69729.1 | 5.8 | 0.14 | 11 | 4.2 | 0.17 | 5 |
| WYM93 | 69686.2 | 5.5 | 0.29 | 6 | 4.2 | 0.22 | 3 |
| WYM70 | 70039.7 | 6.2 | 0.03 | 19 | 4.4 | 0.02 | 9 |
| LYM320 | 69406.1 | 6.3 | 0.02 | 21 | 4.2 | 0.07 | 5 |
| WYM65 | 69519.5 | 5.7 | 0.14 | 9 | 4.1 | 0.18 | 3 |
| WYM65 | 69520.4 | 5.8 | 0.12 | 10 | 4.3 | 0.10 | 6 |
| CONT. | — | 5.2 | — | — | 4.0 | — | — |
| WYM24 | 69664.1 | 5.5 | 0.19 | 9 | 4.1 | 0.24 | 4 |
| WYM22 | 69504.6 | 5.4 | 0.17 | 8 | — | — | — |
| WYM93 | 69686.4 | 5.3 | 0.10 | 6 | 4.1 | 0.24 | 2 |
| CONT. | — | 5.0 | — | — | 4.0 | — | — |
| WYM24 | 69667.12 | 5.2 | 0.25 | 5 | 4.1 | 0.25 | 3 |
| WYM94 | 69626.6 | 5.1 | 0.30 | 3 | — | — | — |
| CONT. | — | 5.0 | — | — | 4.0 | — | — |
| WYM31 | 69729.3 | 4.7 | 0.24 | 3 | 3.7 | 0.25 | 2 |
| WYM94 | 69628.1 | 4.8 | 0.19 | 6 | — | — | — |
| WYM65 | 69519.3 | — | — | — | 3.8 | 0.05 | 4 |
| WYM94 | 69629.3 | 5.0 | 0.12 | 11 | 3.9 | 0.18 | 6 |
| CONT. | — | 4.5 | — | — | 3.7 | — | — |
| WYM65 | 69523.2 | — | — | — | 3.8 | 0.17 | 3 |
| WYM79 | 69538.3 | 4.7 | 0.28 | 4 | — | — | — |
| WYM79 | 69538.1 | 5.0 | 0.14 | 10 | 3.9 | 0.13 | 5 |
| CONT. | — | 4.5 | — | — | 3.7 | — | — |
| WYM24 | 69662.2 | 6.5 | 0.03 | 27 | 4.5 | 0.01 | 13 |
| WYM94 | 69630.1 | 6.1 | 0.04 | 19 | 4.3 | 0.07 | 7 |
| WYM24 | 69662.1 | 6.1 | 0.07 | 20 | 4.3 | 0.12 | 8 |
| WYM93 | 69688.1 | 6.5 | L | 27 | 4.5 | L | 13 |
| WYM79 | 69539.4 | 5.9 | 0.11 | 15 | 4.3 | 0.13 | 8 |
| WYM22 | 69500.8 | 6.1 | 0.08 | 20 | 4.3 | 0.16 | 7 |
| WYM70 | 70034.7 | 6.0 | 0.14 | 17 | 4.2 | 0.21 | 6 |
| CONT. | — | 5.1 | — | — | 4.0 | — | — |
| WYM55 | 69507.2 | 6.2 | 0.08 | 14 | 4.5 | 0.05 | 7 |
| WYM79 | 69536.1 | 5.9 | 0.17 | 8 | 4.3 | 0.16 | 4 |
| WYM70 | 70039.6 | 6.7 | 0.02 | 23 | 4.6 | 0.03 | 10 |
| WYM22 | 69504.2 | 6.4 | 0.05 | 17 | 4.6 | 0.04 | 9 |

TABLE 61-continued

Genes showing improved plant performance at normal growth conditions under regulation of At6669 promoter

| Gene Name | Event # | Rosette Area [cm²] Ave. | P-Val. | % Incr. | Rosette Diameter [cm] Ave. | P-Val. | % Incr. |
|---|---|---|---|---|---|---|---|
| LYM320 | 69405.3 | 6.0 | 0.19 | 11 | 4.3 | 0.21 | 4 |
| CONT. | — | 5.4 | — | — | 4.2 | — | — |
| LYM208_H4 | 69488.5 | 10.4 | 0.27 | 5 | 5.6 | 0.20 | 3 |
| WYM16 | 69883.9 | 11.4 | L | 15 | 5.8 | L | 8 |
| WYM25 | 69725.4 | — | — | — | 5.6 | 0.25 | 4 |
| WYM16 | 69883.4 | 10.8 | 0.20 | 9 | 5.6 | 0.19 | 5 |
| LYM208_H4 | 69489.1 | 11.4 | 0.14 | 15 | 5.9 | 0.14 | 9 |
| WYM25 | 69726.1 | 10.8 | 0.05 | 9 | 5.7 | 0.10 | 6 |
| WYM81 | 69542.6 | 10.7 | 0.08 | 8 | 5.6 | 0.11 | 5 |
| WYM25 | 69725.7 | 10.5 | 0.29 | 6 | 5.6 | 0.21 | 4 |
| WYM81 | 69542.3 | 11.2 | 0.22 | 13 | 5.8 | 0.20 | 7 |
| WYM25 | 69724.1 | 12.6 | 0.06 | 27 | 6.1 | 0.05 | 13 |
| WYM25 | 69726.5 | 12.0 | 0.01 | 21 | 5.9 | 0.02 | 9 |
| LYM208_H4 | 69488.1 | 10.7 | 0.10 | 7 | 5.5 | 0.24 | 3 |
| CONT. | — | 9.9 | — | — | 5.4 | — | — |
| WYM64 | 72486.1 | 7.4 | 0.05 | 9 | 4.6 | 0.02 | 8 |
| WYM85 | 71526.6 | 7.8 | L | 15 | 4.6 | 0.02 | 8 |
| WYM29 | 71879.3 | — | — | — | 4.4 | 0.14 | 3 |
| WYM103 | 71450.3 | 7.1 | 0.21 | 4 | 4.4 | 0.16 | 4 |
| CONT. | — | 6.8 | — | — | 4.3 | — | — |
| WYM113 | 72759.3 | 7.1 | 0.23 | 9 | 4.5 | 0.22 | 5 |
| WYM103 | 71451.1 | 7.4 | 0.15 | 12 | 4.4 | 0.18 | 4 |
| WYM113 | 72759.6 | 7.0 | 0.26 | 8 | 4.4 | 0.20 | 4 |
| WYM113 | 72761.2 | 7.7 | 0.09 | 18 | 4.5 | 0.10 | 6 |
| CONT. | — | 6.5 | — | — | 4.3 | — | — |
| WYM3 | 72479.5 | — | — | — | 4.4 | 0.29 | 3 |
| CONT. | — | 6.8 | — | — | 4.3 | — | — |
| WYM85 | 71527.3 | 7.0 | 0.23 | 9 | 4.3 | 0.19 | 5 |
| WYM20 | 72492.1 | 7.7 | 0.05 | 21 | 4.5 | 0.05 | 10 |
| WYM38 | 71690.2 | 7.3 | 0.02 | 14 | 4.5 | 0.02 | 10 |
| WYM64 | 72485.8 | 7.1 | 0.08 | 11 | 4.4 | 0.08 | 6 |
| CONT. | — | 6.4 | — | — | 4.1 | — | — |
| WYM3 | 72477.1 | 8.0 | 0.06 | 10 | 4.9 | 0.03 | 8 |
| CONT. | — | 7.3 | — | — | 4.5 | — | — |
| WYM113 | 72762.1 | 6.9 | 0.20 | 6 | 4.3 | 0.18 | 3 |
| WYM85 | 71529.3 | 7.2 | 0.09 | 11 | 4.5 | 0.05 | 8 |
| WYM12 | 71893.4 | 6.9 | 0.30 | 7 | 4.4 | 0.16 | 6 |
| WYM85 | 71528.4 | 7.0 | 0.12 | 8 | 4.4 | 0.07 | 5 |
| CONT. | — | 6.5 | — | — | 4.2 | — | — |
| LAB278_H0 | 71522.4 | — | — | — | 4.2 | 0.19 | 5 |
| WYM12 | 71893.9 | — | — | — | 4.1 | 0.26 | 3 |
| WYM38 | 71690.3 | 7.3 | 0.02 | 23 | 4.5 | L | 13 |
| WYM20 | 72491.6 | 6.3 | 0.25 | 6 | 4.2 | 0.07 | 6 |
| WYM64 | 72481.7 | 6.9 | 0.04 | 17 | 4.4 | 0.01 | 11 |
| CONT. | — | 5.9 | — | — | 4.0 | — | — |
| WYM103 | 71452.1 | 6.4 | 0.26 | 2 | — | — | — |
| WYM12 | 71892.3 | 6.5 | 0.16 | 4 | — | — | — |
| CONT. | — | 6.3 | — | — | 4.2 | — | — |
| WYM3 | 72479.2 | 7.0 | 0.03 | 19 | 4.3 | 0.06 | 9 |
| WYM3 | 72475.4 | 6.2 | 0.05 | 7 | 4.1 | 0.06 | 3 |
| LAB278_H0 | 71521.5 | — | — | — | 4.1 | 0.29 | 2 |
| LAB278_H0 | 71522.7 | 6.3 | 0.21 | 7 | 4.2 | 0.16 | 4 |
| WYM38 | 71689.2 | 6.2 | 0.15 | 7 | 4.2 | 0.11 | 4 |
| CONT. | — | 5.8 | — | — | 4.0 | — | — |
| WYM3 | 72478.3 | 7.4 | 0.07 | 10 | 4.5 | 0.08 | 4 |
| CONT. | — | 6.7 | — | — | 4.3 | — | — |
| WYM64 | 72481.2 | — | — | — | 4.5 | 0.11 | 4 |
| CONT. | — | 6.8 | — | — | 4.3 | — | — |
| WYM64 | 72485.4 | — | — | — | 4.6 | 0.11 | 3 |
| CONT. | — | 7.2 | — | — | 4.4 | — | — |
| WYM113 | 72762.5 | 5.9 | 0.26 | 3 | 4.0 | 0.16 | 2 |
| WYM20 | 72489.5 | 6.5 | 0.05 | 13 | 4.2 | 0.06 | 7 |
| WYM29 | 71876.5 | 6.1 | 0.11 | 7 | 4.2 | 0.08 | 6 |
| WYM12 | 71896.5 | 6.5 | 0.07 | 14 | 4.1 | 0.10 | 5 |
| WYM64 | 72485.2 | 6.5 | 0.04 | 13 | 4.2 | L | 7 |
| WYM85 | 71526.3 | 6.9 | L | 20 | 4.3 | L | 10 |
| WYM113 | 72762.4 | 6.4 | 0.08 | 12 | 4.2 | L | 6 |
| CONT. | — | 5.7 | — | — | 3.9 | — | — |
| WYM103 | 71452.3 | 6.4 | 0.16 | 7 | 4.2 | 0.14 | 4 |
| WYM3 | 72479.9 | 6.7 | 0.07 | 12 | 4.2 | 0.13 | 4 |
| WYM85 | 71526.5 | 6.2 | 0.30 | 5 | 4.1 | 0.21 | 3 |
| WYM103 | 71450.5 | 6.2 | 0.22 | 5 | 4.1 | 0.30 | 2 |
| CONT. | — | 5.9 | — | — | 4.0 | — | — |
| LYM350 | 69417.1 | 12.5 | 0.04 | 10 | 6.4 | 0.05 | 9 |
| LYM350 | 69418.6 | — | — | — | 6.1 | 0.23 | 5 |
| LYM350 | 69421.2 | 12.8 | 0.16 | 12 | 6.2 | 0.15 | 7 |
| CONT. | — | 11.4 | — | — | 5.9 | — | — |
| WYM67 | 70022.7 | 9.6 | 0.04 | 8 | 5.2 | 0.11 | 3 |
| WYM72 | 70043.1 | 10.1 | 0.06 | 14 | 5.4 | 0.07 | 8 |
| WYM91 | 70012.10 | 10.7 | 0.01 | 21 | 5.6 | 0.01 | 12 |
| WYM72 | 70043.5 | 9.9 | 0.18 | 12 | — | — | — |
| WYM43 | 69949.7 | 10.7 | 0.03 | 21 | 5.7 | 0.03 | 13 |
| WYM91 | 70011.7 | 9.4 | 0.20 | 5 | 5.1 | 0.25 | 2 |
| WYM72 | 70045.9 | 9.9 | 0.20 | 11 | 5.3 | 0.13 | 6 |
| WYM91 | 70011.4 | 9.5 | 0.25 | 7 | 5.4 | 0.14 | 7 |
| WYM23 | 69658.2 | 10.8 | L | 22 | 5.7 | L | 14 |
| WYM67 | 70023.2 | 12.2 | 0.02 | 37 | 6.0 | 0.04 | 19 |
| WYM43 | 69945.2 | 10.4 | 0.06 | 17 | 5.5 | 0.10 | 10 |
| WYM43 | 69947.4 | 10.5 | 0.06 | 18 | 5.4 | 0.10 | 8 |
| WYM91 | 70012.4 | 9.7 | 0.19 | 9 | 5.4 | 0.15 | 7 |
| WYM43 | 69949.3 | 11.2 | 0.04 | 26 | 5.9 | 0.02 | 17 |
| WYM91 | 70012.7 | 12.2 | L | 37 | 5.9 | L | 18 |
| WYM72 | 70044.3 | 10.0 | 0.06 | 12 | 5.3 | 0.05 | 6 |
| WYM23 | 69656.1 | 9.5 | 0.25 | 7 | 5.3 | 0.18 | 6 |
| WYM43 | 69947.5 | 10.3 | 0.08 | 16 | 5.5 | 0.06 | 10 |
| WYM72 | 70043.7 | 12.0 | 0.04 | 35 | 5.9 | 0.05 | 18 |
| WYM23 | 69659.1 | 10.2 | 0.21 | 14 | 5.3 | 0.26 | 5 |
| WYM23 | 69658.4 | 10.2 | 0.20 | 15 | 5.4 | 0.21 | 8 |
| WYM72 | 70045.2 | 9.7 | L | 9 | 5.3 | 0.07 | 5 |
| WYM72 | 70044.1 | 9.8 | 0.11 | 10 | 5.4 | 0.08 | 8 |
| WYM43 | 69944.4 | 10.8 | L | 21 | 5.9 | L | 18 |
| WYM43 | 69949.10 | 10.9 | 0.03 | 22 | 5.6 | 0.04 | 12 |
| WYM67 | 70023.1 | 11.0 | 0.06 | 24 | 5.7 | 0.05 | 13 |
| WYM23 | 69657.4 | 10.5 | L | 18 | 5.7 | L | 13 |
| WYM72 | 70043.2 | 11.5 | 0.06 | 29 | 5.7 | 0.07 | 13 |
| WYM43 | 69949.6 | 10.2 | 0.05 | 15 | 5.4 | 0.02 | 8 |
| WYM67 | 70023.3 | 10.5 | 0.03 | 18 | 5.5 | 0.10 | 9 |
| WYM23 | 69660.3 | 11.0 | 0.05 | 24 | 5.6 | 0.05 | 11 |
| WYM23 | 69661.4 | 10.3 | 0.08 | 16 | 5.5 | 0.03 | 10 |
| WYM23 | 69661.7 | 10.8 | L | 22 | 5.5 | 0.06 | 10 |
| WYM43 | 69949.11 | 9.7 | 0.04 | 9 | 5.3 | 0.05 | 6 |
| CONT. | — | 8.9 | — | — | 5.0 | — | — |
| WYM69 | 69529.4 | — | — | — | 5.9 | 0.21 | 2 |
| CONT. | — | 11.0 | — | — | 5.8 | — | — |

Table 61.
"CONT."—Control;
"Ave."—Average;
"% Incr." = % increment;
"p-val."—p-value,
L—p < 0.01.

TABLE 62

Genes showing improved plant performance at normal growth conditions under regulation of At6669 promoter

| Gene Name | Event # | GR Of Rosette Diameter [cm/day] Ave. | P-Val. | % Incr. |
|---|---|---|---|---|
| LAB259 | 69401.8 | 0.4 | 0.02 | 19 |
| WYM18 | 70938.3 | 0.4 | 0.01 | 22 |
| WYM30 | 69672.2 | 0.4 | 0.10 | 16 |
| WYM83 | 70956.7 | 0.4 | 0.09 | 16 |
| WYM83 | 70953.1 | 0.4 | 0.01 | 24 |
| WYM105 | 70931.3 | 0.4 | 0.27 | 9 |
| CONT. | — | 0.3 | — | — |
| WYM48 | 69972.5 | 0.4 | 0.03 | 16 |
| WYM86 | 70917.3 | 0.4 | L | 22 |
| LAB259 | 69400.1 | 0.4 | 0.01 | 19 |
| WYM30 | 69668.2 | 0.4 | 0.10 | 11 |

TABLE 62-continued

Genes showing improved plant performance at normal growth conditions under regulation of At6669 promoter

| Gene Name | Event # | GR Of Rosette Diameter [cm/day] Ave. | P-Val. | % Incr. |
|---|---|---|---|---|
| LYM91 | 69394.5 | 0.4 | 0.07 | 12 |
| CONT. | — | 0.3 | — | — |
| WYM86 | 70918.6 | 0.4 | 0.10 | 14 |
| WYM83 | 70951.4 | 0.4 | 0.03 | 19 |
| CONT. | — | 0.4 | — | — |
| WYM86 | 70919.2 | 0.4 | 0.14 | 9 |
| WYM87 | 70960.8 | 0.4 | 0.14 | 11 |
| WYM32 | 70414.3 | 0.4 | 0.06 | 11 |
| WYM32 | 70413.2 | 0.4 | 0.06 | 12 |
| WYM83 | 70956.5 | 0.4 | 0.13 | 11 |
| WYM30 | 69672.4 | 0.4 | 0.02 | 14 |
| LYM91 | 69395.2 | 0.4 | 0.06 | 11 |
| CONT. | — | 0.3 | — | — |
| WYM18 | 70938.7 | 0.5 | 0.21 | 10 |
| CONT. | — | 0.4 | — | — |
| WYM105 | 70932.10 | 0.4 | 0.29 | 7 |
| LYM91 | 69395.1 | 0.4 | 0.25 | 7 |
| WYM87 | 70961.7 | 0.4 | 0.24 | 8 |
| WYM30 | 69672.1 | 0.4 | 0.25 | 7 |
| LAB259 | 69401.1 | 0.4 | L | 19 |
| CONT. | — | 0.3 | — | — |
| WYM32 | 70417.1 | 0.4 | 0.01 | 18 |
| WYM86 | 70919.1 | 0.4 | 0.11 | 10 |
| WYM83 | 70956.1 | 0.4 | 0.08 | 11 |
| WYM86 | 70920.1 | 0.4 | L | 20 |
| CONT. | — | 0.3 | — | — |
| WYM48 | 69968.1 | 0.4 | 0.13 | 10 |
| LAB259 | 69401.6 | 0.4 | 0.11 | 9 |
| CONT. | — | 0.4 | — | — |
| WYM32 | 70415.3 | 0.4 | 0.25 | 8 |
| CONT. | — | 0.4 | — | — |
| WYM18 | 70937.3 | 0.4 | 0.29 | 7 |
| WYM32 | 70416.11 | 0.5 | 0.03 | 16 |
| WYM61 | 69978.2 | 0.4 | 0.15 | 10 |
| WYM18 | 70938.5 | 0.4 | 0.21 | 9 |
| CONT. | — | 0.4 | — | — |
| WYM48 | 69970.4 | 0.4 | 0.24 | 12 |
| LYM91 | 69395.3 | 0.4 | 0.06 | 15 |
| WYM32 | 70416.4 | 0.4 | 0.23 | 9 |
| WYM87 | 70962.5 | 0.4 | 0.06 | 17 |
| WYM61 | 69979.4 | 0.4 | 0.06 | 16 |
| CONT. | — | 0.4 | — | — |
| WYM83 | 70956.4 | 0.4 | 0.12 | 10 |
| WYM86 | 70917.2 | 0.4 | 0.14 | 11 |
| WYM61 | 69977.1 | 0.4 | 0.07 | 12 |
| WYM30 | 69670.2 | 0.4 | 0.10 | 11 |
| LAB259 | 69399.6 | 0.4 | L | 19 |
| WYM61 | 69977.4 | 0.4 | 0.03 | 14 |
| WYM30 | 69670.1 | 0.4 | 0.06 | 14 |
| LYM91 | 69394.2 | 0.3 | 0.21 | 8 |
| CONT. | — | 0.3 | — | — |
| WYM105 | 70928.2 | 0.4 | 0.16 | 11 |
| WYM86 | 70918.7 | 0.4 | 0.08 | 12 |
| WYM18 | 70937.11 | 0.4 | 0.21 | 8 |
| CONT. | — | 0.4 | — | — |
| WYM48 | 69973.1 | 0.4 | 0.04 | 14 |
| WYM86 | 70920.4 | 0.4 | 0.23 | 7 |
| WYM48 | 69973.5 | 0.4 | 0.16 | 9 |
| WYM32 | 70416.6 | 0.4 | 0.22 | 7 |
| LYM91 | 69392.4 | 0.4 | 0.01 | 16 |
| CONT. | — | 0.4 | — | — |
| LYM490_H1 | 71155.4 | 0.5 | 0.16 | 11 |
| CONT. | — | 0.5 | — | — |
| WYM35 | 71163.1 | 0.5 | 0.25 | 8 |
| WYM90 | 71891.2 | 0.5 | 0.28 | 8 |
| CONT. | — | 0.4 | — | — |
| WYM112 | 69928.3 | 0.5 | 0.10 | 13 |
| WYM34 | 71768.2 | 0.4 | 0.26 | 9 |
| WYM34 | 71769.1 | 0.5 | 0.09 | 13 |
| WYM71 | 72162.1 | 0.4 | 0.28 | 8 |
| CONT. | — | 0.4 | — | — |
| WYM21 | 71763.3 | 0.5 | 0.30 | 9 |
| CONT. | — | 0.5 | — | — |
| WYM35 | 71162.9 | 0.5 | 0.24 | 9 |
| CONT. | — | 0.4 | — | — |
| WYM90 | 71888.1 | 0.4 | 0.26 | 8 |
| CONT. | — | 0.4 | — | — |
| WYM79 | 69537.4 | 0.4 | L | 21 |
| WYM70 | 70034.6 | 0.3 | 0.01 | 12 |
| WYM79 | 69537.3 | 0.3 | L | 12 |
| WYM24 | 69663.3 | 0.3 | L | 14 |
| LYM320 | 69406.3 | 0.3 | 0.07 | 9 |
| WYM79 | 69537.2 | 0.3 | L | 12 |
| WYM93 | 69690.2 | 0.3 | L | 11 |
| WYM94 | 69628.3 | 0.3 | 0.06 | 12 |
| CONT. | — | 0.3 | — | — |
| WYM24 | 69667.7 | 0.3 | 0.02 | 16 |
| WYM79 | 69536.2 | 0.3 | 0.13 | 7 |
| WYM31 | 69730.9 | 0.3 | 0.22 | 6 |
| WYM15 | 69495.5 | 0.3 | 0.10 | 10 |
| WYM70 | 70034.2 | 0.3 | L | 12 |
| WYM31 | 69730.7 | 0.3 | 0.02 | 12 |
| WYM15 | 69497.4 | 0.3 | 0.17 | 8 |
| CONT. | — | 0.3 | — | — |
| WYM94 | 69631.2 | 0.3 | 0.11 | 11 |
| WYM31 | 69730.4 | 0.3 | 0.29 | 5 |
| CONT. | — | 0.3 | — | — |
| WYM15 | 69499.5 | 0.3 | 0.09 | 9 |
| WYM93 | 69686.1 | 0.3 | 0.15 | 7 |
| WYM15 | 69495.2 | 0.4 | L | 18 |
| WYM79 | 69541.2 | 0.4 | L | 16 |
| WYM55 | 69509.5 | 0.3 | 0.11 | 8 |
| CONT. | — | 0.3 | — | — |
| WYM70 | 70039.7 | 0.4 | 0.06 | 10 |
| WYM65 | 69520.4 | 0.3 | 0.20 | 8 |
| CONT. | — | 0.3 | — | — |
| WYM31 | 69729.3 | 0.3 | 0.29 | 4 |
| WYM65 | 69519.3 | 0.3 | 0.14 | 5 |
| WYM94 | 69629.3 | 0.3 | 0.07 | 9 |
| CONT. | — | 0.3 | — | — |
| WYM65 | 69523.2 | 0.3 | 0.11 | 8 |
| WYM79 | 69538.1 | 0.3 | 0.13 | 7 |
| CONT. | — | 0.3 | — | — |
| WYM24 | 69662.2 | 0.4 | 0.01 | 12 |
| WYM94 | 69630.1 | 0.3 | 0.13 | 7 |
| WYM24 | 69662.1 | 0.3 | 0.22 | 6 |
| WYM93 | 69688.1 | 0.3 | 0.02 | 9 |
| WYM79 | 69539.4 | 0.3 | 0.23 | 6 |
| CONT. | — | 0.3 | — | — |
| WYM55 | 69507.2 | 0.4 | 0.28 | 6 |
| WYM70 | 70039.6 | 0.4 | 0.25 | 6 |
| WYM22 | 69504.2 | 0.4 | 0.21 | 7 |
| CONT. | — | 0.3 | — | — |
| WYM64 | 72486.1 | 0.3 | 0.13 | 9 |
| WYM85 | 71526.6 | 0.3 | 0.09 | 10 |
| WYM29 | 71879.3 | 0.3 | 0.22 | 8 |
| CONT. | — | 0.3 | — | — |
| WYM20 | 72492.1 | 0.3 | 0.12 | 10 |
| WYM38 | 71690.2 | 0.3 | 0.03 | 11 |
| WYM64 | 72485.8 | 0.3 | 0.16 | 8 |
| CONT. | — | 0.3 | — | — |
| WYM3 | 72477.1 | 0.4 | 0.10 | 10 |
| CONT. | — | 0.3 | — | — |
| WYM85 | 71529.3 | 0.3 | 0.29 | 8 |
| CONT. | — | 0.3 | — | — |
| WYM38 | 71690.3 | 0.3 | 0.11 | 13 |
| WYM20 | 72491.6 | 0.3 | 0.20 | 10 |
| WYM64 | 72481.7 | 0.3 | 0.04 | 16 |
| CONT. | — | 0.3 | — | — |
| WYM3 | 72478.3 | 0.3 | 0.29 | 6 |
| CONT. | — | 0.3 | — | — |
| WYM64 | 72485.4 | 0.3 | 0.18 | 8 |
| CONT. | — | 0.3 | — | — |
| WYM64 | 72485.2 | 0.3 | 0.18 | 7 |
| WYM85 | 71526.3 | 0.3 | 0.21 | 7 |
| CONT. | — | 0.3 | — | — |

TABLE 62-continued

Genes showing improved plant performance at normal growth conditions under regulation of At6669 promoter

| | | GR Of Rosette Diameter [cm/day] | | |
|---|---|---|---|---|
| Gene Name | Event # | Ave. | P-Val. | % Incr. |
| LYM350 | 69417.1 | 0.6 | 0.18 | 10 |
| CONT. | — | 0.5 | — | — |
| WYM43 | 69949.7 | 0.4 | 0.20 | 14 |
| WYM23 | 69658.2 | 0.4 | 0.14 | 15 |
| WYM67 | 70023.2 | 0.5 | 0.03 | 24 |
| WYM43 | 69949.3 | 0.5 | 0.04 | 22 |
| WYM91 | 70012.7 | 0.4 | 0.06 | 19 |
| WYM72 | 70043.7 | 0.4 | 0.10 | 18 |
| WYM72 | 70044.1 | 0.4 | 0.17 | 14 |
| WYM43 | 69944.4 | 0.5 | 0.05 | 21 |
| WYM43 | 69949.10 | 0.4 | 0.08 | 19 |
| WYM67 | 70023.1 | 0.4 | 0.17 | 15 |
| WYM23 | 69657.4 | 0.4 | 0.12 | 16 |
| WYM72 | 70043.2 | 0.4 | 0.22 | 13 |
| WYM23 | 69660.3 | 0.4 | 0.16 | 15 |
| WYM23 | 69661.7 | 0.4 | 0.21 | 13 |
| CONT. | — | 0.4 | — | — |

Table 62. "CONT."—Control;
"Ave."—Average;
"% Incr." = % increment;
"p-val."—p-value,
L—p < 0.01.

Example 20

Evaluating Transgenic *Arabidopsis* Under Normal Conditions Using In Vitro Assays [Tissue Culture T2 and T1 Plants, TC-T2 and TC-T1 Assays]

Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N). For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (transformed with an empty vector containing the selection marker or GUS reporter gene under the control of the same promoter) used in the same experiment.

Digital Imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F). An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling Analysis—Using the digital analysis seedling data was calculated, including leaf area, root coverage and root length.

The growth rate for the various seedling parameters was calculated according to the following formulas XXI (GR leaf area, below), XXII (GR root coverage, described below) and XXIII (GR root length, below).

Growth rate of leaf area=Regression coefficient of leaf area along time course.     Formula XXI:

Growth rate of root coverage=Regression coefficient of root coverage along time course.     Formula XXII:

Growth rate of root length=Regression coefficient of root length along time course.     Formula XXIII:

At the end of the experiment, plantlets were removed from the media and weighed for the determination of plant fresh weight. Plantlets were then dried for 24 hours at 60° C., and weighed again to measure plant dry weight for later statistical analysis. The fresh and dry weights were provided for each *Arabidopsis* plant. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events were examined in replicates.

Statistical Analyses—To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if p≤0.1. The JMP statistics software package is used (Version 5.2.1, SAS Institute Inc., Cary, N.C., USA).

Experimental Results:

Tables 63-65 summarize the observed phenotypes of transgenic plants expressing the gene constructs using the TC-T2 Assays.

The genes presented in Table 63 showed a significant improvement as they produced larger plant biomass (plant fresh and dry weight) in T2 generation when grown under normal growth conditions, compared to control plants. The genes were cloned under the regulation of a constitutive promoter (At6669, SEQ ID NO:9405).

The evaluation of each gene was carried out by testing the performance of different number of events. Some of the genes were evaluated in more than one tissue culture assay. The results obtained in these second experiments were significantly positive as well.

TABLE 63

Genes showing improved plant performance at normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| WYM40 | 71881.6 | 6.1 | 0.22 | 18 | 142.5 | 0.13 | 33 |
| WYM8 | 71394.3 | 6.8 | 0.05 | 32 | 144.1 | 0.09 | 34 |
| WYM8 | 71398.4 | — | — | — | 123.6 | 0.25 | 15 |
| WYM36 | 71030.2 | 7.2 | 0.01 | 38 | 142.5 | 0.02 | 33 |
| WYM40 | 71883.5 | 6.2 | 0.06 | 20 | 129.5 | 0.05 | 20 |
| WYM104 | 70921.1 | 6.9 | L | 33 | 142.1 | L | 32 |
| WYM8 | 71397.2 | 6.2 | 0.12 | 19 | — | — | — |
| CONT. | — | 5.2 | — | — | 107.4 | — | — |
| WYM107 | 69962.1 | 8.4 | 0.17 | 33 | 145.1 | 0.22 | 26 |
| LYM332 | 69412.2 | 8.4 | 0.02 | 34 | 149.0 | 0.05 | 29 |
| WYM1 | 69695.2 | — | — | — | 123.5 | 0.26 | 7 |
| WYM1 | 69693.2 | 7.1 | 0.17 | 13 | 126.4 | 0.19 | 10 |
| LYM332 | 69412.5 | 9.0 | L | 42 | 171.5 | L | 49 |
| WYM59 | 69705.1 | 9.6 | 0.06 | 52 | 170.4 | 0.07 | 48 |
| CONT. | — | 6.3 | — | — | 115.3 | — | — |
| WYM36 | 71031.2 | 5.8 | 0.10 | 58 | 119.7 | 0.07 | 65 |
| WYM104 | 70921.8 | 4.6 | 0.29 | 25 | 112.9 | 0.16 | 55 |
| WYM104 | 70925.2 | 5.5 | L | 51 | 130.3 | 0.01 | 79 |
| WYM104 | 70925.3 | 5.5 | L | 49 | 101.1 | 0.06 | 39 |
| WYM36 | 71033.6 | 7.1 | 0.02 | 92 | 147.4 | L | 103 |
| CONT. | — | 3.7 | — | — | 72.7 | — | — |

Table 63.
"CONT."—Control;
"Ave."—Average;
"% Incr." = % increment;
"p-val."—p-value,
L—p < 0.01.

The genes presented in Tables 64-65 show a significant improvement in plant performance since they produced a larger leaf biomass (leaf area) and root biomass (root length and root coverage) (Table 64) and a higher growth rate of leaf area, root coverage and root length (Table 65) when grown under normal growth conditions, compared to control plants. Plants producing larger root biomass have better possibilities to absorb larger amount of nitrogen from soil. Plants producing larger leaf biomass have better ability to produce assimilates. The genes were cloned under the regulation of a constitutive promoter (At6669). The evaluation of each gene was performed by testing the performance of different number of events. Some of the genes were evaluated in more than one tissue culture assay. This second experiment confirmed the significant increment in leaf and root performance. Event with p-value<0.1 was considered statistically significant.

TABLE 64

Genes showing improved plant performance at normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| WYM104 | 70926.1 | — | — | — | 9.4 | L | 35 | 7.3 | 0.07 | 17 |
| WYM104 | 70921.5 | — | — | — | 7.9 | 0.19 | 13 | 7.0 | 0.09 | 12 |
| WYM40 | 71882.2 | — | — | — | — | — | — | 6.7 | 0.25 | 7 |
| WYM104 | 70922.3 | — | — | — | — | — | — | 7.3 | 0.04 | 17 |
| WYM40 | 71881.6 | 0.6 | 0.23 | 14 | 10.0 | 0.09 | 45 | 7.0 | 0.17 | 12 |
| WYM8 | 71394.3 | 0.7 | L | 35 | 9.0 | 0.03 | 30 | 7.0 | 0.02 | 12 |
| WYM36 | 71031.2 | — | — | — | — | — | — | 6.6 | 0.20 | 5 |
| WYM8 | 71398.4 | — | — | — | — | — | — | 6.6 | 0.20 | 6 |
| WYM36 | 71030.2 | 0.6 | L | 26 | 8.3 | 0.07 | 19 | — | — | — |
| WYM40 | 71883.5 | 0.6 | 0.06 | 13 | — | — | — | — | — | — |
| WYM104 | 70921.1 | 0.6 | L | 23 | 7.6 | 0.29 | 10 | — | — | — |
| WYM8 | 71397.2 | 0.5 | 0.25 | 8 | — | — | — | — | — | — |
| WYM8 | 71395.5 | — | — | — | — | — | — | 6.5 | 0.26 | 3 |
| WYM40 | 71880.2 | — | — | — | — | — | — | 7.4 | L | 18 |
| CONT. | — | 0.5 | — | — | 6.9 | — | — | 6.3 | — | — |
| WYM59 | 69704.11 | — | — | — | 5.9 | 0.09 | 19 | 6.5 | 0.02 | 19 |
| WYM107 | 69962.1 | 0.6 | 0.14 | 21 | 6.5 | 0.08 | 32 | 5.8 | 0.20 | 6 |
| WYM107 | 69962.3 | 0.5 | 0.26 | 6 | — | — | — | — | — | — |
| WYM107 | 69962.4 | 0.5 | 0.22 | 9 | 6.1 | 0.05 | 24 | 5.8 | 0.27 | 6 |
| LYM332 | 69410.2 | — | — | — | 5.8 | 0.18 | 19 | 5.8 | 0.22 | 6 |
| LYM332 | 69412.2 | 0.7 | L | 30 | 6.7 | 0.01 | 37 | — | — | — |
| WYM9 | 69551.10 | — | — | — | — | — | — | 6.1 | 0.01 | 12 |
| WYM1 | 69692.7 | — | — | — | — | — | — | 5.8 | 0.22 | 5 |
| WYM1 | 69697.1 | — | — | — | 6.1 | 0.05 | 25 | 6.3 | 0.02 | 15 |
| LYM332 | 69410.3 | — | — | — | — | — | — | 5.7 | 0.10 | 4 |
| WYM1 | 69695.1 | 0.6 | 0.11 | 12 | 5.5 | 0.19 | 11 | 5.9 | 0.16 | 8 |
| WYM1 | 69695.2 | 0.5 | 0.15 | 9 | — | — | — | — | — | — |
| LYM332 | 69413.4 | — | — | — | — | — | — | 6.2 | L | 13 |
| WYM1 | 69693.2 | 0.7 | L | 34 | 6.6 | L | 35 | 6.7 | L | 23 |
| WYM76 | 70028.2 | — | — | — | 6.8 | 0.06 | 38 | 5.7 | 0.28 | 5 |

TABLE 64-continued

Genes showing improved plant performance at normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| WYM1 | 69692.6 | 0.6 | 0.09 | 13 | 6.0 | 0.09 | 23 | 6.3 | L | 15 |
| LYM332 | 69412.3 | 0.5 | 0.24 | 9 | — | — | — | 5.7 | 0.14 | 4 |
| LYM332 | 69410.6 | 0.6 | 0.15 | 10 | 5.3 | 0.17 | 9 | 5.8 | 0.17 | 6 |
| LYM332 | 69412.4 | 0.6 | 0.16 | 22 | — | — | — | — | — | — |
| WYM59 | 69704.6 | 0.6 | 0.11 | 13 | 5.9 | L | 20 | 6.3 | L | 15 |
| LYM332 | 69412.5 | 0.7 | L | 41 | 7.1 | 0.02 | 46 | 5.8 | 0.19 | 6 |
| WYM1 | 69693.4 | — | — | — | — | — | — | 6.1 | 0.01 | 12 |
| WYM59 | 69705.1 | 0.7 | 0.01 | 46 | 7.9 | L | 61 | 6.5 | L | 19 |
| WYM59 | 69708.2 | — | — | — | — | — | — | 5.9 | 0.17 | 8 |
| WYM59 | 69704.4 | — | — | — | — | — | — | 5.9 | 0.03 | 9 |
| WYM59 | 69708.3 | — | — | — | 5.8 | 0.17 | 19 | 5.7 | 0.27 | 5 |
| WYM9 | 69553.6 | — | — | — | — | — | — | 6.3 | L | 16 |
| WYM9 | 69550.2 | — | — | — | — | — | — | 5.6 | 0.22 | 3 |
| CONT. | — | 0.5 | — | — | 4.9 | — | — | 5.5 | — | — |
| WYM36 | 71031.2 | 0.5 | 0.08 | 53 | 7.7 | 0.10 | 22 | — | — | — |
| WYM36 | 71033.4 | 0.4 | 0.11 | 16 | — | — | — | — | — | — |
| WYM104 | 70921.8 | 0.5 | 0.08 | 37 | 9.5 | 0.10 | 51 | 7.7 | L | 18 |
| WYM104 | 70925.2 | 0.6 | L | 59 | 9.2 | 0.02 | 47 | 7.0 | 0.18 | 7 |
| WYM104 | 70925.3 | 0.5 | L | 39 | 8.7 | 0.02 | 38 | 6.8 | 0.11 | 5 |
| WYM104 | 70922.3 | — | — | — | — | — | — | 7.3 | L | 12 |
| WYM36 | 71033.6 | 0.7 | L | 85 | 8.3 | L | 32 | — | — | — |
| WYM36 | 71029.4 | 0.4 | 0.07 | 10 | — | — | — | — | — | — |
| WYM36 | 71033.2 | 0.4 | 0.21 | 6 | — | — | — | — | — | — |
| WYM36 | 71034.4 | 0.5 | 0.14 | 34 | — | — | — | — | — | — |
| CONT. | — | 0.4 | — | — | 6.3 | — | — | 6.5 | — | — |

Table 64.
"CONT."—Control;
"Ave."—Average;
"% Incr." = % increment;
"p-val."—p-value,
L—p < 0.01.

TABLE 65

Genes showing improved plant performance at normal growth conditions under regulation of At6669 promoter

| Gene Name | Event # | GR Of Leaf Area [cm²/day] | | | GR Of Roots Coverage [cm²/day] | | | GR Of Root Length [cm/day] | | |
|---|---|---|---|---|---|---|---|---|---|---|
| | | Ave. | P-Val. | % Incr. | Ave. | P-Val. | % Incr. | Ave | P-Val. | % Incr. |
| WYM104 | 70926.1 | — | — | — | 1.1 | 0.04 | 36 | 0.7 | 0.09 | 20 |
| WYM104 | 70921.5 | — | — | — | — | — | — | 0.7 | 0.23 | 13 |
| WYM104 | 70922.3 | — | — | — | — | — | — | 0.7 | 0.21 | 14 |
| WYM40 | 71881.6 | — | — | — | 1.2 | 0.03 | 47 | 0.7 | 0.29 | 13 |
| WYM8 | 71394.3 | 0.1 | 0.04 | 32 | 1.1 | 0.08 | 31 | 0.7 | 0.26 | 12 |
| WYM36 | 71030.2 | 0.1 | 0.10 | 29 | 1.0 | 0.28 | 22 | — | — | — |
| WYM104 | 70921.1 | 0.1 | 0.29 | 16 | — | — | — | — | — | — |
| WYM40 | 71880.2 | — | — | — | — | — | — | 0.7 | 0.09 | 18 |
| CONT. | — | 0.1 | — | — | 0.8 | — | — | 0.6 | — | — |
| WYM59 | 69704.11 | — | — | — | 0.7 | 0.18 | 21 | 0.5 | 0.03 | 27 |
| WYM107 | 69962.1 | 0.1 | 0.26 | 22 | 0.7 | 0.05 | 32 | — | — | — |
| WYM107 | 69962.3 | — | — | — | — | — | — | 0.5 | 0.17 | 15 |

TABLE 65-continued

Genes showing improved plant performance at normal growth conditions under regulation of At6669 promoter

| Gene Name | Event # | GR Of Leaf Area [cm²/day] | | | GR Of Roots Coverage [cm²/day] | | | GR Of Root Length [cm/day] | | |
|---|---|---|---|---|---|---|---|---|---|---|
| | | Ave. | P-Val. | % Incr. | Ave. | P-Val. | % Incr. | Ave | P-Val. | % Incr. |
| WYM107 | 69962.4 | — | — | — | 0.7 | 0.06 | 27 | 0.5 | 0.29 | 13 |
| LYM332 | 69410.2 | — | — | — | 0.7 | 0.20 | 20 | 0.5 | 0.07 | 22 |
| LYM332 | 69412.2 | 0.1 | 0.11 | 27 | 0.8 | L | 43 | 0.5 | 0.18 | 17 |
| WYM1 | 69692.7 | — | — | — | — | — | — | 0.5 | 0.12 | 18 |
| WYM1 | 69697.1 | — | — | — | 0.7 | 0.13 | 22 | — | — | — |
| WYM1 | 69695.1 | — | — | — | — | — | — | 0.5 | 0.06 | 22 |
| WYM59 | 69704.14 | — | — | — | — | — | — | 0.5 | 0.23 | 13 |
| LYM332 | 69413.4 | — | — | — | — | — | — | 0.5 | 0.03 | 24 |
| WYM1 | 69693.2 | 0.1 | 0.04 | 35 | 0.8 | L | 39 | 0.6 | L | 40 |
| WYM76 | 70028.2 | — | — | — | 0.8 | 0.02 | 38 | — | — | — |
| WYM1 | 69692.6 | — | — | — | 0.7 | 0.10 | 24 | 0.5 | L | 30 |
| LYM332 | 69412.3 | — | — | — | — | — | — | 0.5 | 0.28 | 11 |
| LYM332 | 69410.6 | — | — | — | — | — | — | 0.5 | 0.26 | 13 |
| WYM59 | 69704.6 | — | — | — | 0.7 | 0.16 | 19 | 0.5 | 0.21 | 14 |
| LYM332 | 69412.5 | 0.1 | L | 47 | 0.8 | L | 51 | 0.5 | 0.03 | 26 |
| WYM1 | 69693.4 | — | — | — | — | — | — | 0.5 | 0.13 | 19 |
| WYM59 | 69705.1 | 0.1 | 0.01 | 47 | 0.9 | L | 60 | — | — | — |
| WYM59 | 69708.2 | — | — | — | — | — | — | 0.5 | 0.02 | 30 |
| WYM59 | 69704.4 | — | — | — | — | — | — | 0.5 | 0.21 | 13 |
| WYM59 | 69708.3 | — | — | — | 0.7 | 0.24 | 18 | — | — | — |
| WYM9 | 69553.6 | — | — | — | — | — | — | 0.5 | 0.09 | 20 |
| WYM9 | 69550.2 | — | — | — | — | — | — | 0.5 | 0.14 | 16 |
| CONT. | — | 0.1 | — | — | 0.6 | — | — | 0.4 | — | — |
| WYM36 | 71031.2 | 0.1 | 0.01 | 52 | 0.9 | 0.17 | 21 | — | — | — |
| WYM104 | 70921.8 | 0.0 | 0.03 | 38 | 1.2 | 0.01 | 51 | 0.7 | 0.05 | 15 |
| WYM104 | 70925.2 | 0.1 | L | 53 | 1.1 | L | 47 | — | — | — |
| WYM104 | 70925.3 | 0.1 | L | 41 | 1.1 | 0.01 | 40 | 0.7 | 0.05 | 14 |
| WYM104 | 70922.3 | — | — | — | — | — | — | 0.7 | 0.10 | 12 |
| WYM36 | 71033.6 | 0.1 | L | 83 | 1.0 | 0.04 | 32 | 0.7 | 0.19 | 10 |
| WYM36 | 71034.4 | 0.0 | 0.13 | 28 | — | — | — | — | — | — |
| CONT. | — | 0.0 | — | — | 0.8 | — | — | 0.6 | — | — |

Table 65.
"CONT."—Control;
"Ave."—Average;
"% Incr." = % increment;
"p-val."—p-value,
L—p < 0.01.

Results from T1 Plants

Tables 66-68 summarize the observed phenotypes of transgenic plants expressing the gene constructs using the TC-T1 Assays.

The genes presented in Tables 66-68 showed a significant improvement in plant biomass and root development since they exhibit increased biomass (dry and fresh weight) (Table 66), produced a larger leaf and root biomass (leaf area, root length and root coverage) (Table 67), and a higher growth rate of leaf area, root coverage and root length (Table 68) when grown under normal growth conditions, compared to control plants. Plants producing larger root biomass have better possibilities to absorb larger amount of nitrogen from soil. Plants producing larger leaf biomass has better ability to produce assimilates). The genes were cloned under the regulation of a constitutive promoter (At6669; SEQ ID NO:9405). The evaluation of each gene was performed by testing the performance of different number of events. Some of the genes were evaluated in more than one tissue culture assay. This second experiment confirmed the significant increment in leaf and root performance. Event with p-value<0.1 was considered statistically significant.

TABLE 66

Genes showing improved plant performance at normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| WYM56 | 73450 | 0.0044 | 0.26 | 8 | — | — | — |
| CONT. | — | 0.0041 | — | — | — | — | — |

Table 66.
"CONT."—Control;
"Ave."—Average;
"% Incr." = % increment;
"p-val."—p-value,
L—p < 0.01.

TABLE 67

Genes showing improved plant performance at normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| WYM56 | 73450 | 0.44 | 0.1 | 11 | 5.92 | 0.03 | 48 | 5.9 | 0.007 | 22 |
| CONT. | — | 0.39 | — | — | 3.98 | — | — | 4.8 | — | — |

Table 67.
"CONT."—Control;
"Ave."—Average;
"% Incr." = % increment;
"p-val."—p-value,
L—p < 0.01.

TABLE 68

Genes showing improved plant performance at normal growth conditions under regulation of At6669 promoter

| Gene Name | Event # | GR Of Leaf Area [cm²/day] | | | GR Of Roots Coverage [cm²/day] | | | GR Of Root Length [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| WYM56 | 73450 | 0.046 | 0.04 | 23 | 0.72 | 0.01 | 50 | 0.67 | 0.01 | 25 |
| CONT. | — | 0.038 | — | — | 0.48 | — | — | 0.53 | — | — |

Table 68.
"CONT."—Control;
"Ave."—Average;
"% Incr." = % increment;
"p-val."—p-value,
L—p < 0.01

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

LENGTHY TABLES

The patent contains a lengthy table section. A copy of the table is available in electronic form from the USPTO web site (http://seqdata.uspto.gov/?pageRequest=docDetail&DocID=US10260073B2). An electronic copy of the table will also be available from the USPTO upon request and payment of the fee set forth in 37 CFR 1.19(b)(3).

SEQUENCE LISTING (9813 sequences)

SEQ ID NO: 1 - DNA, 2182 bp, Zea mays
catcgacctcgatccattgaataattttactaatcaaattcttgttgggatatattcctccaattcccctcctcctcccaacaaggcaacaacaatctgttccggccgccaaacaaaacccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtcggggagcgcggccgacctggcctccgggggcaggaggtcgtccggcgtgccggtgttcgtcatgatgccgctggacaccgtcaaggagtgcggcaccgcgctgcaccgccgcaaggcggtgcaggccagcctctccgcgctcaagagcgcgggcgtcgagggcgtcatggtggacgtgtggtggggcatcgccgagcgcgacggcccgggccggtacaacttcgcgggctacgcggagctcatggagatggcgcgcaaggccgggctcaaggtccaggccgtcatgtccttccaccagtgcggcggcaacgtcggcgactccgtcagcatcccgctgccgcggtgggccgcggaggagatggagagggaccaggacctctgctacaccgaccagtggggccgccgcaactacgagtacgtctcgctcggctgcgacgccatgcccgtcctcaagggacgcacgcccgtcgagtgctacaccgacttcatgcgcgcgttccgcgaccacttcgccgactacctcggcaacaccatcgtggaaatccaagtcggcatgggccccgccggcgagctgcgctacccgtcctacccggagagcaacggcacctggaagttcccaggcatcggcgccttccagtgcaacgacaggtacatgcgtagccgcctgaaggcggcagcggaggcggccggcaagcctgagtggggccacggtgggccgaccgacgctggcggctacaacaactggcctgaggacaccgtcttcttccgcggcgacaacggtgggtggagcaccgagtacggcgacttcttcctgtcgtggtactcgcagatgctgctggagcacggcgaccgcatcctgtcgggcgccacgtccgtgttcggcgccgcgcccgtggaggtctccgtgaaggtggccggcatccactggcattacggcagccggtcccacgcccccgagctcaccgcgggctactacaacacgcggcgccacgacgggtacctcaccatcgcgcgcctcctggcgcgccacggcgccgtgctcaacttcacctgcgtggagatgcgggaccacgagcagccgcaggaggcgcggtgcatgccggaggcgctggtccggcaggtgggcgccgcggcgcgcgccgccggggtgggcctcgcgggcgagaacgcgctgccgcggtacgacggcacggcgcacgaccaggtggtcaccacggccgccgagcgcgccgccgaggaccggatggtggccttcacgtacctgcgcatggggcccgacctcttccacccggacaactggcggcgcttcgccgccttcgtgcgccgcatgaacggcgccgggtcgtgccgggaggccgcggagcgggaggcgcacggcgtcgcgcaggccaccgggtcgctggtgcacgaggccgccgtcgcgctgcggagctgaccggccgggccgggacggaacggaagcctacgatcgactgtacatacaggggttgggacttgggagggagctcgggttcttgttgggttttcctttgggtggagagcgagggagcgcagtcgagagccagcgagcagtctctcgtgcagtgcagtgcagtgcactgcagctccagcgtagacgagattgtattgtgaccaagccgggagggaaagcagggaggggaggacaaagatgttttgtcacgtttcaggctctggccatcgccggagtttgtgcggggaatatatcgatttcctattagaaatccgcaga

SEQ ID NO: 2 - DNA, 668 bp, Zea mays
cgtctccccaagatccatcggctcacgcactgacgcacatccattaccttctataatacgtctgcggtgtcaaaatttccctctcagccgtgttgctcgccgccgccccgccgtgttgctcgccgacaccgccccgccggcagccaaaatgccgttcaagaggttcgtggagatcgggcgagtggcccttgtaaactacggcaaggagtatggccgcctcgtcgtcatcgtcgacgtcgtcgaccagaacagggctcttgttgatgcccccgacatggttcgttgccaaatgaacttcaagcggctttccctgactgacatcaagattgacattaaacgtgtcccaaagaagactacactgatcaaggcaatggaggaagctgatgtgaaaagcaagtgggagaatagctcatggggcaagaagctgattgttcagaagaggagagcatcactcaatgactttgacaggttcaaggtcatgttggcgaagatcaagaggggcggtgccattaggcaagagcttgctaagcttaaaaaggtggctgctgctgcttagattgctttggtggttcctctattcgatctcttgaaatgtaatgcacgaattactttgacagttagcttgtcaagatgtcaattttaaactggcttatttagatattttgtcc

SEQ ID NO: 3 - DNA, 1290 bp, Sorghum bicolor
acctctcgagtctgactccgcaccccgtccgcgtccgacgtccggcgctcgtcctcccggctctccctccctgcccgccgcggcgccgccccttctcctccttggcttctcttgatcttctccccaagcggccaagccacctcctgccggctgccctcctccgtgtccctgccggcggccacggccagcagcactcagcaggcgctccgcgccccgcgcccaggccggcagaccgcccccgcgagccgcggtcccgcccggccgccctcctcgcagtctctcgtccacgtctagtaggcagcaccgcggcaggcagccaggcctgagacgcccaggctcctgctcccgactcgccggctgcactccccctgctcctggctcctgcagtcctgcatctgtcatctgtgctgcttctgcacatctcggcaacttgagagacaagcagggttgcatcccggcatcccgcaatgtcagctcccaacagtgatagcaacatgcagcagctagtccctatagcaccaccaggaaaggcttctggtgctgacagtgggaaggagctggttgtggcggatcctggaggtaagagttcaggaggtgtaaaactgcgagaggacgaggaggacctggaggtgaagctcaggcgcatcatggagaatgtccctgtgcgtgtcagtaacacatcagggtcctctgctggctctggctctggtgatttccaccagtatcggcaaatgcggaggagagagcaggaccggctagctcgaatggatgctgactaccagaagagaaaagagatggctgagtttgaactgcggagggaggagaggatcaaagctgctgaggagcggacagccaagaagcgcctgaaacggcaaaagaagaagcagcgtaagaaagagaagcgagctaaaactggtaataatggtggtgaagatcctaacagagtggattcgtctgatgatgatgaaggttcagatgacgatgacaagtccaagcaatgacacgccaatttgcatctgaagatgatttctcactctggttgtctgggcaatgaactaacgcctgtatggcagttgtaacaggctgaatctggtgctgtatctgtaagaagttgtcattttgagcagagatggagagcactagataattttctgttagtgttcatcatttagagaattgccctgcgtcattaccttttgttcagctctatatattcttctctcagctgtcttttttggggtccatgttaccatgggctcgagacaaaattaagcatctaagagcatctct

SEQ ID NO: 4 - DNA, 1226 bp, Zea mays
gatccatttgaaccggaggctaccgctgcctcaagggcctcctcgctcgctcgccagtcgccacccgctcacggagacagagaggccgatggcgagctcgctggcccgcctgggagcggcgctgccacgcgcgcgcccacgcgctgcgacccgcaccctgccaccgccgcggtgggacgccgcggcgctcggcgcctcccgccgcgccgcaccgaacgtttgcaggtgcctagttcattccgacgttaaagtagcccctacatcggacttcaaggacagtagcaaatctgaaacttggaggatcaagatgctctacgacggtgattgccctctctgtatgcgtgaggtaaacatgctaagagaaagaaacaaatcctatggagcaataaagtttgttgacataagctcgaaagattactctccagatgacaatcagggccttgattatgaaacttccatggggaggatacatgcggttctttcagatggaactgttgtcacagacgttgaggcatttagaaaactgtacgaggaagtaggacttggatgggtttatgctgttactaagtatgagcctgtagctagcatggcaaatgcagtatatggtttgtgggcaaaataccgtatgcaaattacaggtcgacctccgctagaagagatcatggcatcccgaagagctgcaggcgaatgtaaagatgacaaagtatgcaagatgtgagcataaagatgttatactgtgctacatacctcgcctctagccatgctttatataggctaaggctcgtatatatggctttaacagtacaaataatcgcagttgtattagaaaaaaaaaggtgaatagcttatgtaatggtttatcaaagtacatatgattgtacatttgtatgtacactgtactggttcacgcatgtaaaaacgatccaccacagatcgagctgactcacattgtctgttctaccaagtcgtatggactactacgcggccccaagctcacagtcacatcctagtccattgttgtggatatataagctcatgcactgcccgctgccggctgagaagcacagctaacgtccgcagaggccgcgttgcttgacgtcgagggggcctcggtgcttggatgggcgtcggcgcgcttgttcttggaggctaacctgctgttcctgagcctgttgaagggccgccagtgccatctgtcgtgcgacttcatgtgacccatccccacc

SEQ ID NO: 5 - DNA, 743 bp, Hordeum vulgare
agccattaggcgcgtgagacgacgaaccccacgaccagaagcgcagcgcaagtgagccatgctagcctcgccggcgctcgccggcgccacccactccttcctggccttcgtgtcgggcagccgcagcatccacctcccgtccgcatccgcgccctcgcactcgccgtcgcggcgggccgccctggtcgtcctcgccaaggccaaggtgtccacgcccaatgccgaccgcatcgcccgccacgaccgcctccgcaagaaggtgagcggcaccacggagaggccaagactcagcgttttccgctcaaacaagcatctgtatgctcaggtgatcgacgacacaaagtcgtgcactctggcttcagcctcaacaatgcacaaatctctttcaaaggagcttgagtactctgctgggccaacaactgaagtggcacaaaagattggtgaagtgatcgccaagtcttgcttggagaaaggaatcaccaaagtggtatttgaccgagggggtttcctctaccatggccgcatcaaagctctagctgatgctgctagagagaatgggcttgagttctgaattttcctgtcgatatttccgggatcgcatgtaatattctcttgttttccccgcctgttgaacaattctttctgtagtcattggagtcgctctgcagacatggctcctctttaattttatctggtctttcgatcaatcatgcaattggaagattaattttctgtttatttct

SEQ ID NO: 6 - DNA, 594 bp, Hordeum vulgare
cactctcagacggtcacatagaaagcacactgctgctgctctacttctagttcacttccttctggtctcgtgccaccaagctgccactcccacgaagatgtctacggtgacccgcgcctacctcgaccagaggctcgctgcagccaagcgctgctccagagaggctgccatggcgggagccaaggccgcggccgtcgccaccgtcgcagccgcagtccccacgctggcgagcgtgaggatgctgccgtgggcaaaggcgcacctgaacccggccgggcaggcgctcatcatctccaccgtcgccgggatggcctatttcatcgtcgccgacaagacaatcgtctccatggccaggaagcactcctttgacaacgccccgccacacctcaagaacacctccttccactaattaggctgtagatcaaataatgcgcagcaagttctatacgcctccccgaacttgtctgctgaaattggggcgatcaggcgaggccatgcttgcagtgcgatgtttactgcgagcaagcactaattatctgatcatgtatgaaatgaaataatgttgccaacttctccatcttagtacctttccag

SEQ ID NO: 7 - DNA, 1991 bp, Hordeum vulgare
cacatctcaacactagctaccatcctcaacatttgtggtagcactcgccgccagccgccgccatgtccaaagcattcaccaagtccctcctcttgtacaacaagatcctcgtccggcgtctcaagtccctcatcccccgtgcgccacccgcgccgacgtcggccaccgagagactgccaccatcacacaggcgcgagtcgtcgacggcgcctctgggcgcgctcccggcgccgggaacgaccgacgatggcaacaatattggtggcggtgctggcggcggcaccatcgtgtgcgaggtggagggcggcctgctgatgtcctcatccaccttcccctacttcatgctcgtcgccctcgaggccggcgggcttctccgcggcctcctcctcttgcttctctaccctctcctccgcctcctcccggacgagctcgccatgaaggccatggcgatggtgaccttcgcggggctccggaaggacgcgttcggccggctgggcatggccgtcatgcccaagctgttcctgcaggacgtgagcgccgaggtgttccacgcggccacgtctgctccaacggcggcggccgggggcgcgcggcgaagacggcgctgcgtgtgcgtgagcggcatgccgagggcgatggtggagccgttcctcaaggagtatctcgccatcgacgccgtcgtcgcgccggagctgagggagctcggagggtactacctgggtctcctggaggacgaaggagaggcggtgaggaggatggatgtggaggaggtcattggggccaagggcggcgccgtcgtcggcattggtgggctgcggtgctcctttcagcacatcttccaaaagtactgcaaggaggtgtacgtgccaacggagtcgacgcggcggcggcgcggggcgctgcacccgcggcggtacccgaagcccctggtgttccacgacggccgcaccgcgttccggccgacgcccgccgccacgctcgccatgttcgcgtggctcccgctcggcgcgccgctcgccctgctccgcgccgccgtgtttctcctcctcccgttctccctctccgtaccgctcctcgccgccctcggcatgcacaaccgcatgatcgcgtcgtcgccgccgaagtacgccggggtcgacaagagcaagagcaagagcaacctcttcgcgtgcaaccaccggtcgctgctggacccgctctgcgtgtccgcggccgccggccggcgcgacctcgccgcagccacatacagcatcagccgcctgtcggagatgctcgcgccgatccccacgttccgcctcacccgcgaccgcgccgccgaccgcgcggccatgcaggcccagctcgcccgccgcggcggccgcggcgggctggtggtgtgcccggaggggacgacgtgcagggagccgttcctgctgcggttcagcccgctgttcgcggagctggcggccggcggcgtggacgtggtgcccgtggcgctgcacctggcggtggacatgttccacggcacgacggcggggggcaggaagatgctggacccgctgtacctgctcatgaaccccgtgccgtcgtacctggtgcagttcctcgaccccgtcgagtgcggcggccaggaggcgcgggccgtggcgaacgaggtgcagcggcgggtggcggaggcgctcgggtacgagcgcaccgggctgacgaggagggacaagtacctcatcctcgccggcaacgaaggggtcgtcggcgcccacgacggcggcatgaagaattagctgcagctgatgccagcgaactctattattgacgactagcactacaaagcacaatactgcactacaaagcttaattagcttgttgtcgctgctgatggtgtacagtgcgtatgcatgtcctggctcgtcatggattatgcgtgtcttccggggtgctttgtgaagatatcacactaatacagtgtgcaatttatttatttttgcaatcataatatacagcggttttgcttg

SEQ ID NO: 8 - DNA, 1601 bp, Hordeum vulgare
ggagctccctctctttccgccttcacttcctcccgagcctctcctcttctcctgctcctcacggcggcggcggcggcggcgatgcagatgactgctgctaaaaccgatgtcccggcggcagctgctccgcacccacatccccacgcccatggcccgcaagtaccgcacggtcacgggcacccgcatcctcaccaccacatgccgcagccgcggtgggtggtacttccctacccgccgccgccgcctatggtggccgcgccgccccctcctacgccgcagtatgtgaagcatttcgcgccgcaggcatcggtgactccgcctccgccaccggctggatccggcgggaacggaggtgacgagaaccggacgatctgggtcggcgacctccagtactggatggacgagaactacctccacagctgcttcggccccagcggcgaggtcgtgacgattaaagttatccgcaatagacattctggagtttctgagggttatggttttgtagagttctattcccatgcatcagcagagaaagcacttcagaatttcgctggtcatgtaatgcctaatactgaccgagcttttaagttaaattgggcatcatatagtgttggagaaaaacgctctgaacttgcttctgatcactcaatttttgttggtgatctagctgttgatgttactgatgacatgttgatggaactttttgctaacaaatatcgttctgtgaaaggagctaaagttattattgatgcaaacacgggccgttctaggggatatggatttgttaggtttggagatgatattgacagaactcatgctatgactgaaatgaatggcatgtattgctctactcgaccaattcgcattggacctgcaactcctagaagaacttcaggtgattctggcacctctccaacaacacaatcagatggtgactcaactaacaggacagtatatgttggcgggcttgaccccaatgttagtgaagatgaactaagaaaaacatttgcaaaatatggtgatgttgcttctgtcaaaattcctgttgggaaacaatgcggttttgttcagtttatcaacagagctgatgcggaagaagcattacaagggttgagtggatcaacaattgggaagcaggctgttcgtctttcttggggccgcagtccagcaagcaaacagtctaggggtgattctggccatcgacggaatggcatgtactatggcatgcctttctacggtggatatggctatgcgtcgccagttccacacccaaacgtgtatgctgcggcttatggagcctaccctttctacggtaaccagcaactagtgagctgatgatagaggtcgtctctgtttcctcccaacaccagtagaaaacaaggttttggtccagtaagaatactatcatgggatgacatactatagatggccataaaagcgggcgagagagacaggtatatgtatgtgatgtctgcagatttgtgttgctagtagaacctaaagcaaggcttctagacaataaagagacgagttattcgtattgttgtaagaaattttgacttgctaataaaactattggctgaaagtctgtttgcttaaaa

SEQ ID NO: 9 - DNA, 2492 bp, Hordeum vulgare
gcagaaccagtaactcgcactgacccccgctccgatctccccaatcccctccaaatccctcgccggaaccctagccccgcgccgccgccgccatgcctccgcgccgctctaagggaggggccgggggccagcccgactccgaagccagcgacgccgagcccgtggagaccgcggtcgacgccacgtccgaagacgaggccgacgacggcaactccaacgaggactccgctgagagcggagctgacgatactgacggcgaggcctccaaggaggaagccgccgataccaaggccgaggagatggatgcggagcatgaagaggaagctggcgcaaccaaggccgaggagatggtcgccgaacctgaagccaatggtgcagatgcggggaccaaggtcgaggcggcggaggccacggtcgaagaggaagccgcccagagcgactctgagcgcaaggcaggtgcccgagaagccgatccagaagcggaggcagaggaaaccgacggcgagaatgaagagcaagccgctcggaccgacggcgggagtggagaggaagctgccgggactgttggcgaggacgaagaagaagccgccggcacagacggcgacaacgccgctgaggttggtggcgagaacgtagatgcggattctgaagccgaaggtgagggtactgatgccgagcctgacgctctggaggaatcccctcccccctctcctccagcccgtagccgccgccgcaagcgagtggtcaaacccgacccgcctactgaggatgacgaggaagaggagacccctctgccttcacgtcggcgccggcgtcgcaaagcaggagaacgtggcgattctcctccgccactgccggataacctccggtgccgcagaagtgatggtaagaagtggcgctgctcagctcgtgcactccccactgtcagcttttgcgagtatcattatgccaaggctagcaagggcaagaaaccgccagccgatggggaggtccttgccgtggctctccaacggcaaaagaagaacaagagaaagggaagaaagcgcttaaatctggcgccagaatcaccaaaggccacaagggatctccctaatggattgatgacaatttcaccggggagcagtgggccgctaggctcccctgtgactacaaaggttggagtggatattcccgcaccactccggcggtgctaccgttccaagaatgctgagccagtgcctgttggccctgtgaaggtcgttcctcatgcaatgagtaaagcaaaggcagcacagatgtcatgccaccgttgtgggttgaagaaggtagcacgcgttgtcaagtgcaagaactgtgaaaacaagtacttctgcaacagctgcatcaataaatggtattctgggatgtccaggaatgatataaagatccaatgcccggtttgccgtggctgctgtgattgcaaaaagtgcacccttggtcagaccaagggaggtatgcggaaggaatcaccaggtggtcaagggaaactaatcaggatcaaaatctgcaatcaccaattttacaagcttttacccttgaaacttgaccaggaacagcttgatgaattggaaattgaagctaaaatacaaggaacaaagttatccaatgtccgcgttcaggtagctgaagatgaccagagcgggtcactttactgtaataactgtaagctgtccgtgcaccaagccttgagaagctgcccaagatgcccttttaagctgtgcctaagttgctgtcagaagatacgtgaagggagtatgtcaggcagcacccctgaagataaatttacacaacgactgttgcagcaagagtcagcccatgaggatggcagcataagttgcccttccattgagttgggtggctgtggcgactctctgttaaacttgatatatacatccccatctgatgaccagtcgggggaactaagttcaggagacgagctagatgctccaggcaatgactctggagttaaagatgcacaagatcattcctcgcctttagccgagagtaatggtagtcttgccagattatccggtggtcagcaggaatcgatgtccacataatctctggtgattttgcagcagatacccacccatgcatcttttggtgtgtgagatgggatatggtctgaagtgggtagaggttagagtggcttatttagtgtgattatcggctgattttaggtctgtgacctacctggggatattctcgagtaattgtttggtgttgttcatcttggatttatacattatgtttgttgtcagtgtaaatagggtatgactatttatcatccatgagtcggaagcttgtatcggttcggtcgtattgtggttaatttagaaaactgtctgtactctatcggctattgcagtgttcgagaaagtgagggattctattggattagtcgtctgaaataaaagcgactttgggatggttacattgaattggatctgtgtatcctgatttcctgccctgtt

SEQ ID NO: 10 - DNA, 1390 bp, Hordeum vulgare
ggctgcaggcacaccaacgtcggtcaaggcgagaagccgagaagcaatcaggtgccagaagcccagagccaaccagcctcagcgcgcgcgcgcgtgtgtggtggtgggaggttcttcagcagcttgcggggctagagcggcggcagcgatggcggcgtccgtggccacctccccggcttgcagccggctcatccccagcagacccctctccgcctccgcctccgccgccgcgccgtccctcgtccgcctggcggggtcctccaggcgcctccgccgggccctgcgggtctcggccgcggcggagccggccgacgcgctgccggggcccggggccggcgacctggacggggtggtgccggcggggctgctggaggacctgccggagggcctcgccttccagggcgatgtgggcgggggtttcgcccccggcggcggcggcgacgacggcaacaagatgctcgaccgcggcatcaacgcggccatcgtgctcggcgccagcacctacgcgctcaccaagctcctcaccgtcgaccaggactactggcatgggtggactatctttgagatcctgcgctacatgccggagcacaactggtcggcctacgaggaggccctcaaggccaatccggttcttgccaagatgatgatcagcggcgtcgtctattccctcggcgactggatagcccagtgctacgaaggcaagcccatcttcgagtttgaccgtactcgcatgttccggtctggcctcgtagggttcaccctccacggatccctttcgcactactactatcacttctgcgagtcgttgttcccgttcaaggattggtgggctgtgcctgtcaaggttgcgtttgatcagacggcttggtctgcgctgtggaacagcatctacttcgtcgccctgggcttccttcgctgggaatctccgttcaccatattcagcgagctcaaggccaccttcttccccatgcttactgctggatggaagctgtggccatttgcacacttaattacatatggtgtggttcctatcgaacaaagacttctctgggtcgactgtgtcgaattaatctgggtcaccatcttgtcaacttactcgaacgagaaatctgaagcaaggatcttagatgattcctccacaacagatacgcaggacaactccagatagcacatacttcatggttttgctgttttatagattggaacagcggaaactgctccggcttcgttatgttgggattgtataaattgtatgtacagttagttgccagcgctgcgtgtgtaaaaaaaaaagccttgcatctattgcaagcaaattgtgctggccaaacaaaacgaaaaagaaattgtctcaagggagatcaactcctgatgaaaatatgagttgtgc

SEQ ID NO: 11 - DNA, 701 bp, Hordeum vulgare
ttacacctcatcacctagctctccttgccttccttcaagttccaactgccatggatgccatcagactcagcctcctcatggtggccgtgatggccgtcctgagcaccgcgtcggcggcgatctacaacgttggcgaaccgggtggtgcgtgggacctcagcaccaactacgacacctgggcgtcctctaggaagttccaacccggcgaccagatcgtcttcaagtactcccctcaagcgcacgacgtccttgaggtcagcaaggccgactatgactcctgcagcaccgccaaccccattgccaccctcaacaccgggaacgacatcgtcacgctcaccgccaccggcacacgctatttcatctgtgggtttcctggccactgcactggtggcatgaaggtcaagatcgacgtcgtgcctgcctcctcctcctcctcgcccgccccagccagcggccccagtgcaagcaacgctcctccgcccacgcctgtctctaccgccaactctgtggaggccacggggtttggcctcgccgtcttgcttgcctttgccggtatcatggcttgagtacatgttgtcgccccacgcacatgcatattttatgtatagtcaagtaatcattattagcgagtatacgtgtgtatactcgactaattggatatgcgaccttgatcttttttatatacaatttgaaggattagt

SEQ ID NO: 12 - DNA, 1626 bp, Hordeum vulgare
gcaccgtgcagcgggagcagagcgccgcagcgtcacctcggaccaccgagggctgctggcaggcaggggggggagctcaaaaggcaaacaagactctctctctctctgctttctccccgtttgaggtttgacctctcctccagctccagaggccccccgcaagtctctcgcgacgaccgtcgccggcaatggcggccgcctcggaggagtccgtcaagcagttctccgcgctcatggagcagctggaggagccgctcaagaccacattccagaatgtgcaccaaggatatccaagagggactctgctgcgttttctaaaggccagagaatggaacgtccccaaggcttataaaatgctaatggattgcttgaattggaggcttcagaatgagattgacagcgttctagccaaaccaatattgcccgctgatttgtatagatctattcgtgatacgctacttgttggattaacaggatattccaagcagggtcaacctgtctatgcatttggtgttggactcagtaccttcgacagagcatcggtgaactactatttgcagtctcacatacagatgaatgaatatcgagatcgtgttgtcctgccaggtgcatctgagaggtccggaagacagattaacacctgcttaaaagttatggatatgactggcctgaagctttctgctttgaaccaaataaagatgttgagcacgataacagctgttgatgaccttaattatcctgagaagaccgagacgtattacatcgtgaacgctccatatgttttttcggcatgttggaaggttgtgaagcctcttttacaagaacgaactaagaagaagatcaaagtcttgtatggccctggaagagatgaattactgaaggtgatggactacgcgtcgctcccgcacttctgcaagagggaagggtccggttcaggttcgtcgtcggacgaagtcgactgctactcgtacgaccatcctttccaccagcagctgtacaactatgtgaagcagcaagctgcgaggaaccaggaggacggcgccggccccgtgaagcaagggtcgatgcatgtgagggtgccgacgccggacctggaggaggccaagatcatggagacgatccagtcggaactccacagcctcaagggaggtgacggcatttcccgctccttcaacaggatcaccatcgaaggcccgtgagtgatgatcggagccgatccatgatgatcggagcgcccgagatcgcgccgcggagggaggtaatcgcttatcgctatcttatttgacgccagaagatttctctggggtttatggcggttcttgcttgcattgtaaccgctggctgcaaggctcgactaggatcatgtcggtagaggaagtagtagcagcagtagtaaaacatcggattctaataaccgagttgagtctgtatcgtgttgtcgtaagatggtggtagtaatttagctatgattaaccctgctaatggatgtaatgtaccatttgcgcgttactgtttccatgcttctcatggcagggaagtgtcatcatgtttccagacatgagtggcacgagctctatcttctatgtatcgtatcaatcagtatatatataatatatgtatgtgtat

SEQ ID NO: 13 - DNA, 3289 bp, Hordeum vulgare
gcgagagctcagctcagctcacggtcacgcgcaccgctgctgagctagctccaatggattactccacctccctcctccgcctcaccttcctcgccctcggcgccgccctcatcctcctcgtcacccgctccgcctttcgcctgccgctcgccatcgacgcaccagccgcctccttcttacacggctccggcggctgcacccggttctcgccgtgggcctgccgcccaccacgaaccggcaagtccccgccacgtcgttcgtcacacgagtccgacgtcccgcgccacccgctcgacccgctcacggtgacggagatcagccgcgcgcgcgagctcctccgcgcgcacccgccgttcgcgtcggcgccgtcggccctggtcgtgcacgcgctcgcgctcgacgagccggacaagcccgccgtccggcgctggcggaagggcgcccacgcgctcccgcctcgccgcgccgtcgcggtcgtccgcttccgtggggagtcccatgtgctcgccctcgaccttgccaccggctcggtcacccctctgcccacgccggcctcgggctacccgacgatgaccatggacgagatgaccgccctctgcgcggcgccgttcagcgacccggcgttcaacgccaccatcctgcgccgcggcgtgcgcctggccgacgtcgcgtgcctgcccatctcccccgggtggtacggccccgccgaggacgacggcggccgccggttcatcaagagccagtgctactcgacggagggcaccgccaatttctacatgcgccccatcgagggcctcaccgtcctcatcgacatggacaccgggaaggtcgtccacatctccgaccgcggcgccggcatccccatcccggccgccaagaacaccgaataccgccacgccgccaacgacgacgccgatgataaattcgggtaccagacggtgcgggcgccgtcgatggagccggcgccggaggggccggggttcgaggtgtcggacgggcacacggtgcggtgggccgggtgggagttccacctgaaggcggacgcgcgggcggggctgatcgtgtcccgcgcgacggtgcaggacccggcgaccggggcgcggagggaggtgatgtacaagggcatggcgtcggagctgttcgtgccctacatggacccgacggaggcgtggtacttcaagacgtacatggacgccggcgagtacggcttcgggctgcaggccatgccgctggtgccgctcaacgattgcccccggcacgcgcggtacatggacggcgtgttcgtggccgccgacggccggccgtacgtgagggagaagatgatctgcgtcttcgagcggtacgccggcgacatcgcgtggcgacactccgagagccccatcaccggcatggacataagggagtcccgggcgaaggtgacgctggtggcgcgcatggcggcgtcggtggccaactacgactacatcgtcgactgggagttccagaccgacgggctcatccgcatcaaggtggggcttagcgggatcctgatggtgaagggctcgccctactcccacatgaaccaggtccggaaaaacgaggagatgcacggcaccctcctctcggagaacatcatcggcgtcatccatgaccactatgtcaccttccgcctcgacatggacgtcgacggcgccgacaactccttcgtccgggtcgacatggcccgccaggacaccgcacccggcgagtccccgcggaggagctaccttaaggcaacacgccacgtcgcgagcaccgagaaagacgcaaaggtgcgtctgaagctctatgagccggccgagttccacgtaatcaacccgaccaagaagacgcgtgtcgggaacccggtgggctacaaggtcgtccccgccggcaccgccgccagcctgctggaccccgaggacccgccgcagaagaggggtgcattcacaaacaatcagatttgggtcacgccctacaacaagagtgaagaatgggccggtgggctgttcgtgtaccagagcaaaggggaggacacgctggctacttggtcggagagggaccgtccgatcgagaacaaggacctggtgctgtggtacacgctggggttccaccacatcccttgtcaggaggacttccccatcatgcccactgtgtcgtccagcttcgacctcaagccggtcaacttcttcgagagcaaccccatcctcaagcagcgacccaccatggagaaggatctccccgtctgcgtcgctaccgcgtgagaacatgcaccacaatacatgtgtgctctcgaggctcatcaacatacaaacactgggatgttgcccggggcatgaggtcgtgcgtaggcttccggaatcaccatggtgtgtccagtacactggggacttggctactcttggctccgcctgtggttggccaatagcctagtatgtatatacagctttatgtttgtgttgtactgtgttttgagtgtggacaatctgaacccatgcgttgttggcttttgaacgtgcgtatgcagctgtacaggcgtgcctacgcgattcttgcttcggccggctacttgacggaacttgcgtaactagcgacacgaataaaactgatcgatggatttgatggctaaaggcccgtgtcgagcctttgctttgtattgcttttcgtttttctggtgttacaatcaacacccctagggtgtcttttatacacgtccacaagggactatggaaatagactaggactaggaatcctaatactactaggactcggtttggctttctttcctaatcctaaagaaacaacatgattaacttctacattcacctccttaatcttgttgcttgacttcacttcttgcactccgactttcctcctcatctcgatgaacttctgtcgactggggacttggtgaaaatatcggcaagttggtctttcgtgttcacatgttgaacctcgatcaacccttcttcaatgcactcccggatatggtggaaccgggtatctatgtgcttgctcctttcgtgatgaaccggatttttgcacaacgagattgcagcttggttatcgatcttcagtgacaccttctgcacctcccgctttgcaagaatagctaggagtcttctcagccacactgcttgacaagccgccgtgcttgccgctatgtattctgcctctcatgaagacagtgccaccaccttttgcttctgagaattccagctaatcggattcgggccaaggtagaaaaccatgcccgttgtgctctttcggtcatcaacttcacctgccatgt

SEQ ID NO: 14 - DNA, 661 bp, Hordeum vulgare
aagaagccaccagcctcctcctcctcctccctcgccgccgcccgccgaggttggtcgccggacgccatggctcccaccaagaagtcgaagaagagcacggagaacatcaacaacaagctgcagctggtgatgaagagcggcaagtacaccctcggctacaagaccgtcctcaagacgctccggagctccaagggcaagttgattatccttgcaaacaactgccctccactcaggaagtctgagatcgagtactatgctatgctcgccaagatcagtgttcatcacttccatggaaacaatgtggatcttggaactgcctgcggcaagtactacagggtgtgctgtttgagcatccttgaccctggtgactcggacatcatcaccaccgttcctcagtgaagacaaccttacctatcctagtcttaagacgatgtagcgtggagagtcatgctggccgtctcttgttatcgagccagagctgccaatcgcagtttcagaccaaacatggctgtttttgtaaggcattcctatggttttgttttatgagatgtttattcctatgtggtccttttactgtgtgcgattggatgattagtggtgttaacatgttttgcatgcgtggaagcgctggtgcaatcttagatgaaagaatttttgtttt

SEQ ID NO: 15 - DNA, 1669 bp, Hordeum vulgare
cggcaccagccagcacctaaccttcgtcgtctataaagcgccactccgcgccgcagtggcaacggcgccaccgaagccagaccacgctactctccactccactcaactcttccctcacgcagacccgcgcatccatcggcctcgcctcgggctccatctgatccacggattctggaagggagtatcattctagttcccgagtcgtacgtgatcccgccgaagcgtgagctcgagcaacagccacgcaggcaggaaccaggatggtgaccaaggtggtggacctccgctccgacacggtcaccaagccatcggaagccatgcgtgccgccatggccgccgcggaggtggacgacgacgtgctgggcgcggacccgaccgcgcagcgcttcgaggcggagatggccaggatcatgggcaaggaggcggccctgttcgtgccctcgggcaccatgggcaaccttgtctccgtcctcgcgcactgcgacaccaggggcagcgaggtcatcctcggggacaactcccacatccacatctacgagaacggcggcatctccaccctcggcggcgtccaccccaagaccgtgcccaacaaccccgacggcaccatggacgtccacaagatcgtcgctgccatcaggcaccgggacggggccatgtattatcccaccaccaggctcatctgcctcgagaacacgcatggaaattctggtgggaaatgtatatctgtagagtacaccgacaaggttggtgaagttgctaaaacccatggcttgaagcttcatatcgacggagctcggatttttaacgcctccgtggcacttggagttcctgttcatagacttgtgagagctgctgattcagtttcggtgtgcctatccaaaggtttaggtgctcctgttggatcagtaattgttggttccaaggccttcatatacaaggccaaaattcttaggaagacactaggtggtggaatgaggcaggtaggaattctctgtgctgctgcctatgttgcggttcgcgacaccgtgggcaagctcgccgatgaccataggaaggccaaagttttagcagatggactgaagaaaattaaacagtttacagttgatttagcttcagtggagaccaatatggtattctttgatatcgcggatccacgcataacacctgacaaactgtgtcaagtcctggaacagcgcaatgtgcttgcaatgccagcaagctccaagagcgtcagacttgtcactcactaccaaatttcagacagtgacgtccagtatactttgacatgtatcgagaaagccgtggaggaaatcctgtcaggcaatgctaaattcgagcacctgacaaacggcaccaccaccaactcgtatgggcactaggccacggcacctcctttagagcccacctatggctatgggctatggacggactgcggcatccgagcagcttgtttgtggccgtgggctttgtagtaccagtaacaactttgcagaataatgtgtggcgtttgggccgccggaaggcccctgaatggaatgcaatgtcgcgatttgattatcttgttcttcagcccggatacgggaagtgttcgccaggccggcccatcacatgtccagaagtgtacaccagctttcccgctaaaaaatgacaagaagtgtactctgttgcc

SEQ ID NO: 16 - DNA, 1462 bp, Hordeum vulgare
ggcggcatctgtccttcctcgcttccggcgcagacttgtcgacttctctctccgctgatcgctccctgcgagtattacttgccgtaccacaccagtgaacccccgccccactccacttccgcctcgctccccaacctttcatggccggcaacaccctcgccgccgcgagattctccgcggccgttacgctcctccgcacccgccgctccccggtggtcgccgtgccgctcgccccgtccggtctccgccaccaccgccgcagcgtcggcatggccgccggcgccgcgccctcacccattcccgcctccgatccgcttcccaagggttctgatctatttttgcggtcagttctctcaaacatgcaaaaagtctatttgagtaggaatccaactgcagaaaagattctggaccttgtccattcttatgatggggacaacatttgttttgatcactttgctttcagaacatttggggttgatggttatggtataaactcacttgcggaattttttactgattttggttacgagtctcgtgaagaactaaggtttccagcaaaaaaactgagagcactatggttttcccctcccaacaatgatggatactccagaactggtatatatggacctttgccaagaatattcatttctgaacttcttgtagatgagctgagtgctccgagccaggaaattatacggaaatacatcaaaacatcagctaatggaaataaatatgctgttcttgcaagtacatttggggagctgacatgggaaaagcctacttattctgatttccaggttctatctagggaaagtgaatatgctggatggactcttgttaatggctatgcactgaaccatgccacagtttccactcatcgcttagagtcagatatcagaagtattagtaagtttaacaaatttgtggagaacaacggattcaagttaagtaccgaaggaggaattttgaaagtgagccctgacggtctcctccagcaaagctcaactgtagctgattcatcattatttacttttgctgatggaatcactgaacctattccacgttcctatattgaatttgctgaacggctgccactcccacagttcagagatttgcaagatgaagaggtcaaggaacaccacaggcgcgatggtttcgaggtaggcaatgcagacaagatatttgagagcacttcaaaggatcagcttacccgaaggtctgcataggcggtgtactcttgatcgaacattctgcaggtgggccaatgagcctcttggaagtgtgttgaaggcgtgtgttgtgtaattattgtatatgccatatgccttgaagtgcgctgaaaatcagatgctcaataaagactagtatttcctaatggcattgcgctctcctatctggaattcagctatctctatgtatcatgaactctaaactgatacctgggaatggatgaagtagttta

SEQ ID NO: 17 - DNA, 1762 bp, Hordeum vulgare
atcactctcccgtcccctcgcactcccacgcccgccgccgccgccgccgccgcagatccccctcctccggcgcgccgccatggactacgagcgcatcgagaagccgtcgttccccacgcagggcgggggcttctcgccgaagcggctgcgcgcgatgctgctgggcgtggagaggcgccgcaaggacgacggcgtggaggggcggcagcaggaggaggaggaggaggaggagtacggcgcggtgcccatggcctccgtcagatccgacgacgacgcgcgccgaggaggcagcgtctgcgaagaatacaaggacgtggacgtggtgagcacgatgtcggggtcttcgtcctcgctggacaccgggagcgggcaccggtcgcgggactcccactccatgggctcgaggttcagggtgcccgaggaggactcgtgcgattcagagagcgtggcgtccaacttcgagttccataaggagcgaggggcctccgctcggtcagcgcccacggcggtggtcgcaccgttctccaagcccccgccgtcgaagtgggatgatgcccagaaatggatcgccagcccggcgacgaaccgtcctggtagggctggtggagctttcccaaggaagatggagaaaactggctttggtggagggaggctgccgccgacgaaggttgtgctggaggccatggaggaaatagataccaagaggatcgatccaagccaagagaagagggagattgggtggcagaaagcggcgaactgggccacgccggagccctatccagaagtggagccttgtgcaaagtctgcacctggtgcagaaagtactataattgattcagctgttactttgagctgtgattcatctaccacacttcatagtgccactgcatgcatacctcccccaccaacaggccggtcagtatcgatgagggacatgggtactgaaatgaccccaattgcaagccaagaaccatcccggacaggaacacctgtgagagcaacaagcccggattgctctcggccaactactccacgaaggacattgggtatcaatgcagctggcggtgttatcaaccgcggtgaatgtagcaatgcagatttaagcgaagaggagttgcaaatgaagactaggagagagataatgcttcttggcacccaactaggtaaaaccagcatcgcggcatgggcaagtaagaaggaagaggaaaaggacgcatcactttctctcaagacagtgtcatcagaccaatctgcacaaaatgcaaccgaaatacgtgcagctgcttgggaggaggcagagaaggccaaatacttagcaaggttcaaacgagaagagatcaagatccacgcatgggaagatcaccagaaagccaaaatcgaagcagaaatgagaaaaattgaggtcgaggtggagaggatgcgagcccgtgcccaggacaagctgatgagcaagctcgcgtccacaaggcacactgcagacgagcagcgagctgccgcagagtcgaagagggaccagagcgccgcgaggactgcagagcaggcagagcacatcaggagaaccggccggatgccgccctcgcttggctgctggaactggtgctcgtagccccagaagaagaaaacagcatgtgttgttcctctcaactggtgaaggaaatgaatctggcattgtagaaacttcttctcttttgattggttcagtagatatgtgacacgagaacagatcacctgtgtaactatgtatatgtaagatgtgagcttt

SEQ ID NO: 18 - DNA, 731 bp, Hordeum vulgare
agcatccgcaacggccatggccttcgccgccatccacgcccgcctcgccgtcttcccccctcgcctcagcgccgccgcgtcgtctctccgctccgcacctccccgcgcccgtctcccgcagctcaggacttcagccggataccgctgcctccgtagcccgcggtgccgccggccgtgtcgcgctcgcgccagctgcatctccatcaccgcgtcgctcgacctcgccgaggacaacgtccggcaggccatcgtcgacgctaaagccgagctggcccagctgttcgacacgtcggtcggcataacaggacaagttgatctggcggagctggacgggccgttcgtgaagctccgactgaagggaaagttctggcacacccgcgccaccgtcgccgcgcggataggcaactacctcaagaaccgtataccggagattttggaagtggagatcgaagatgaggaccagctcgacgacagccccgcggcttactgagattactgaagacctgaactgaagttgttgaaggacctaatacatataccagaacagattattctagcactttcttcgctagcatgggtaaagaacatgcgagtcattgctgagggcgcctacttttctcagtaccactgggtttggtaggatcatatttttgtaagtgtgcaccgtctgtaccaaacaattcttctctcttaattaatatataaggcaaaaaatttgcctccgtttcgag

SEQ ID NO: 19 - DNA, 1563 bp, Hordeum vulgare
ccccagcacaacaaggcctctgatgatgtccaatgaccacaacaaattcgagcatccaaatcggcttcatctttcaccttcaaactttacaaatcatccttgtgaaggtttcgcggttcctcctatcctgtttgataagaaacgcactgggcctcgaccatgccctgtttgctatgtgtcggtagatcaggcatttgctctgatgcctctacaagcttctccatctcctgtccttgaaaacttaaaatacgccttggaagacagcgtcactgcaaatttctcaaatccgggctctgcatttggagggcatctatctctggagcagagaaataaatcttttgacattaccgattcgatgactgtccactgtggatttgttagaggaaagaaacctggccaaggtaccggatttgacatcagtgatgatgatctgctagaaatggagcaatgccgtgagcttgttgtagcttccgccattttcgggaattatgatatgattcaacatccaaggaatgtcagtgaactgtcaaaggcaaatgcgtgtttttatatgtttgtagatgaagaaacaatggcttatgtcaagaattccagctcactgtacaaagataataaagttggcttatggaggctagtggttgtccgaaacctcccttatgaagatccaaggcgcacggggaagattcccaagcttctgctccataggctatttccaaatgtaagattttcagtttggatagacgcaaagcttcagcttgttgtggatccttatttactgcttgagaggtttctgtggagaaaggattctagttttgcgatatctcggcactacagacgttttggtgtgtacgaagaagcagaagctaataaagctgctggaaagtatgacaatgcatcaatcgatgaacagatagatttttacagaaatgagggcctaacacattattctcccgccaagcttcctatcacaagtgacgtcccggaaggctgtgtgatcatcagagaacacgtccccatctcgaacctcttcacatgtctttggttcaatgaagttgaccgtttcaccgccagggatcaaatcagcttcagcaccgtccgggacaaaataaggtctaaagtcggctggatgccccagatgttcctggactgcgagaggcgcaactttgttgtccaggcataccacagggagctgctagagcagatgatcgcgtccggcaggaacacgcctccgaccgccgtcgagccatcgcggaaaatcaggccgggtggcagcaggagagctcccccgtcgaagaagcctgtcgtgaagcggaaaaaggagaagaaatcgagctcgcggaggcgggtcccgaagccggttacgtgggccatggatgctgtgtgactgacggaggttcacagggatggacggactcctgtcactctatcgatagttgggcgtggccgtgtcgcagctggtgccgctaggggagggagggaaagaaagggggaatggaggattgtaattttttgccggccacgaaatggaatttgttcatagtcaattcttgattgttgttgtaa

SEQ ID NO: 20 - DNA, 1453 bp, Hordeum vulgare
ggccactggccagcgaagccatgacgttatcccctcacacactctgcccaccccttctccccccgctcccgccaagttcaaaccgccgcccgccgccgcctcgctcccgcccctgcccccgcatactcctcccggcgctcgcgggccgccagagccgcgtacacctcgcgcggccgccgcgcgcgggtgcgggcgcaggggacggcatggcgtcgcaggacgcgcactaccccacgctgctcgagcacatgggccgggccggcgcgcccgccgacctcgccgtcctcgtcgcccacatccaggccgcctgcaagcgcatcgccgcgctcgtcgcgtcccccggcaacgccgacctctcgcgggccaagccggcggccgctgccggtggggcgtccgcggccgggcgcgacgcgcccaagccgctcgacgaattgtcgaatgagatcatcctgtcgtcgctccaaagctctggaaaagttgcagtggtggcgtccgaagaaaatgatcaccccgtttggatgtgcgatgacggcccctatgttgttgtcaccgacccgctcgatggttctcgcaacatcgaggtgtcgatccccactggaacgatattcgggatatacgataggctggtggaactcgaccatctccctgtggaagagaaagctcagctcaattcactgcagagcggttctcgcctggtcgctgctggatacgtcctatattcatctgccaccatcttctgcatcagtttcggtgagggaactcatggcttcacgttggatagatcgacaggagaatttgttctgacgtatcctttcatgcaaataccccctagaggacagatatattcagtgaatgatgcgcggtatttcgactggccagagggcctgaagaagtacatcgacacgatcagacaaggcaaggggcagaatcccaagaagtactcgactcggtacgtgtgcttattggtcgctgattttcaccggacggtcatatacggtggagtcgcaatgaacccgagggatcaccttcggttggtatacgaggcaaatcctctcagtttccttgccgagcaggcaggggggcgaggctcggatggcaaaaccagaatcctctccattcagcctgtgaagctgcaccagaggctgccattgttccttgggagcatggaggacatgcttgagctagaaagctatggggatgtccagcagaaagtcaatcctggatacgatgtttaatgttaagcatgaggtgataccttcaggtattgtagcttacaatgaggtaaccattgtatatggcaaagtctatatttgcaagcacaatgttgtttctgtgtattgttttgtttgccttcttttgcctaggcaattgcagagtactgcataatggaggtcagaaaaatttgctgtagttcactgtggaaacaaaatatgcaatatggctatttgtttgt

SEQ ID NO: 21 - DNA, 1232 bp, Brachypodium distachyon
gaatcaccgggtagaattccttctgagctccgaggaaagaacaagcattcttctccagagcaaaccattggccacggcagcatcctgatgtccgtcgcgtccgctgccgccgtccggtccgcgtccggccgccgctgcggcgtcggctctggcctcaacggaggcaataagtttctgatgatgcagaggagagacatcgtgaccaaggggatcgcgctctccgtctgctcctcgctcctctcttcctccaacggcgacgctcaaggattggagaggttgccgttcaaggcggacgggtacaacttctggacatggcggggccgcaggatccactacgtggagcaaggggaagggcagcccatcgtgctcgtgcacggcttcggcgcgtccgcgttccattggaggtacaacatcccggagctggccaagaagtacaaggtgtacgccgtggacctgctgggtttcgggtggagcgagaaggcgctggtggagtacgacgccaccatctggatggagcaggtctccgacttcctcagggaggtcgtcaaatcgccctccgtcctcgtcggcaacagcttagggggattcacgacgctgttcacggcgacggagctgccggagctagtccggggcctcgtgctgctcaactccgccgggcagttcggggaccccaatgcgccgccgcccattgaagcagaggaggaagtgggcgtgttgagcaggctgctcgtcaggccgatcaaggaggccttccagcgggtcgtgctcgggttcctcttctggcaggccaagcagccggccagggtcgagaaagtcttgaaaagcgtgtacaaagaccccagcaacgtggacgactacctcatcagctccatcacggcgccgacggcggaccccaacgccggcgaggtgtactacagactgatgtcgcggttcatggcgaaccagagccggtacacgctggacaggctgctggggaagctgtcgtgcccgctgctgctgctgtggggggacctggacccgtgggtcgggccgtccaaggcggcgcggatcaaggaattctacaaaaactccaccgtcgtcaacctgcaggcgggccactgcccgcacgacgaggcgccggagcagttcaacgcggcgctgctccagtggctcgacacgctggaggagactggcaccggcggcaagtcggccgagcccagcctccaggccgtgtgattctttgcttgcacccg

SEQ ID NO: 22 - DNA, 1202 bp, Brachypodium distachyon
gcgctaaaaccagacagaacaccaccgaagaagcctcagcctctccgaggggccaaacagaaatggcggcttcctgcacgctcgcggtctctcctgccttcgccgcctcatgctccccctccagttcatctcgccgctccaggcgatttggggtggtggccatggccagcgtggggcagaaggtgtacgccccgggcgtggcggtctccgagggcaacggcgggctaccgaagatcatcctcaaatccccgcatgggagtgaggctgaaatttatctatttggagcatgtgtcacgtcttggaaggtccccaatggaaaggacctgctctttgtcagaccagatgctgtgtttaacggtcagaaacccatcagtggtggaatcccacattgcttcccccagtttggccctggccccatgcagcagcatgggtttgcaaggaacgtgaattggtctgtcactgattcagaagttaatgaaggagatccagctgtaactttggaactcaaagatgactcttacagccgttcaatgtgggattttagtttccaagcatcatacaaggttgcattgcactctacaagcctgtcaacaaccctgaaaataacaaatacagatgataaacctttctcattcaactcagctctccacacgtacttcagtgcttccattgctggtgtttcagtgaaaggtctcaaaggtagcaagaccctcaataaggatcctgaccctaaaaatcctctggagggcaaagaagaaagggatgaagtgacttttccaggatttgtcgactgtgtttacctcggcgcgcccagcgagcttatcctggacaatggattgggtgacaaaattgccatctcaaatgaaaattggtcagatgcagtgttgtggaatcctcacttgcagatggaggcatgttacaaagattttgtctgtgtcgaaaatgccaagattgaaacagtgcaactgggtccgacacaatcttgggtggcagagcagaaaattgaactaatctgaagttcatcggtgcaatctgcaatgtgacacactgcggcagatatgttgtagaagggcctctcttttttaccgttctggcaatgtaaacatgtgccattccccaatgtacttcattcagcttacactatggcattagatgtacggagtactattttatttttatacgtaaatgaaaattcagctctc

SEQ ID NO: 23 - DNA, 1026 bp, Brachypodium distachyon
accccgcccacgacacagagcagccccgcgcagacagctccacccaacagcaacagctaagctacgctaagcgctcgcccaccaaacgtacatcccggccccgagagctagctagcagtcgacccatggctgcggaggaggctaagaaggtggaggtggaggtgacgccggagcccgaggctccgccggccgtgcccgccgcggagcccgaggcccccgccaaggacgtcaccgaggagaaggccgtcatccccgcgccggccgccgaggaggagaagccgcccgtcgatgactccaaggccctcgtcgtcgtcgagaaggttgcagatgagaaacccgcagatgagaaggccgcacatgggggctcaaatgacagagatattgctcttgcaagggtggaaactgagaagagaaactctttgattaaagcatgggaggagaatgagaagacaaaggctgagaacaaggctgctaagaaggtgtccgccattctctcgtgggagaacaccaagaaagcaaacatagaagctcaactgaggaagattgaggagcaattggaaaagaagaaggctgaatacgcagagaagatgaagaacaaggctgcaatgatccacaaggaggccgaagagaagaaagcaatggtcgaggcgaagcgcggggaggaagtcctcaaggccgaggagatggcggccaagtaccgcgccactggcaactctcccaagaaaaccatggggtgctttggggcctaaagaaaaaaaaaacgttccttggtcacaaacgagcaagattgaagtgttcatccgaggttgctttcttccgttttctttcacccgtccaaagtgtgcagtgtgccctgtgtgtaaagtctgttgttgttgtacatacatatatgcttcccaagacagatgttttgtgcagtgctgtacatcttcgacgcttgacaaacaacattcttatgtgtagttaagaagtcacattgttattgttgttgacatttacataagtagtttttggtcccttttgtta

SEQ ID NO: 24 - DNA, 1278 bp, Brachypodium distachyon
cgatcgattcgatgccttgcctcctcctctctccggccgcctccctacgagtttataaacccaccgcacagtgcccgcacggccgcacccttctgctccgggctacgcacacagggccggagcctgtggccgcgccgccccatttctggggagcgtctgaggattagattggattccgttttggggagcacgaagaaaggaaggaaggatggtgcggggcaagacggagttgaagcggatagagaacacgacgagccggcaggtgaccttctccaagcgccgcaacgggctgctcaagaaagccttcgagctctccgtgctgtgcgacgccgaggtcgcgctcgtcgtcttctccccgcgcggcaggctctacgagttcgccagctctgccagcctgcaaaagacgatcgaccgctataaggcatacacaaaggataatgttaataagaagacagcacaacaagatattcagcaaatcagagctgacactgtaggcttggcaaagaaacttgaggctcttgaagattcgaaacgaaaaatcttgggcgaaaacttaggagaatgtactactcaagaactgcatattctggaagctaaaattgagaagagcctccacatcatcagagcaaagaagtcccagctgctggaacggcagatagctaagctgaaagagaaggagacgatgctgctcaaagataatgaggaattacgcgaaaagcagcagcatctcgccgcactgatggtggttccctccctgaaccatgttgcgctttcgcctttgcagcccgagcccgagccggagcctagcagcgacgccattgacaccgtggagacggagctgtacatagggttgcccggcagggagcgctcctccaaccggcagtcaggttgagccaagtagcacgcgtgcaccgtcagattaatcggcggcaggttcagctcacaggaataagctctcttcagtctgcacctgcatctgcacgcgtgaagtgcccagcctgtagcccactgttaatttctctatgtttagtttatctctactgaaatgattcacctgcacaaaaaagaaaagggtgtaaattagcagccgcgatggcgacaaaatcaacccgcagctgacctccgacatctgaaagaaaatgaaacacccaggagcacgtggacggttccttcgtttggatgtctatgtaaattacagtctgaagctatatgaagcacttggaaccaatcgatgattaagtagaaaggaaataaaaaagaggaggtccgaatcttctg

SEQ ID NO: 25 - DNA, 898 bp, Brachypodium distachyon
agatttgatacatgccaacctgttgcttcttaacagaaccaaaaagatttggccttggcctagaagtagctagcaagagagatcttcttgtgggagaaacaacagagagagagagagagagagataaacagagagaagggagacagagagagtgcctttaccttcttccgaagaattcaggaacagggatccttaccagaggtgaagctgatctttgtttgggttggtgagaaatggagaagaaacaaatgaagatggccatcatgaggcaagaacagacattcagacaccaggtaaacgaactgcatcgtgtataccaggttcagaagcaactgatgacggagatgcacgttgttaagatgaaccgggctcaggcaggagaagatactcaagctgaagcaatggtggagacaaatcatctgcaatggtacagtaactcaggcgagaagaagccccctcccgttgaagacttcaacctggagctgacactagcaactgggaatgataggaggaaacaagatatggcatccaactcagactccggcgcaacagtgtcgtcatcaacttctgctgaatcagagtcagggcagcgattccccaagtccaatgtaaacgtaaggtttcaaaataagagcgagaggcatgatgatcagcacatgcagtctccttggctctaccaatgtttaagtctgaagatggcttagctaggcttcagtgtttcagaattcagtccaaacagaatcacaggcattattatgtgtacatcagaaactaatttgttgcaactggaggaacgagctcaatagaaagtaatcggccacatctaaaaacgtgtggctgattagaaatagaaagtaatcagaaagggggttattcgtcaacaaaaaatacattttat

SEQ ID NO: 26 - DNA, 4431 bp, Brachypodium distachyon
cgatcgagcgtgtgtgcacggacagcgcggctgcgcatttctatgcgaggatttagaggggagagatcagggacaagaggtggggggttttgccttcggcaatggagatggctctccgggcgcagagcccgctctgctcccggagccggccggtgctcgtcgtgcggccggccaacgccgccgctgccctcgcgcagcctattgtgaagtgcagcagatttacaagaagcaggcttgttcgatgcatggtagcaagttcagattatcctaagaggaatccaaggagatcatcaactcctaagcccaaaggcacagcctctagaggatatgctccaagacctgctgcggaatccagcacgaagaagattgaacagagcagcactgatgaaggtgatcttgccagaagcaatgtgatgctcggtagtgcaggaatagagcagacaggtactgcagaagaatcatctgaggtcgacctctcaggaaatgttcccagcagcgaggcactggagggagtgaatgagactgagaatgaggaagagattgaccaaaagctgccaccagcattgtcttccacatccatggatgctgagtcaattagtgaagcagcagatcagacaagtaccgttgaagaagcatctgaggtggacttctcaggaaatgtttctagcagcacggcactggagggagtgaatgaggctgaggctgaagaaaaggtcgaccagaagcagacttcagcattggcttccacctccatggatgttgagtcaattgacagagaacttgaggagtaccgtggcaaaataagtgcactggtggcttcaaaccctgggccatcatctcttgctagcaatcaaggacaggacaaaccaatttttggtgttcatgagcaagacaaatcggtaattaatttccatgagcaaggcatatcaattgttgatgtttccaaacaaagtcagttggctgttggtgtcactgaagaagatccaacgaaacaaaccaccataattggtgaacaggatatcgctgaagaagcagtggaggatatagacagcaaattttttgaggatgggcagcttgctttatcagaagatgatgctgggacaagtaaatatgcgcaagaagagccttcagttgctggtgatcaactgaggatatcggaagatggacatgatgaaccagagattcaagaactggtacagaaggatgttaatcttcaagtgctaaagcgaaggcttgaagagcttgctaatgaaaactactcgatcgggtataagtgttttgtttttcctgaaatagtgaaagctgattcagttattgatctttacttaaatcgtagcatcactgccttagccagtgagtccactattcttataaaaggggcattcaatggttggagatggaacctttttactgaaaaaatgcatagaagtgaactagccggggattggtggtgttgcaagctccacataccaaagcaggcatacagattagactttgtgttctttaatggtgacactgtctatgaaaataacaattataatgattttttcatagaaatagaaagtgacatggatgaacactcatttgaggacttcttggtccatgaaaagcaaagggaacttgaaagacttgctgcagaagaagctgaaagggaaagacaggctgaggaggagcgccggaaggaggaagaaagggccattatggaggcttatagggcacaagcaaaggctgaagttgagacgatgaagaatagattgcagcatgtgttgggttcagccagcagacacatggataatctatggtatatagaacctagcacatataaaggaggtgatagggtcagattatactacaaccgaaacttgagaccactaatgcatagcaatgagatttggctccatgggggttacaacaactggactgatgcactttctattgctgaaagactagtcaaatctcatgaaaaagacggtgattggtggtatgcaaatgtcactttacccaaaagtgcattggtgttggactgggtttttgctgatggaccacctgggaatgcaaggaattatgataacaatggaaagcgagatttccatgctgttgtttcaaagagcatatctgaggactttttttgggtggaagaagaacacaggatatttaaaagatttcaacgagaaagaaaagaaagggaggatgcggatcggagaaaggctgaaataactgcaaaaatgaaagctgagatgaaggagaagactatgagagagtttcttctctcacagaaacacatcgtgtatactgagccactcgaagtgcgtgcaggaaccaccgtggatgtcctatacaatccttctaacacagttctgaatggaagccccgaagtttggttcagatgttcctttaaccgttggactcatccaagtggtcctttgccaccgcaaaagatggtgaatgcagaaaatggttctcacttacaagctaccgtcagggttcctttggatgcatatatgatggactttgttttctccgagtcggaagaaggcggaacatatgacaaccgaaatggaatggactatcatattcctgtgtctgattccatggcaaaggaaccacctatgcatatcgtgcacattgcagtagaaatggctcctattgcaaaggttgggggtcttggtgatgttgttactagtctttcacgagctattcaagatttgggccacaaggttgaggttattattccgaagtatgactgtttaaacttaagcaatgtgaaggatttacactgttgtcaaagttttacttggagtggtacagaaataaaagtatggtttggaaaggttgaagacatctctgtttatttcctggaaccacagaatgggatgttttgggttggatgtgtctatggaaggaatgatgaaagcagatttggcttcttctgtcattctgccctggagtttctccttcagagtggttcttctccagatatcatacattgtcatgattggtcaagtgctccagttgcttggctgtacaagcaacagtatgttcataatgggttgccaaatggtcgggtggtatttaccatccacaatcttgaatttggagcaaatcaaattggcaaggcaatggcgcattgtgataaggctacaaccgtttcgtacacatattcaagggaagtgtctagacatggttctattgctcctcactatttcaaattccatggcattcgtaatggaattgattcagatatttgggatccctataatgacaactttatcccggtccattatacttctgacaatgttgttgaaggcaagagctccgcaaaaaaggcattgcaggagaagcttggattacaccaaactgatagccctgtagttggaattatcagtaggcttacagcccagaagggaattcatctcatcaaacatgcaatttatcgaactcttgaacggaatgggcaggtggttttgctaggctcagctccagatcatcgcatacaaagtgactttaccaacttagcccgtaaacttcatggtgaatttgatggccgggtgaagctttgtttgacttatgatgagccactgtcacatttgatatatgctggtgccgactttattctcgttccttccattttcgaaccttgtggtttaacgcaacttaccgccatgcgatatggatccatcccaattgttcggaaaactggaggcctttatgacactgtttttgacgtcgatgatgataaggagcgagcccgtgaacaaggcctagagccgaacgggttcagttttgaaggagctgatatcaatggcgtagattatgctcttgacagggcgatcaccacatggtacgatgctcgcgattggttccactccctctgcaagcgggtcatggagcaagattggtcctggaaccgccctgctctggactacatggaactgtaccattctgctcgcaaaaactgagactaactgacaggaagaagaaaaaatgaatctccagggaataggtttaccaggtttctgtaaaatgccaatgcttcgccgtatgccattttcggtggccattatttcatcaaatgggcaatgagagcaagtatggcttatacatctccggcgtctgcaagaggctaaagagctgtttactgtgcccagcgatttgcgagctcacaatcacgtggcgcaaatgtgcagtttcacaagcatgcaccgatgcaaatatgttctgtctttacgtgtctgtagttcttcagatgtacatattttgtaagctgactttagattcttagggccgactctctccatgtagttcctttcctgcacatctctgaagaataaagtgcgtatcaaatggttacatgatgtatctcaaactcaaaaggtgtagtactttaagcatcattaaccattttgtgaataccagttctctaattatgcc

SEQ ID NO: 27 - DNA, 661 bp, Brachypodium distachyon
gcgttgcgtacgtctcggccagccagccagccatggaagccctcgcctcctcctcgccccggctggctctcttctcccgcacagcaacggccgcaaactgggcctcgtcgtcgtcgttggtcaggcggagtcctgctgcccgtgtcaaggccgccgcagagccggccggcgaagcgaagccggccgccgccgccgccgcgacagccgatggcgcgccggcgcccaagaagatcctgaagaagaagcccgtctactccatgaagaaagggcagattgtgcgcgtggagaaagaaaagtacctaaacagcataaattacctgtcagtgggccatccccccttctacaaggggcttgactacatttacgaagaccgtggcgaggttctggacatcagagtctttgaaaccggagaatatgccctgatcgcgtgggtagggattccaacccctccggcttggctaccgacttacatgctcatcaagtcggacaagctcgactacgagagaatgtgattggtggatgagagtttgcacagaatcaggaaagatgatttattgtccacagattcattgttgtgccacgttgctccatggatttatacaaacctgaggagttgtaagaagaaccaaaagtgaaaatacaaaagttgttctatttgaat

SEQ ID NO: 28 - DNA, 974 bp, Brachypodium distachyon
ctcttccccgaccgcatttcccccacctcatggccgattccgccgccctctcctcctccctgccccgctccctggcgtccaggaggcccctctcctcctcatcatcctcctcccctctccgcggctgcggcggcaggtcccgatccccgcgccgctgccgcttcgggtcgcgcctgcgggcccgcgcgaggaaggacgaccccgaggacccctacgggccctacccctgggagcagcccttggatctctcctctgggttcgatattgagtgggtgcaagaagataaaatcacattgttcacttctgatgggcttgttcaaatagggggttccctggtacctcgtcgattgtctgcttccgagaagaggaaacaaaaagcaaaagggacacataaattccgccggtttcaggagagttcttacatggatccaaatcaaagtctttgccttggatcactatttaacatagcagcgacaaatggcctagacatgggtagaagattatgcatctttggcttttgtcggtctattgaaatgctaagcgatgtggtggaagatacagtactggagcacggcggtgaggttgtcattgcagagaaggcgagcaacgatggccttcaggagaagctaactatgtctgtcgccgtaccactcttgtggggcgttcctccagcatctgagaccctccatgtcgctgtgcggagcggtggaggtatagtggacaagatctattggcaatgggacctgttctaaacgctcaggacccatacacattaacaaacaatccatcccacctgtatatatgttccttcctcctaattggctgcacgcatcgtgtcagcaactgtgttcgtgccatttctacccaaccggcaaacttcacgtatataaacctgtacagacctgtttcctctcgtgctatcgtgcatataaataaataaaaaggctctgagctcacggcccatgttcaatcaa

SEQ ID NO: 29 - DNA, 1874 bp, Brachypodium distachyon
tctccccttcttcttcttccccggtcctgactccggtggccgctgacatccgcggaggcggagggaggtgagtttgtgtctgtttgttttcgttgttcgacgcggaaccggaggatggagcatggcggcggaggggctgggagtggcggcgggggagccgcgccttcgagcagcaacagcggcggcggggggagcggcacgagcgggagccgtggcggcggcggcgaccaccacccgcatcacccgttctactacgcgggcccatcggtggcggcgcccaacaacaacagcaacaacgtgcagcagcagcagccgcagcagttcatggggtcgctcgccatcaccaccgccgccgtggccgccgaccaggccccggctaacaaggagaaggcggtggcggcgccggtgaccccgtcctcgtcgggcgcggtggcgaagcggccgtccaaggaccggcacaccaaggtggacggccgcggcaggaggatccggatgccggcgctgtgcgcggcaagggtgttccagctgacccgggagctgggccacaagtcggacggcgagaccatcgagtggctgctgcagcaggcggagccggccatcctcgccgccaccggcacgggcaccatcccggccaacttctcctcgctcaacatcacccgcgcctccggctcctccgcatccgtttccgccgccgcacgcgccgcaacgccgttcccggccctcgcgctccacccccacgcgcaccaccaccacgacatgtccaccatgctcggctaccaccaccaccacctcatcccgccgcagccgcagccgcagcagcaggagccgccccatgaccccaacagctctggcggcggcggattcatgaggaagcggtatcgggaggacctgttcaaggaggacgacgagcgtcaagatcccaaggcgcgcgagcagcagcagcccgcggcaatgtgggccgtggcgcccaacagcgcggcccccggcggcgccttctggatgctccccgtgtccgcgagccaggccgccggggcccggcccaccgagcagcccatgtggtccttcggcggcagcggcggcgggggcaccagcaccgtgcaggcgccgctgcagttcatgtccagggtcaactaccccaccgccgccgggatgggcggctcccccgccgacaccaacatcggcatgctcgccgcgctcaactacagccgcggcggcactgaggaccagcaggagcagcagcaccagcagccggagatggagcagcagcgcggcggcaacgagggcgaagaggaggaaggcggcgacgacagcggcggagaggaagaccacggcgccaacaacaacaacagctcacagtgagttaacctcgtcgcaagaagaacctcatcatctgcagcaaacaaaaaaaaactctgaatccgccatgatcatatcgcaatcgtgctagtgggtcactgcgtagcagcaggcaccccccataggactggaattcgaatcgaatcctgctgccttttcccctgagatgccatcattgagttagaagggaagattggagaaatcaagcgaatggaactgaagaagaagccaagccaaatagccaatgcaggaagaacttcttgctagtcccattagcctcttgttatttgttttgggtcgaattttttcgtctgttaatttcctttggattgattccatgagttgaatgattgtcttcgtttcgttttagtagtagatgggtgttatgattagcagtgggtcccaattcaggaggggccaagaatcgaacaagaagaagaaactgagtttgatttgtacagctgatcatcttgatttgtgctgcaagttttaatttctagcatccgtattatttttct

SEQ ID NO: 30 - DNA, 1125 bp, Brachypodium distachyon
acaaaagggcacacggacaacataccctggagtctccacaccaccaccaagtacaatcctgccactaaaccccatccactcccttatcatcgtttccctccctctccttcccctcttccgttcgttctcaggcccccctctctctgcctgccatggcaaatgcttctctccaatccttccttcttcagcaccaccaatctttccacaacaacagcacccatgaaggcccctcttctgtaatcctcaagctcacctccagcaccagcatttccttcaagctcttctccagcacctcctcctcggtgagcacagcatcaaccgccaacacatcagcgccaactccagtcgctgctgccgccgcaacaacctcaccccctacgccctccctggagctcctaggccagcagcttgcggacggagattatcgccaagctgacgagaccacccgcgcactcctcatccacctcgcgggcgagcctgcacgtcgtcgagggtatgttttcttctcggaggtccaatttatctccgtggaggacctccgtgccattgatatgctctggctggagcatagcaaccgcaagtttggatacagcgtacagcgacggctttgggagaagtcgctgcgtgactacacccgcttctttatcaaggttggctggatgaagaagctggacactgaagtggagcagttcaactacagggccttccctgatgagttcatatgggagctgaatgatgacaccccagagggccatctgcctctcaccaatgccctcagaggaacacggctcctaggcaacatattcactcaccctgcctttgagtgtgaagaagaggaagcagcaggagaggagaatgagacaggtactaccactggtcagaataaggatgacatcaaagggagggggaggccaaagattataacagatttcaagcctgactactccttttaaggacagcaaacctcgtggaagtttgtgatgcagagatgttgtcatggtgcgattgatttaaaaagtcatgtgtctgtagttccttttggttgcgtttgtactaaacatgcatggaaatttgtgacagaatattataaagataattgttcgagaagctgtttgctctgcacac

SEQ ID NO: 31 - DNA, 1201 bp, Brachypodium distachyon
caccaaaagcaccccttccgtctctcttctctgcttccgcgcctccgctctccccgcaggtgctctcgtcacgcggcggcggcggggagggagaatggcggcgccccgggcagtgccggcgttcgagagtctagccgggatccgacccctcgcggaatccggccgcttcaaggcatggttcctggaccagtttggtgttcttcacgacgggaagaaaccctaccctggcgccattcttgcactggagaagcttgctgggtttggagccaagatggtgataatcagcaactcctcgaggcgggcgtcggtgaccatggagaagctggggagcctcgggtttgacacgtcttgtttcctcgcggcggtcactagcggggagctcacgcatcagtaccttcagaagagggaagacccatggtttgcagctcttggaaggaagtgtgtccatcttacgtggggcagtcgaggtgcaatttctctggagggtcttggtttgcaagttgtgagcaatgttgatgatgcagacttcatactagcccatggtactgaagccctgggtttaccttcaggtgatccacttcccaaaagtcttggggagcttgagcaggttctagtgcttggcatacagaagcgactaccaatggtggtagctaatccagattatgtcactgttgaagctcgagacctgtgtgtcatgcctggcactctggcagcaaaatatgagagtcttggtggtgaagtaaaatggatggggaagcctgataaggttatctatacatcagcaatgtccctagcaggtgttgaaacccatgaatgtatcactgtgggggattcgctgcaccacgacattaaaggcgcaaatggagtaggaatggcttctgcattcattactggagggatccatgcgtccgaacttgggctcggtgaattcggagaaactgctggagatgataccgtcagtacattgtgttgcaagcatagcgcatacccatcctatgttctgccttcatttacatggtagaaatatggtttagattcaggtacatgctttacactggaaaacattttagaataatgataccctttggaattgtcaaaatgagcataaagactgtggaggtgtttctgtgcagtgctaaattgttatgtattttcggaaatacaatctctgctgatttgattgatagaaactgcatgcgac

SEQ ID NO: 32 - DNA, 2103 bp, Brachypodium distachyon
acccgcaacacaccccccaaccccggcgaccgccattagtgcgagcgaggtcatccggagatgaaggtgatcgagaagatccaggaggcggcggcgaatggccggacggtgttctcgttcgagtacttcccgcccaggacggaggaaggggtggagaacctcttcgagcggatggaccgcatggtggcgcacggccccaacttctgcgacatcacctggggcgccgggggttccacagccgacgtcaccctcgacatcgccaaccgcatgcagaacatggtatgcgtggaaacaatgatgcacttgacatgcaccaacatgccagtagagaagattgatagtgctttggataccattaagtccaatgggattcaaaatgttctggcacttagaggagatcctccacatggtcaggacaaatttgttcaagttgccggtggattttcttgtgccctagatctggtgcaacacattaaagccaagtatggtgattactttggcataactgttgccggctatccagaggcacaccctgaggtaatcctaggtgaggaaggagctaccgaggaagcatatagcaacgatcttgcttatttgaagagaaaggttgatgctggtgctgaccttatagttacacagcttttctatgacaccgatatgttccttaagtttgtgaacgactgccgtcagattggtataacgtgccccattgttcctggcataatgccaataaataactacaaaggtttcatacgcatgactggattctgcaaaactaagattccagccgagattactgctgccttggatcctattaaagacaatgaggaggctgtcaaagcttatggaatccacctcggaactgagatgtgcaagaaaattttagctagtgggatcaacactttgcacctttacacgttaaatatggagaagactgctttagcgattttgatgaatcttggattgatcgaggagtccaagctttcaaggacattaccttggaggcctccaacaaatgtgttccgtgtcaaggaggatgtccggcctatattctgggctaatagaccgaagagctatatttcgaggaccctaggttgggatcaatatccacatgggcgatggggtgattcccggaacccatcatatggagcacttactgactaccagttcacacggccacgtggaagtggcaaaaagctccaagaggaatgggctgtaccactgaaatctgtgcaagacattaatgagcggttcatgaacttatgtcaagggaaactgacaagcagcccatggtctgagttagacggtcttcaaccagagacaaagataattgacgaccagctggtgaagattaactcgaagggtttcctcaccatcaacagccaacccgctgtaaatgcagagaaatctgattctcctagtgttggatggggcggtccaggaggctatgtgtaccagaaggcatatgctgaattcttctgtgctaaagacaaactggaccaactagtcgagaagagcaaggcattcccttcacttacatacattgccgtgaacaaggaaggggagacgttctcaaacgttcctgcaaacgccgtgaacgctgtcacctggggcgtgttccctggcaaggaggtgatccagcctaccgttgttgattcagcgagcttcatggtctggaaagatgaagcatttgaaatctggtcgaagggatgggcctgcctattccctgagggcgactcttccaaggaattgctagaacaggttcagaagagctactacttggtcagcctcgtggacaacgactacatccacggggacctcttcgctgcgttcaaggagatctaatgtatgagataatacccgtgctgtcttccagcctttttgcgtggctaaactcctcccgccttggggctcttgcttccacggctacatgggtcgatctcactcgaacgcttgcgcatttgcccccctctcgctggagtcctctgtctagcctgatttccgtgatttgtattgatttatccagaccgttcaataccaataagaattgagctcttagtagcccggcttttcccggcccgtttttatcatgtagcatcattt

SEQ ID NO: 33 - DNA, 1067 bp, Brachypodium distachyon
tgtgaaaccgaaaaccggaacgccgcccacgtcctatccactaccgatcgactcacaccgcgctcgatcgaagctctccccaccgctaaacctcgcgctcagccctatccatggccgcggcaaccatctccctctgcggctcacgctgcctcggcccgagcctgaggcctgaagcgcgcctcggctccccatcccctgcccaacttctcgtagagcggggaagtggccgcgggaggccgtcgcagcgaaggcctgtggccgtagccgcgacggaagggtccgccaagtcgtcgggcgaggcggacgagcaggtcccctcctgggcccggccgggctccgacgagccgccgccgtgggcgcgcgacgaaggcggcggcggggcggggggccgcgaccccgccgccgtccaggtcccgttctacgcgtaccttctcgcgtccgccatcacggccatcgccgctatcggatccatattcgagtacacgaacgggcggccggtgttcggcatcgtgggcgttgacagccccctctacgcgccgatactgggcttcttcgccgtcaccggggtcccgacctccgcgtttctgtggtacaaagctgtgcagacggcgaacaaagacgccgaggagcaagaccggaaagacggcttcctttgatctcccggccggaaagtgctacgctgtttttgtattctggcttagcttggtggcgtcttaatttccatgtgtttgaatgcctcatctgatacacgagcaacatctgaactctgcattttgaatgggggaggaaatgcatgcatgcgtgccagctccgttcagttttccttccctaggaggtcgtgcttcgatgtgattttgggcaagaaggttcgttgtgtatgtaatccacgcaacacaaagaaaccgtccttgttctatatctttggctcaaacgtaaatatgatgatgagaaatgatagacctgtaccaaatttgtggagaaccggagacatttgtgaaccgtatgttttgcggacatactttcgtacattgtccatttgatttgaacacaccattgtgattagaaac

SEQ ID NO: 34 - DNA, 2287 bp, Brachypodium distachyon
cattacggtgcctctgtaaactgaatacaggagcaggagagccacaaaaccctcctctcttcttcgaccgtctttccctttctcttctcccgccgccacacgagcacggcacggccatggcacgcatcctatcgcgcgcccttccgttcgcctcgcactcgcacctccagttttcgccgcccatccgtggcgcggcgctgctcagctccgcgccgctcctcccgcacctccctgcggcgtccacggtctcactgctctcctggcgcgggttcactcccacccccgagccctcgcgctctgtgccgcctttcgcgggattcctcgctggcatacgtggcttccgaagggcgcggcgcggacaggcggcagcgaagcgagaacaggcgcaggaggaccctgcgcccccgcccccaccaaaggagagcgagatcgagctctacgctcgcatcggtgtcgacgaggacttgcccgatgatctcgaagtgctgaacattatagaaatcctgaaattaaatgttccgatggcgatgaaaattgcactagatgggcttttggagtacaactacaacacacgagacacttcaataagtgatgttgggaagtatgaaaaggttgaggtttctgtgttgctaggcaacgacaacttcatccagaatcttaacaaagagtggagaggcgaggactgcgctactgatatgctctcgatgtcacagtacattcctgatcttgatgttcctattcttatgttgggtgacatagcaatctcagttgagacagctgcaaggcaagctgaggagagaggccatacacttcttgatgaactgcggacactagtggttcgtggcctattgcatcttcttggttttgatcgtcaggctagtaatgaggctgcagtggaaatggagaaagaggagctgctcattttaaaaagtctgaggtggaaagggaaaggttttgctaagagtgctcttgatttgagcaagcctcgcacagaaacatcggatggacgagcgacgaatggtctaaagaaagctggcagcctaagattttatagaccaaaattcaaatatatcttctgtgatttggacggtacgctgctcaacagcaaaagtcgagttacagcaagaaatgcagaggctcttaaggaagctaggtcaagaggagtaaacatagtaatcgccacgggaaagacacgcccagctgcaattgatgttcttaatatggtcggtttatctggaagaaatggctttgtttcagaatcctcgcctggtgtatttcttcagggactggtggtatatggtttggaagggcaagagatttataaaagaaatttagaccaagaagtatgcagagaggcattattgtattctttggagcacaaggtaccactagcagcatttagcaaggaccgaagtttctctctgtttgaggacccttcggttgattctctccattatgtataccatgaacctaaggctgaaatagtatcatctattgatcagctcttagggacagctgagatacagaaagtactgttccttggtactcctgaggggatttctaccacgttgaggccatactgggaaaaggcgataggtgaaagggctggcgttgttcagggacagcctgatatgcttgagcttgtaccacctgcaacttcgaaaggcaggggggtgaagatgttgttggaccatctttgcattagcccggatgaggtaatggcaataggagatggagaaaatgacatagaaatgctacaactagcatcactgggtgttgctatggcaaatggggctgagaagacgaaagcggtggcaaatgtaatcggcgcaaccaacgacgaagatggagtcgcgcaggctatttatgactatgctttctaacagctgctgacactaaggagtatcgtttctttggttccccacggtgttctgggttcaccacccagtttcacatgtctgcacatctatctgacaaaactatacagggttgtgatcagcagcacccgttaagaggaacatttgaactgttaggcagagttattttttggctggcaatccatgaggagccaccacccatttttggctggaatatctgtaaaacgttttcaatctctgataaccaacgaccggtgtctgtgttagctaagctactttttcttccttgttgtattgagagtttaggattcagatttgcatgggatgttgtttaaccaatcactgcggtcaaaagaaatgtccggttacaacttgtctagttatttacaaattacatcaatatcttcgtg

SEQ ID NO: 35 - DNA, 1920 bp, Brachypodium distachyon
ttcatgcaacactagacagacaaccttagcaaccgcacaccttccgaccatacatacagctaaatataaaaaaaatattcacctcccctgttttggtaaatgaaattcctgtttttccatctgatagatatgaggtgatcaattcaagcaataccattactgtggaggatcaagccaggcatgctataatggagctctaccctggctatctcgaagaccatttcaacatccacaagctcagcggcgccggcacgtccccgccggagtacatgacctcggcgtcggcgcagttcgcgccggcgcccctcaggatgggcatgtacgagcgtcccccgccgcagcagccgatgccgccgtcgccgcagccggtggtcggcatgtggaacaacagcgtcgacacctacaaggtcgacagcggccaggccaccagcgggtccaccatcatggaggccgacaccaagttcgacgacgccgagcttgaagaggttccagggatggaggaactggagccaaccagggatgtcgatcaggaagcgagcaagccgccggataaggtgttgagaagactcgcacagaacagagaagctgccaggaagagccgcctccggaaaaaggcttacatccagcagctagagacgagccggataaagctggcgcagctagagcaagagctgcagcgaacgagacagcagcagggcctgtatcctccgggtcactcgggcatggcggggttcggcggcgtcggcggggtgcccatggattccggcgtggcggcgttcgagatcgagtacgggcactgggtggacgagcagaaccggcacacgcgggagctccgcggcgcgctgcagcccgggcagcagaccacggagctggagctccggatgctggtggagaccgggctcggcaactacgaccacctcttccggatcaagaacctcgccgcctccgccgacgtcttctgcgtcatgtacggcttgtggcgctcccccgccgagcgcttcttcctctggatcggcgggttccgcccctccgaggtcctcaaggttctgaggccgcagctggagccgctgacggaccagcagctggagcaggtgtaccacctgcagcagtcgtcgacgcaggcggaggacgcgctgtcgcagggcatggagaggctgcagcagacgctggcggacgcgctcacggccgccgcagaccccttcgcctcccccgacggctactccgggatgaacgacgccatcggcaagctcaaaggcctcgtctgcttccttcaccaggcggaccatctccggctggagacgttgcagcagatgcagaagatcttgacgacgcggcaggcggccaggggactcctcgcgctcggggactacttcgagcgcctccgcgcgctgagctcgctctgggctgctcgcccgcgcgagtcggcgataagctgaaccttctgctcgtggaaccaaaaaaaatggttgcaggatcagttcctctcgtagtatgatcagttgtgtagttcccgggtcaagggccgccgccagtgaaggatgaagaaatccaatcacgctagctgctgggttccgggagaattatctgagtttatgacgccgtacgcgcttgcattgtctgccagatgaaggagtagttccagattccgaagagtaagtaaaaggagagtgtaaaggtcgatcagattgggcaggtcgatctcacgatcgagagaatgtgtaaatacatgttttgtggtgtcacatgcctgatcgagacctctatctgctgccgtacagattttattttgcggtgatggtgaccatcgatgatcttgttgaagtagccgtgtaattgcacaaaggggtacgcactagtttacgcgctatgtatatatacgtgtatgatgtaattcttatttttattttgaagtgaaggtgt

SEQ ID NO: 36 - DNA, 1464 bp, Setaria italica
ccgcttccccactctctccctctctcgctcgccgtctctttcctcgcgccgccgcttcgcccagcaaacgcgcgtgcgccctcctctcatctcgccaagaaaagcaccgatggagacgccgctgtccaccaggaggatcacccgctcgctcgccgccgcggccgccgcatcagcccagaagagcgccgccgcggggacggattccgcggcccagttctccctggccaagaacgccaccgcgggggagccccagccgcgcgccgcgctgcacgacatcaccaacgactcccccatcgtcggcctcgccgcgggcggcctccacggcaccgacaagacccccgcctccaccgcagccaagacccgccgcagggccccgcgccgcacgcccggctccggggaggcgctcctgcgcggccaggtcaaggcgctcctgcacaaggtcgaggaggagcagggatgcgccccagcggctctcgtcaggccagcacgcatccaggcgctgctcggggtctccaggtcgccggcccagctcctggcgcccacgccggccaacacgccgcagatcgggcccgtccccgcggccagggaaggcctcctgatgcctgatggcgtccccgtggtgccctgcgtcctcgaggaggaggaactgctgcttcctaagctgcagatcattgcagctcccctgccgccacctcagccagaggagaacctgggcgagtgtcagctgaaccgtgcgctggtgttcgacgactcccctgagaagtccagcgcgtccaatgggtcggccgtcttgttccaggagagcagtactggcagctgcaatggcaagtcgtcatcacctgaggacgacagctcctcggcctggtccattcaggtccatgccagctccgagaagggcgacgaagaagagcttggcgtggaggacctaggagagtacactgaagaagaggaggagtgggaagaagacagcgacgacgaagactgcttcgatgacctgtgcgaggagatgagcaggatgaccgtggtcgatgaagaggagaggaaggcagggctgccacagttcgaggggaggcacacccggttcatctacaacagcgacgacgagatcgagcgggaggaggtagcggatgcagctgaggcgagggcggagctcggcgcgctgatgctcagggacctgccggtgccggaaggcaggcacctgcgcttccaggaggacgaggaggatgaggagtgaagcgtgtcagttgtgttcggattcgggtatctgcagtggttgtcattccctgacaccagccaaacattcttttgggggttcttctctgtttctacattctgattctgtattttgattcgtgtctcagttcttcggagaacacaaattaaattgtattgccaattcaactcttctgaaatgcaagtataggccccagttactgaataaatatctgttctatgtcattcggt

SEQ ID NO: 37 - DNA, 1592 bp, Setaria italica
acagctcacatcttgaaggagcgaaatcatccgctgccggcgtcagcgttgtatccaaagcgtccaccgtcgtgctagattccacaactaggcaggcaggcgccacacgccagccgtcctggtgtgcgtcactgcgtctcgtgcagacagacgcggtccacagctcgccacggccatggacgtggaagcgcgcaaggacgcggcgcccgcgcgcggcaaggcgatgcgccgcctcctggtggcgctcaactgcgggatgctcgcgctgggtgccatcggcgggccgctcctcagccgcctctacttcagcaagggcggccaccgtcagtggctgtccgcgtggctcgagaccgccggctggccgctgctgctggtccccgtggtggcggcttacgtcgcccgccgcgcgcgcgaccgggccgccccggccctcctcaccccgccgcgcatcctgctggccgcggtgggcctcggcgtcgccacgggcgtggacgacttcatctacgcctacgggctctcgtacctccccgtgtccacctccgcgatcctcatctcgacgcagctcgcgttcacggtgctcttcgcgttcctcatcgtgcggcagcggctgaccgccgcgtccgtgaacgccgtggcgctcctcaccgtgggcgccgtcgtgctggggctgcacgtctcctccgaccggccccccggggtcaccaggggccagtactggctggggttcatcctcacgctcggcgccgccgcgctctacggcctggtcctgccgctggtcgagctcgcgtacaggcgcgccgccggcggcgggcgcgccgtgacgtacgcgctggtgatagagatgcagctggtgatggggttcttcgccaccgcgttctgcaccgtgggcatgatcgtgaacaaggatttccaggcgatcccaagggaggcgaagcacttcgagctaggggaggcccggtactacacggtgctggtgtggtcggccgtgctgtggcagtgcttcttcctgggcgccgtgggggtcatcttctgcgtgcacacgctgctcgcgggcatcctcatcgccgtgttcatcccggtcacggaggtggccgccgtgatcttcctgcacgagaagttcagcagcgagaagggcgtggcgctggtgctctcgctctggggcctcgcgtcctactcctacggcgagtggagcgactccagggccaagaagaaggctgaggccgccgcggaaggccaggcctcgtgattcttatactgcaactgtggacgatgatgagagatcgaggctctgatctcttcccgttgtactttctatatgctgtgattgtggccgtgtcgatggagtcgcgtaagtcgtcacctgcaactgtaggatggtcaacattcttcagttcagttgggtgggtagtactgtactgcatggtgcatggaggtgtgtatgtcatactagtactgtaccgtacagtacatgaaactgctcgctacgtttgaagtcgtagcaaagcgatcggcgcacttgtaacccgattccgggtatggttagaacgaatacaaaatatgtttctgtgactattctccacagttaaaacgag

SEQ ID NO: 38 - DNA, 2940 bp, Setaria italica
gggcccgcccgcggattcgcgctccccggcgcgccaaaccctagatccgccgccgctcatcccgccgccgccatgttctggcgcatgaccggcctctccgcggcctcgcccgtggatacaattctggacaaagaaaattttacgttggaagaacttcttgatgaggatgaaattattcaggagtgcaaagcactgaattcacgactcataaacttcttacgtgacaaggcccaggtggaacagttgcttcgttatgttgtggaagaagttccagaggacaatgaaaaaaagcgctctttcaagttcccttttattgcttgtgaaatatttacttgtgaaattgatgtcgttttgaggaccctagtcgaggatgaagagctaatggacttgcttttctcatttgtgaaacctgatcatccacatagcacactattatctggttatttcagtaaggttgtaatatgcttgatgctgcggaagactgccccacttatgaattatgttcaggggcatccagagatagttgtccagcttgttgacctgattggcatcacatcaataatggaggtgctgatacgactgattggtgctgatgagaacatatactcaaactacggtgatacattgcagtggttagaaaatacagatgtccttgaaatgattgctgataagtttagctcatcggattctcctgaagtgcatgccaatgctgcagaaattctatgtgcagtgacacgatgtgcacctccatctcttgctgcaaagatatgcagtccaagttttgttggaaggttgttccatcatgcttttgaagaatcaagaccgaaatctgttctggttcattcgttgtctgtgtgcatatcattgctggatccaaaaagacttgcatcagcttcctatcaagcattcagaagcaacttaagtcatggggcattggtcactgccagtccagagacagttgatggcatgcttgagagcctaggcaacttgctgatgttattggacacttctgctgctgaaaatgtattgccaacaacttatggatgtttacgcccacctcttggcaaacatcgtctgaagattgtagagttcatctctgtgctgcttacaattggtagtgaaactgctgaaaaggagctaataaggcaatcagcaataaagcgctcaattgatttgttctttgagtacccatataataactttttgcaccaccatgttgaaaatataattgtttcttgcctggagggtaaaagaactgaacttgttgagcatgttcttaacgagtgtgacattgttggtaaaattcttgttgcggaaagactttcttctttgtcgacagagtctaacgggcctaccataccctcggaagagaaagcccctccaagaattgggaatgttggtcacatgacaaggatagccaataagcttattcagttgggaaatagtaacagcacaatccaggcacatttacaggaaaataccgagtgggttgaatggcaaacaaatgtgctggtcaaacgcaatgaagtggagaatgtttatcactgggcttgtgggcgcccaacatcattacatgatcgtggtagggatagtgatgatgacgacttccgagacagggattatgatgtggcagctcttgctaataacttgagtcaagcattccgttatgggatatacagcaacgatgacattgaagaggcacaaggatcacttgaacgcgatgatgaggatgtgtattttgacgatgaatcagctgaggtggtaatatcttctctgcgtctgggagatgaccaggacggcagctccctctttacaaattcaaactggttcacatttgatggagagagaggcatcaatgaccgtatatccgattctgttccctcatcgtcacccaattctgaggagatatccctagagaccgaggaagctgatgatggtaaagtcattggcactgaggatgaaatggaaaccgtttgccttggaaatgggagtacagaggaggcaaaggatgtagcagaatgtgtcgaacagctaaattgtagtacagcgaatgagccgttgcaaaatacagacagtctggaacggcattcagatgtttcaaatggcagtaccgaagtaggtacagccgcagcggcagaatcttcagccccatcagttgagattgcggcagaatcttcagccccatcagttgagatagcggcagagaaaacggcagatgaaccattaatggtagagagaacagtaggtgaaccagcagtctcatctgatctggacaattctatctctgaagctacaccgggtgctaatggaagtgagcctgctgaccctgaagtatcttctgaacaagttggcaatgacactgatgtacagcaaccagtaaaggaagttgctggtgaggatgttgatgaaacaaaaactgatgcagtcaaagcaagcgactgaagtagcaacatgtcgaattagagcaattacttgtgaactcggcggtctgcatgattttgcttcatgtctgctcagaagccacggaatagtccgaagcaaactgctgtacaataagcaagtgtattgttctgccatccaccgtggcatatcactgtacaaatgagcaccattgactaaggcacgctcaccgtgttgtctgaaactggtcattttctttgaaatttacctccagttcatgtgctctggtctggtggcagtcttcgtgaagttgtatgtgatacctgaaagaacattctttgagtggcaactggttttggctacgtagtcttctgtttctttaggttaactgtggaactgtaatatgatgtcatattatttctagtctagctattgttgtaagtttattcagactctacatgtttcagttcaccttgaacatgttattttttataaagattcccggccccatgtattcaattcttaaagacttgtttgatc

SEQ ID NO: 39 - DNA, 916 bp, Setaria italica
tccactcgaggtccacaaacactagagcgagatccggcggaggcagagtgggaggccgtgggggagccgtgtctacccgtggaggttcgatccatctctcctcccctcccgaccgtcgtcgcatcgcatgcaaccacccctgccgctgctgcgttgcttgacggcctcctcctcctccgccctcccgctctcggtgttggtgcgcaagcacaagctaggattattattctccacggccatggacgacggcgtttcttcgcaagacaagaagacgtctccgccgccggcggggggcgtcgcggagcgcatcatgccgcatctcctcaacatctacggatcgcgcgcgacggcccgggacttcgagatttacgcgcccaacgccacgtttgaggacccgctcatgcgagcccacggggtgcagcagatcaagtcctcgttttacacgcttccaaaggtgttcgcggaatccaagatcgtggagtacactgtacatgagaatcccacgggccccggcaaagccgagattctgatcgacaacaagcagcactacaaggtacttgggaaggcggtggagctgaccacgctcatcaggctccaactccaggacggcaaggtggtcacccacgaggactggtgggacaagaagcctctcaagaaccgggacacggtggggttcccgctgctgggccgcgtcgcggaggccacccgccggggagcaatgctgctcacccacgccctcatgggattcggcaaggaccctcctgctcacccaccgccggcatcctcctcctcttgatctacttgtatctatatatatatatatatgtgctgatgatgattactgcatgctactgctacgccaatggcgtagtgatcaaataatctaccactgtacttaattgttgtcctactggta

SEQ ID NO: 40 - DNA, 2239 bp, Setaria italica
tcccacccccgcgtctcctggctccgatcccgcgacgtggccgccgttcggggccgacacgtccgcccgccagggcccccggcctctgacttccagatccttcctgccgcttcctggccacgaatgtccgtctcgatccagcggcccggcgcgcgccacgtgtcgggtcctgccacgtcagcgtccgatgtggcgcccccgtccccgaagaaactgatacggcgcagacctcgcggctctcagcctcacgcttggccttggaaaagcaagtggccgccgcttcccattccgccgcaaccaacaccagggccttgcttgctcgctcgcttgcttcgctcccatccgcgctgagtaatcgacggtggattcggagcggccggggttcctcgaggagatgaacggccgcggcagcggcggagggggagggggaggggaggaggagatggaggaggacggcggcggcggcgccggctgcgcgcagggggccggggcgggggcggagaataaggagcgggtggtgctgatgtggggctacctacccggcgtgtcgccgcagcgctcgccgctgctcgggccggtccccgtgaggctccccccggcggcggcggcgcccggcggcgatgggtggagggacgtgtgcggcggagggtgcggcttcgccatggccatctccgagtctggaaaactcctcacttggggttctgctgatgacatgggccaaagttatgtaactgctgggaagcacgaggagactccagaggttttccctcttcctagtggtgttgcaatggtgagggcggatgctggatgggcacattgtgttgccataacagatgaaggggatgtctacacgtggggttggaaagaatgtgttccaactggcagggttgttggagaccagtcttcagttggaaccatggagaaggatgaaagacaaattgcaatggccactgaccaagtgagccccaggtcacaggtatctaggacgagcagtggagcagcatctggtccttctgaaagcagaggcactgacgatagcacaaagcgacgaaggttgtcttcagcaaaacatggacccgagagctcaacatctagtgatgaaagtctttctgcacccccttgtgttgtgacatttaatacaggagtgaaaatagtggctgtagctgctggtggtcgtcatacgttagcactatcagatttaggtcaggtgtggggttggggatatggaggagaagggcaactaggtctgggttccagaatcagaactgtttcttctcctcatcctgtaccgtgcattgaatcggcactgtacagcaaggatcggccgtcagctatgaaaggtaacaagaccgctgaagggcacatcagtaaagtcatgggaaattgcgtgaaggcaattgcttgtggaggccgtcatagtgctgtagtaacagattcaggagctcttctcacatttggatgggggctgtatggacagtgcggacaagggaatacagaagatgttttaagtccgacgtgtgtatcatctatcctgggaatcaagatgcaagatgttgccgcaggtctgtggcacaccgtatgtacatctgtagatggtgatgtctattcgtttggaggaaaccagtttgggcagcttggcactggttcggatcaagctgagactgttccaaaattggtagatgctacaagcctggaaaataagaatgccagatctgtttcttgtggagctcgccacagtgctattataacagatgaaggcgaggtattctgctggggatggaacaaatatggccagctcggcctcggcgactcgatggacaggaacgtgccttgcagtgtccccgtggacacgtaccacccgctgaacgtgtcgtgcggctggtggcacaccttggtgctcgcggagtcgcctacctgaaacctgacaggaattaccgtagattgacaattttgttaggaacatgtaggctcgtgcaggtgcggatgctgcatttcatcgtgtacatacatggcagtgcatacagatgtgtgtattcattctttccggtgcgctcttcaacgtgtgcaacgtagacgaatcttgtatcgccctgcgtatacagttgagtaggattgcctgtacaattacgcttgaaactgggttcgctgacgcttgccaagcggttatgctgctcccacattgggtaaccggattaccagattgccgactccagccgtccatgttcttcgctactggagc

SEQ ID NO: 41 - DNA, 1195 bp, Zea mays
gtggccccgcggatgcggcctcatctccccggcgcggtttagatttccctgggccccgcacccctctcgtggcacagtcacatactttccgcgcctcttcttctgcgcccctctcctcccaaactgcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgccccggagatcttcggcaagatgggcatcatccccccggagaccgcgctgccgtggttcaagacgggcgtcatcccgcccgcgggcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcgggcccctcttcaacccgctcggcttcggcaagaccgagaaggagatgaatgagctcaagctcaaggagatcaagaacggcaggctcgccatgctcgccatcctcggttacttcatccaggggctcgtcaccggcgtcggcccgttccagaacctgctcgaccacctcgccgaccccgtcaacaacaacgtgctcaccagcctcaagttccactagaacgtggtgcatcagcatacctgctgctgccgccgccgccgccagttgtttgctgtggaaagctagatgcatgcgtgttgtaaaggaacctgaagcgttgcatcggtcatgattcatgcatggccagcctgctgcctgtaacaacaaactagtattgatcttattgagaccgga

SEQ ID NO: 42 - DNA, 815 bp, Zea mays
gtaggataagccgcttgtggccgcctcgccttccccatcacgaccaccacccaatcaccacgccagcttatatgccccacccggcgccactcgacgtctcacggagaaaaagaaagaggagctcggacaaggcagagcgccatcgttcggtttccttgctgaattcccgatcgctcgctcgctcgaaaagaaagaagctagcttttagcatggcgtctctggcgttcggcagcaccgtagcggcggccgtggcggcgacctcggggaggacgcggccggcgcgccggtccgtgctggtcgtgccgcccgctgccagcaggggcggcccggcgccggccaaggaggagaagggcctcggcgagaccatcttcggcttcatcttcaagaaggaccagctggtggagacggacccgctcctcaacaaggtcggcgccgcgccggccgccgcctcccgcgccaagacgaccgccggcaagaaggctgccggcggcgacgacagcggcagcggcggggggttcaacctcggcggcctcggcgggctcttcgccaagaaaagcagctgaacgtgccaagtgtggcgtggtttatggattgtcgaactcaaagctggatttggcttttgagggggaaatggttgcgcatatatatttgtggacgtgtggtggtgtgaccagtgatctttgatgtcataatgtgatatactctacttccagctgcacctgtgattttttttcaggacttcgttttgctctcaatccatatggattggatgagattgagttagtttaattttcaaacaagtaaaaatctttcat

SEQ ID NO: 43 - DNA, 499 bp, Zea mays
acgccgccactccccccaacccgaccacgctgcgcctccgcttgacccccagccgagggaggaatgggtaagggtacgggcagcttcggcaagcgccggaacaagacgcacacgctctgcatccgctgcggccgccgcagcttccacctccagaagagtacctgctcctcctgcggttaccccgccgcccgcatccgcaagtataactggagtgtgaaggccatcaggcgcaagacaaccggtaccggaaggatgaggtacatgcgccacgtgcctcgccgtttcaagagcaacttcagagaagggactgaggctgctcccaagaagagtgctgccgctgccaactaagtctggatgttgctatcaagaacctgataagctagaacattggaacattttgcttgagttgtacttctgaactatttagcccaaatactctggatgtactggtttatagtgctttgaattaaagtcagacgccctggtggtttgatgtttc

SEQ ID NO: 44 - DNA, 1170 bp, Zea mays
gtaacgcctttctccaagcctgagcactccatccactagcactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaggtgctggagaagtgggtgcgcgtggacttcaaggagcccgtgtggttcaaggccggcgcgcagatcttctcggagggcgggctggactacctgggcaaccccaacctggtgcacgcgcagagcatcctggccgtgctcggcttccaggtcatcctcatgggcctcgtcgagggcttccgcatcaacggcctcgacggcgtcggcgagggcaacaacctctaccccggcggccagtacttcgacccgctgggcctcgccgacgaccccgtcaccttcgccgagctcaaggtcaaggagatcaagaacggccgcctcgccatgttctccatgttcggcttcttcgtccaggccatcgtcaccggcaaggggcccctcgagaacctgctcgaccacctcgacgaccccgtcgccaacaacgcctgggtctacgccaccaagttcgcaccagggtcttaagctagctaccgggccgcggcgtgccaggacattgtgttgtacactactcgtttctgtcgtgatctgtaccatgaacgaatgcaaatattcttgtgctctcccagaaggaacgaactggactagttttgctcttccattccatgtatactctgcttcagcatatatgtagttgtgtctactggtttttgcagttgttaactgatttgcgtccatatatgaggttgtgtctactttttttttacaaacacaa

SEQ ID NO: 45 - DNA, 1057 bp, Zea mays
cggaagaaaaagaaaaaaaatagagagtaattaaaccccgtcggacccaaacctctgaaagccccaaaacctaaacctagcttttcgtcagtacaacgcctccgccgctccttccattagctcagacatggttctcggcctctacaccttcgccgacatcgacgccgacggagcaccccgcctcgaggttgccgatggcgaggagttcgtccgtgtcgatcgcgttgtcgagcttgccctcggtccccgggtgctgaaggcccctggaaccctttacctcaccaccaggagggtgatttgggtcagcgatggcggcgagggctacgctgtggacttcgttgccatctcgctccacgccgtgtcgcgtgatcccgaggcgtatccatacccctgcatctacacacagatcgagacggaagctatttctgacgaggagtctgatgtgtcagattctgaaacaaatggagaactcgagctctcaaaagttatggaaatgcgcatcataccttcagatcctggtcaattggatgaactctttgaagcattctgcaattgcgctgagcttaaccctgatcctagtgctgagagtgatgaagaacatggctgggttcatggtgatgagggttatgaagatacggtagatggaagcgacactgagttttcagatgtcaacccaattggtcaaactggtgagcaggatattaaccatgctgtaatcgagctccagatcaatgaccaacgttttgaggacgcggtagatgaggagagtcacaggaacgggaactagggaccatgtgaattggtcgtcgtcgatgcagcatacttgtctgtaaagacttcacttttctcatgttgtcagatcatgtggaccaacttgaatggcaacaatgggggataacgagctttattatatgagttgtgcctgtaccatacgtgcatgaccatctatggtcatatgactactgactagtattttagagggcgagggggtgcaaatcgatacccggccttgtgcaacacattttccttagcaaaagaaaaaaaatgttgtttggcc

SEQ ID NO: 46 - DNA, 2313 bp, Zea mays
tttatatgagcgtgctttggacaagaaggacctcgcgggtgcattatagcaaactctagtatatattgctgtttcggtaccctacccccctctctctctctcctctacctccttttcctctaacctttagctttcctccctccctctcctctctcccccctcctctaacaagaactactcccagccattcagatcctaagttgctgaccttgctgctgcttgttggagatagatttgttggttctaagttccaagtaccatgagtccaccgagtgtgatggggcagtttggggacacaacctacaccaaggtttttgttgggggactcgcgtgggaaacccagaaggagacgatgaggaagtacttcgagcagtttggggagatcctggaggctgttgtcatcactgacaagaacactggcagatccaagggctacggatttgttaccttccgggatccggacgcggcgatgagagcttgcgttgatcccgcaccggtgattgatgggaggagggctaactgtaatcttgcttcccttggggttcaaagatctaggcctcctactccccagcatggaggagctagaaactttagagtaatgaaatccttcaaccagcaggcaggaatccaaggtggactcggcgcagcttttccttctcatgccaccttccctcattatgccatcccacaaggccttcccttccatgtctatgggtactctccatataccccagactatggttatccaacaaacttctacaatatatatggaggagctcagtacccgttttatggaggagcaacagctggcatggtgacaggaacaagtcccttttatccatatttccaatttgggcagtcaggaaacactactaccaactatacaagtggacaaggctacaacttgcaacaatacccacaaatgttccacttctcaactgtatcttctacagctgcagctgtgaccggctttgctcagcaatatggaggaccattgtcactagcagcaagccctcaagcccaagcaggcatgactatggcactcacagctccaaccctgccaactccaacacaggctgctcatccttaccggttgattccctcgcactttgcagtttctgctgctccagagcaacccttggcctaaccatggtctcccttctcaccgttgttgtactgtctcgtttccgacgtgtttgagtccatgcatccatctctaacaccaaaaggcactattgtagatcacgcttatcagtcaaagtgctcacctccatatcccacatggtcatgtggtgaatggatattagctttagccccaggatgggcataaagcttcatgccccaaggatggggtgttctaacagacaagtacaaaccccaaccattctaacaatagtccaaggaaggactttatctgggagagttaatttcagccgtaccaagacaatgctgtagctaaaagaaactaacagtcaagcatgacccagggatggttcatgctgatactagtcaaattggacaacaatgacagctaaataactgactagcatgccactcccacatgtcattagtagaatcccaactgtacctagcttaggcatggcatctcttgttgaagcatgaaccatttagcaaaacctacccttctatagtcccgatgttacctagaccaaatgcatttgatatatgaccagcgactacttgtgtaaccaactcatcttttctttgcaaatgcttagatgcatcaactaacattttatttgatctttcagtcgatagcttgcatctaggtggtcaaggctctaaggagagcctgtgcccctaatcagacacaggttcagagtagtgctaatgtttgtttttagcacttggcactacctcctgtcactccaaacacagtattgggactccaaagaaggctttggagtaaccaagcactgctgtgtaactcattaacacaatggacccacagataaatttttattgtcttgggccaccccactcatgtagatgtcattacttctcagtgtcactaccatggttaggtccaggcccccctccccaaccgcgtcccccacctctctcactgcacatcgcagagaccttagtgctctttaatctactattaccaggcatggtggttgtaataataaagtagcgctgtgctactcgtaggacatgaagaactatttgttattcaacccttcatatgtacttaatatcttgtctatttcagttcagtagtcggtacttatttccatccattgtaatgcaccatataatgttgtgtaatatatgtccactgtgctgcac

SEQ ID NO: 47 - DNA, 804 bp, Zea mays
agtcgaacgaacctacctgcaggctgtggcctccctcaatgtctccatcgagctagggttttgaggcggcggcggcggcttgtcccatttaaagctggactgctccatcagactcgcctcctcggccgctatctgtttgttgtgttagggtttcgtctcgtgtataaggcgttcggagctcgcaaatcctttcctctctcgcgttcgaggctaggtagccgtcaccatgagccgctcggggcagcctccggatctcaagaagtacatggacaagaagcttcagattaagatgaatgcaaaccgtgttgttatcggcacacttcgtgggttcgaccagttcatgaatctggtggtggacaacactgtggaggtcaatggaaatgacaaaacagatattggaatggtggttatcaggggaaacagtgttgtaatgatcgaggcactggagccagttgcgaggtcacagtgaatcattgttctttagcactagcagcgtgaaaactgatgtaaaagatatcagtggaccctgttgtatttgactaatgcttttgcacagcaacataacttcggaggtggaatgtctatccctttttctatgggatgcttgtagctatacaatcatcgagctcttaaattacatgatctaacgcatgctcatcgagctcttaaattacatgatctaacgcatgctcctggttcaacggtgactacatttactgtcttacggtgctaacactggcaatgagtcatgtcttttaatgttgtacagtgcccgttgccttgtgacttgtgaggcacatttga

SEQ ID NO: 48 - DNA, 1230 bp, Zea mays
cccataatcccatcccatttaactgccgccagctcgccgcatgtccttttggatcccatcaaccgtgcgacgccgaccgtgcccaggtttgcctggctataagaccggaggtggatccggactcgcctgcaggggtcgcgtcgcgtgggggaaacgccgccgaaaaccactgggtgcccgctctcgctcggcacgtcccgcgcgcgcccacgcccacgcccacgcccacgactggtcacaagcgctagccagcgttcttcacgcgcctcgcgcctgcctgcagccgcaggggaatcgatcgtggcaagggcttgcagtcgcagctactggtagcagagcgatggcggccgcggcgagggtgtcggaggtgaaggccgagggcctcctgcggggcgcgtgcgcggcgctggccgcggcggccgcgctgctggtggggctcagcacgcagacggagacggtgctgctcgtcaggaagaaggccaccgtcaaggacgtccaggccctctgggtgctggccatggcggccgcggcagcggcgggctaccacctgctgcagctgctcaagtgcctctacctcggccgcgtcggcggcgcgcgcccctgccgccggagcagcagggctctggcctggacatgcctcctgctcgacaaggcgtgcgcgtacacgacgttcgcgacgacggtggcggcggcgcaggcgtgcgtggtcgcgctggacggcgcgcacgcggtgcagtggaccaagctctgcaacatctacacgcgcttctgcgagcaggtcgccggcagcctcgtgctcgggatgctggccgccgtcggcaccgccgtcctctcggccgcctccgcgcgcaacgtcttccgccactactcgtcgttggagacctacgccgcgcactaggctcgcggcccaaggcgtcgtcagctgggccgggtgcgccactcctctaaaacactgggccgtaacgaatttcaggcccagatgaagggtgacctgggctattaaagctggagctagtagagttctactccagagtgtactcctgcctacagtcctactgctctctccctccctctcgaagaggtgtgtacttttatttttcttttgcttctgttgcatttgatacattagtgaagacatgagtatgtacgttcgtcagtgtattttcttagatctttcctgtagactacattgcagctaaggaataaaaaaaccagcaattgctgcgcact

SEQ ID NO: 49 - DNA, 1573 bp, Zea mays
ctcatattcgcctccgcctccctccgtccctcgtcaaatccacgcgaccgcgattgctctcagaaggcactagcacgcaaaaaccccacgagagagacgaatcttccgaatctctcggtggcgatggcgctctccgaccgctcccgcgagtcgctcctcccgagcttcctctacgcctcctcggcgcgctctttcgctgccacaggagccgccgcgcgcctccctgtctcctccccagcgcctgccacggctggagcaggaggcggcgtgccgttctcgatccaggcgcccaaggagaagatcgagatgtactcgccggccttctatgccgcctgcactgccggaggaatcgccagctgcgggctcacccacatggccgtcacgcctctcgacctcgtcaagtgcaatatgcagattgacccagcgaaatacaagagtatctcatctggatttggtatcctgttaaaggagcaaggggccaggggtttcttcaggggatgggtgcctactttgcttggttacagtgctcagggggcttgcaagtttggcttctatgagttctttaagaagtattactcggacattgcagggcctgagtatgcccaaaagtacaagactctaatctacctcgcaggatctgcatctgctgaggtaattgctgatgtggctctctgcccttttgaagctgtgaaggtacgtgtgcagacacaacctggatttgctcgtggattgagtgatgggctccccaaatttgtccgatctgagggtgttcttgggctctacaagggaattgttcctctctggggtcgtcagattccttataccatgatgaagtttgcttcctttgagaccatcgttgagcttatctacaagcatgctgtgcctgttccgaagtctgagtgcagcaagactacccagttgggtattagctttgctggtggttacattgccggtgtcttctgtgctattgtttctcacccggctgacaaccttgtgtctttcctgaacaatgccaagggagctacagtgggagatgctgttaagaagcttggtctctggggtctcttcactagaggacttcctcttcgtatcgtcatgattggtacccttactggtgctcagtggggaatttacgatgcattcaaagtgatggttggactcccaacaacgggaggtgttacacctgccccagcagcagaggctgaattgaaagccagtgcttgattttttttttctgtgttccctgagatcatatttggtggagtggaattgtatcagccggtcgagagcttagttcccgaatcttttttaatcttaacggaaaatttgtccgtcatccttctgatgagaggaactcattaaacaggcgaaataggtcttttttgcgctgggaaaagtttacgcttgatgcataataatttgtaggacggcaacgctctagagcgcaggttttgttcacctcctgtaccgaggaatgcttaaagttacatttcacattatggtctttatgaaagagtgcacctcggttgatgttccttttgccgttgctggaactatgcgatttgctgtaatt

SEQ ID NO: 50 - DNA, 3537 bp, Zea mays
aattagcaagagaaacacaaggtcgaggtggtgaggtatggagctcgccttgggggccatgaccagcttggcccttaagctaggcgacctgctcatggaggagtatgtcgtgcagaagggcctcaagcccgacatcgagtctctctccagggagcttgtgatgatgaacgccgctctcatcgacgcgtcccgggttccacctgaccagctcaccgaggtggaaaagctttgggcacgcaaggtccgggacctgtcgtatgacatggaggacgccgtcgacgatttcatcctgcgtgtggctggtggtgacgactctgccgccgactcaaaattcttcaagaagacccttgccatggtcaaggacgtgatgtcgatgaagaagttcaaggatcggcgccagatctccgacaaggtcaaagacatcaagaaactctccaacgagttagctgaacttcgtgccaagtacacggtaaggggtgtgggcgctgatctcgccgcgagcaccggcatcgaccctcgtgtcatcaatctgtacaagaaagagacagatctcgttggcatcaagaagtcaaggaacaaagtcattaggatgctgtctatggagaccaaagatgatgatgcacttgagtcccatcaggctctaaagatagtgtctatagtcggggttggaggactaggtaagactactctagccaaaacagtgcatgacatgcttaagaagcaattcgactgttctgcttttatttctattggtagaactcctaatctgaataggacattcgagaagatgctattgaaacttgatcgtgagtataaacaagttgacatggccagatgggatctagaacaatttaaaaacgaactggatgaattcttgaaggacaagaggtacttgatcgttgttgatgacatatgggatgttgactcatgggaagcaatcagatatgccttgaaggacaataattgtggaagtagaataatcatgactactcgtaattttgggattgtcacgaaattagaagaggtttatagattaaaacctctttctaatgcaaactccaagaaattgttctacaaaagaatagagagtcaggaaggagaaagccttgatggtgaactctctagtaaaatcatacataaatgtggcggcataccattggctatcattgcaatagctagtttgttggttgaaagatcacgtgaggagtggtcagaagtgtacgacaagattggtcttgggaatgaagacaatacaacaaagataatgtcatacagctactatgatctgcctccttatctcaagccatgtctgctgcaactaagcatatatccagaagactgtatcattgatacaaactctaccatatggaagtggataggtgaaggtctagttcatcttgagaaagaagagggtagcctatttaaggttggagaaagatacttcaaggagcttgtgaatagaagcatgatccagccgacagaggacaaaaatgatcggtttgtagaagggttccgtattcacgacattgtgtttgatctcatctgtaagttgtccaaggatgaagacttcattaccattagcgggcaacattcatctcgggatagtttaagaagagagaagaaaacatgtgtgcctcgctcagactgcaagctacgtcggctggccgtccgaaatcaacgtgtgcagcgcttccctgaagaaaccatcgacatgccagaggtgttgagatcacttagcattatagattgtaatattgaggttatggccccaattgatagcttcagggtttgccgtgtgctgcatctggggaagagctacgtacccatcagcctaaagcatctggggaagctgttgcatctcaagttcctagagatagtatacacgcctattgatgagctccctaaggaaattgggcatctgaggtctcttcagacactgatattagaccgtactggactagacgagctgccaccggttgtttgctcgcttacacggttgatgtgcctgatagcccaggggttcgaaaggttgccagctgacaggatggggaacctaacgtccctggaggagctacgactacgtagggtagttggccggagtgccacccaagccctagtggcagagcttggcaagctgacgaggttgagggtggtcgacatcaccttttcagagcagctagaggagagcttgcaagaagcattggtgcaatctctgtccaatctgcggggactccaggaactaacgcttttgtttaaaatgacacggtggggaagcgatatgtggggagactgggagccaccaaggcagctccggcgcctgattattgaaggcatcatcgtcttctcacgacagcctcgatggatcaaccgctcctgtctgccacgcctctgctacttatctctgatggtgcacactcttgaagcacaggacctagataatctagcgaggttgccagagctccagtacctcacgctagatggtctcagctggcctccaaggtatactgttggcccagacgacttcaggaatctgaggttctgcaaagtgggcacaacgttcgagtttcgtaagggcgccatgccaaggctcgaagtgctgcaatttagagtttttgcagggtactattgttgggcatacaatggtgtgccgttcgagcagttcccaacgaaggatcttgacttggacctggataacgtccttttacttcagcaagtaatagtcaaagtcaactgcgtaggtgctactgtcacacaagtggaggaggtggaggccgtggtcatgcgtgccgtggaaaatcatgccaaccgtccaaccataaaaatgaatcgagcatatgaaatagctatcctatccgacgaagggcgggaggctctgcttcggcgacacattgaaaaggattgctgcgtgcgcacgatgaaggataaatctgatgctttcttcatcagccagctgcggaggtatcgacatcttcagaaagccattattttcatcgactgttcgggtgccagcatgtgtgaggtgcagaaagtggaagcagcttttagacatgcagccgaggttcatcctaaccatccaagtattgaacttatcagaacaaacaccgacggaatggcctcctcctcatctgaccatcccaacacagagcccaggaattgatggctcggtttgtcagatccttccaacccaggagcaggtaaatgtgagttgcttaagtaccaaagagagaggtcctgttcagcaagatgattagaagcattggcaattggcatggcttgttaattagattcgtggttcttagtctaaaatcacattgaagagggagacggacccaagtgatgcagttcatgtgttatctgtatcagtctctgtttttataagctgtcatatattttctcgaaactatcttgtgttgattttgtgtgaagtgtacttttaatggcacgggccattgtgtatttgcttgaaagataaggatggtattatctttgtatttgaactctaaatgcttaaatgaagtgatcattctggatggagat

SEQ ID NO: 51 - DNA, 1138 bp, Zea mays
atccgctgtctgactctgagaccgagagcctccagaaacccacgcgacgcgaccgaccaccatggccgcctccgcgctcctcctctcgccgcggctcgtgtctttcccgcctcacccgagcctcgccccactcttcaccaagagaccaccgccctaccccctcggcggcgccggcgcgaggctccgggccgtcggggacgggcccggcgcggggctgccacccgagcaggccacggtctacgacggcgcctacggtccctggaccctggaggactccgacgtgcgcgaggtcctgctgtaccggtcggggctggtgacggctgcggcgtccttcgtggcggcgtcctccgcggcgttcctgccggaagggaaccccgccgcctccgccgtcaccggcgccgccgacctcctgtacgccgccggcgccgcggggctggggctgtcgctggtcctcatccacatctacgtcaccccgataaagcgcttcctccaggcgctgtgggcggccggggcgctcggctccgtcgggacctacctcgtcgccgcccgcccgctggatgagggcctcgtgcagtacgtgctggaccaccccgccgcgctgtggttcgtcggccccacgttcgccgcgctcactggcctcgtcttcaaggaaggtctctgctatgggaaactggaagctggcatcttgacgtttcttatccctgggcttcttcttgggcatttgtctggtttaatggataacagcacaaaggcaggtcttttaggactgtggatgcttcttttcacaatcttcgccgctagaaaattccagcagcccatcaaggatgacgtcggagacaaatctgttttcatgttcaacgctctccctgaagaggaaaagaaggcttggatccagaaactcgagaggcaaaaggggcaagagttgtttgagtagaaaagagtagcttgtcttggtgcagccaatagttcgtccgtgaatgtttgtagctcatgtatatgattatggctccagaaatttgacaaatacacccaaagacatgaagacgagaacacgttccaatagagatgtaattacaaatctgttagatcacaggtaagatgtaactaaataaagcagttttgttgttatagtcgttga

SEQ ID NO: 52 - DNA, 2071 bp, Zea mays
gaggcgcggcaggaaggaaagcagcgctgcggagcagagtgtgtcgcttcgctgtaaaaacaggggagagggagacgcgcccgctgccagtgcctgccgcacacgcgtttagcgtttaagttccactcctcgccgccccagatctccgccctcctcaccactgcccctcattccccggcgcccagcacccggcggccgcaaccgccgcagtccggagcaagatcggcgggtagacggacggacggacgggcgacaggcgggcgggcgcggctctgtctgtatctatctgttggtgggagaccggttgtgtcggttaggcggcggcgggtgggaaggaagaatggcggcgggcggcagatccatcgcgtgctttgccgccgtgctgctcgcggccgcgctgctcctctccgcaccgaccaccacagaggcctacgattcgctggatccaaacggcaacatcactataaaatgggatatcatgcagtggactcctgacggatatgtcgctgttgtcacaatgttcaattatcaacaatttcggcacatcggggcacctggatggcagcttgggtggacatgggcaaaaaaggaggttatatggtcaatggttggggctcagaccactgaacagggtgactgctcaaagttcaagggcaacaccccccattgctgcaagaaagatccaacaattgttgatttacttccaggcactccatacaacatgcaaattgccaattgctgcaaggcaggagttataaatacctttaaccaggacccagcaaatgctgcttcctccttccagatcagtgttggtcttgctggaactaccaataaaactgttaaggtgccgaagaatttcactcttaagactccaggccctgggtacacatgtgggcgtgctattgttggcaggccaacgaagtttttctctgcagatgggcgcagggtaacccaagctctaatgacatggaatgtgacctgcacatattcccaatttcttgctcagaagactccatcctgctgtgtatctctctcatcattttataatgacacaattgtgaactgcccgacatgctcatgtggctgccagaacccaagtgggtcaaactgtgtgaacgaggattcacctaatctacaagccgcaattgatggtcctggtaaatggactggccagcctcttgtacaatgcacttctcacatgtgcccaataagaatccactggcatgtgaagctcaactacaaggaatactggagagtgaaaatcactatcacgaacttcaacttccgcatgaattacacacagtggaacttagttgctcagcatccaaactttgataatatcactcagttgttcagcttcaactacaaaccacttactccatatgggggtggcataaatgatacggcaatgttctggggtgtaaagttctacaatgatttgctgatgcaagccggcaaacttgggaatgtgcaatcagaactgcttctccgcaaggactcacggactttcacattcgaaaagggatgggccttcccacgccgagtgtacttcaatggtgataattgtgtcatgccatctcctgaaaattatccatggctgccgaatgcaagccctctaacaaaacaagcattgacactcccactcttgatattctgggttgccttggctgttctgttggcttatgcatgatgagtgggatcaagatgtttagcaagcttcaagttgatgtcggattccatgaggtgcactgcaacgggatatttattcattcaattccatagcggcacaggagagatgaggcgaagccaagaaaaagtggatgtgtgtgtgtgtgtgtttgtaagttaaagggccaaaatgtatttcttgtctggtagtatatagcagctctacaacactttggtgaacttagttactgcaaattaggcaattacagttgcaccttttgtattttatagcaaacccagacttctattggattctatgactgcccctcttgtagtaaacgcaaggcttcactggtactcctgtttaaagattggtcaaatagaagagacgacggtgattgtc

SEQ ID NO: 53 - DNA, 727 bp, Zea mays
acggcacacgcacaccgcgacccagtccagagccagtacgtgcgaagcagcacgcacgctgctggtccgcgtacgcgagacgacggtcaggtcggccggtgcttttcagtttggaataatgacggcgacgacgacgacagccgccggcggcggcaaggtgcagccgcgcggcctgcccgcggcgctgtccctgctgctgctcctggtgttggcagcggggctgggcggtggcgccgaggcgcagcagacgtgcgcggggcagctgcgcgggctggccccctgcttgcgctacagcgtgccacccttgccggggcaggttccgccggcgcccgggccggagtgctgctccgcgctgggggccgtgtccagggactgcgcctgcggaacgttcagcatcatcaacagcctgccggccaagtgcggcctcccgccagtcagctgccagtaatgagctgatgatagccagtgcgatgcactgggcaaaaggcaagggatccaaacacgctgaataataaaaggccaccggcgtcgagtcgactcggtgtcctcattccgtcattcgtagtgaatgctaaagcaaactcttgagggtcgcgtgcccttttgcgatcttgtacgcacacgaccggcctgtggctgtgcaatgtgcaacatcgctttgattcaaagaaccaacaataatacagaacccactctgcacagcagggctcactgaaacgaatcatca

SEQ ID NO: 54 - DNA, 868 bp, Zea mays
gcatgggtcgaccagtcaggcggcagcgacgtgcctccccactcccctccctcgcttatccgcgacccacttttgtgaggtcgcaattcatcctggtcgccaccagtaccacctctccatccttaatccttcactagcttagctagccagccacctccgttcactccatctcttgccggccagtgctccgtcgatcgacccgtagccaaccaccgacaactagctagcaacaatggctgccgtcgtcaacgcgcgagccgcaactgctcgttgctcggccgccggcgggccaccacgcggtgctgcgtcttcgtttccgccgtcgacgataaggacgaggaagaggacgacggcggcggcgggcggccgcggccggcttgtcgcggtctcggcggtgggcgacgtcgcggcggagggcaacacgtacctcatcgccggcgcggtggccgtcgccctcgtcggcacggccttccccatactcttctcgcgcaaggacacgtgcccggagtgcgacggcgccgggttcatccggaaggcgggcgcaacgctgcgggcgaacgcggcgaggaaggacgaggcccagatcgtctgccccaactgcaacggcctcggcaagctcggacagatcgacaagtagctaaacaatcccatccaccatgcatgctacgtactaagctcatatacatgtgctgatgtgcatgcatggaccaaccaaactgctcctttgtataagctgctctaaattaaatctcctctccgacagtgtctgaatgtatatgctgagtgagtgttaatttggtctgtaatataacctgttgctttgtcagaaacgatgttgcaataacattgttgtcggtggtgttgttgt

SEQ ID NO: 55 - DNA, 2008 bp, Zea mays
gacccggacgaccggaggcagatacgtgtgcgaccctggacgcgcgagaagatccatccctccacacggatctcctcctgtccaccaggctacttaactgatgagacggcacggccaaaagattctcgtggacgtctccggcgcccaattgtatagtagcccgcgcgctctagcgagaagctagcgcgccatcgccgccggcgtcgtgtcatggaaatggtagagtgctccctcgttgctacacttgctccgcgcccgctgcccggacaggttcggaaggccttgccccggccggcggcttttggggcgagagcgagactccgggtgcggtccgtgggccgagaggagcctctgcatccgcagcagacggcagtccgggcttccggaccggatcacggaggccgggcgctggggcaggctgcggtggggttcgccgccgctgccgttgtgtcactaaccgggttctccggggatgtgtccccgctgccgacgccgcctgcccgggccgagtcgctcaccgtcgcgttccccgtctccaaggcgcgcgaagtgaacagagtgcagaggacgctggtggagacgtgggggctgatccgtgagacctttgttgatcccaccttcaaccaccaagattgggatcagaaactacagcaaaccatggtagagatatttccactgaaatcagcggatgctgcctacagtaagattagtgggatgctgtccacactcggcgacccatttacaaggatcatcagccccaaggagtaccagagttttaggataggaagtgatgggaatgtgcaaggggtcggggtgtttataaacaaggagccaagctctggacgattgcttgttatggactgcattcagggaggcccagcagatcgagcaggcatacatgaaggcgatgagctagtcgagatagacggcaaaagtgtttctggtttggatggagaggctgcagctcagaggcttagaggccgtgtaggaacaacagtgaaagtgaagttgttagatggaactgacgatgaaaggggtgggggtttaagacaaaaggaggtccagctgtctcgtgaaattatcaacctttcacctctgtcaactgcaattatctctcatagaacagacgatggccatgagtgcaagactggctatgttagattagcttccttttatcagactgcagcagctgaaatggaaaatgccgtaaaaaggatggaggatatcggtgtccagtcttatattctagatctgcggaataacccaggaggtttagtaaaagctggtcttgatgtggctcaaatttggttggatggagatgaaacccttgtcaacactattgatcgtgaagggaatgtgctaccaataaatatgatccaagggcattcattaacgcatgatccccttgttgtgcttgtcaatgaaggaagcgcaagtgcaagtgaaatcttggcaggggcattacatgacaatggacgagctattctggttggccatagaacctttggtaaaggaaaaattcagagtgtgactgagctggacgacggatctgctctgtttatcacagttgcaaagtatctatctccagcgctgcatgaaatcgatcaagtaggaatccaacctgacatacaatgcagccctgacatcctttctttgccaagagcgccttcgctaagagaaaacagcaacgccacaaatttggagatggattcgtgtatcatggtagcagaacaagcgttggaaattcagcaaagcaagggttccgcttcttagatgcactatgggctctgtacattatttgcattctacagtagattggatagcttaccttagagacttataaagttctgtagcggtatatagagagaggctgatcctcacatgtttcattttaggcattatctattcggtgattcatgggaatgtatataagttgaccttgtcatatatctgtgtcgggttcattcttgactatccatactcagaaatataacgtgcaatttttttg

SEQ ID NO: 56 - DNA, 2941 bp, Zea mays
ttttttttcctttcgcaactttcacctgtgaataacgttcttgcataatcgcacgggcgaagccttcagaagcacacgttggttgtgtggctcactggcaccgcgccactcagctcagcaacgatgcaaccacctgacaatggcatctctttgcgcgccctcggcgctcctcgaccacccccatcgccgtcggagacgagacgagcacctatacctagccgtataaaggcggcagggcttagacaagctagtgcaggcttcccgggcccctagattctctctcgcgcttccgctttcccttctcctggtcctggccatggcccacgaacgggagccgctcctgcagcaacgacagaccggcgtcggcaatgcctgcggtgccaaggactcgtcctcggcgccggcgccgtcggctgccgcgctgccgtcgctggctaggaccgtgctcaagttcctgatgtgggcggtgttcctcacctgggccgcggggatcttcctctacccgaccaagcccgtgcaggccgtgttcaggaagtgggtcgggctcaccagggactccatgttcggcatcgccgggggtattttcctgaccttcagcgcgccaattctgatcattgcgcttctcgcatatgtgtacatctccttcttcccgagtgagcatgtggtggagaaaaggaagctgcgctcactgagtttcaggctctggactttccctgttcttgtagacggcccctttggagttgtctctgcagttgagttcatcggaattgtcttgtttatagtttttgttgtctactcaatgacctattatgccgtggaagctgtgagccttgtctcgaaatttgatatcccatcaatgactgagagtgaattgatactggatgtcattggcctccgtttaggggcggttgggttgttctgcatgctcttcctcttcctgccagtcgcccgaggctcggttctcttacggcttatcgatattccatttgagcatgctacaagataccacgtctggttggggcatctcacgatggctctatttacattgcatggcttgttctatgtgatctcatggtccatgcaagggcgcctccgtgaagaactgagacagtggaaggaaattggagtagcaaacctgcctggtgtgatcagcttggcagccggcctacttatgtgggtgacatcacttcacccagtgaggaagaggttcttcgagctcttcttctacacccaccagctctacgtcgtcttcgtcgtgttcttggcgtttcatgttggtgacttcatcttcagtatttgtgccggagctgtgttcctcttcatgctcgaccgctttttgaggttctggcaatcaagggccaaagtcgacatcatttcagccgcctgccgcccgtgtgggacggtggagctagtattctcaaaaccagcaagcctccactacaatgctttgagtttcatcttcattcaagtgcgcgagctatcgttcttgcagtggcacccgttcagtgtatcttcaagtcccatggatgggagataccacatgtcggttctcataaaagtactcggcacgtggactgaaaaactgaggagcatcatcaccgatgtacaggagaagaacgggggtgactctgagctgcaatgcgggcgcatgacagcctgcgtggaaggcccatatgggcatgaatcaccctaccacttgatgtacgagaatctcgtcttggtcgcaggaggcattggaatatcgccattcttggcgatcttgagcgacataatccacaggatcgaggagggcaagcaatgcatgcccaagaacgtgctggtcctttggtcagttaagaagtccaaggagctttctctgctgtccgccgttgatgcccagaccatcagctcatctgtctcggacaggttgcaactggatatccaggccttcgtgactcaagaaccccatcctcctttggaggatggcatcgtcggggacgaccagaaagtccctggcatgttcgtcaagaacggtacagccatgtctgggctggtcggcaccggggacaacttctgggcggccatgtacttcctggcgtccacgctcggcttcctcctggcgtacgccctggtgcaggtgtactacgtgaagccgcacaacgtggtggcgtggtggtacctgggcctcctgttcatgctgtgcatggttgccggcgtcgctctacccggcgggctcgtggtcctcctgtggcatctgtcggagaagcagaggttggaggacgacaagtgggacgcctctcagtcaccgcgcgccgagcagacaggccccttggctgcggcgggtggtggtgacgacgacgctgctcccagcgtcagcctcgccgccctgcggacgacccggtacggctgccggccgaacttcgaagcggagttcgcggcgttcgcggagcgcgccggggacgcggcggacgtgggcgtgctggtgtgcggaccgcaggggctgcagacgagcgtagcgagggagtgcagggcgcggaacctccgccgcggcggcttgggggcggccaagagcaggagcggcgcggtcttccatttcaacagccacagcttcgacctgtaaactacgtacgtctcgtttggtcggttcaacgatcatcagtacatgttgcacagcacacacgcacagacgatagttggatgtacatgttgatccgtcataatttgatatcgtgtatatatatgtatagctgatagttaatatagttaagttatataagagatgtataaatctgtatgcgtatactataggtgtagcatatgcatgcatgatagaagcacgaaggttaaatgctgacgaatcacgtgaaatcatgtcatgtttcgcgtctaatgcgtgaatttgtatttttcttatgcgtttgtgagtacgtcaaaactacgttgcaacgcaagatttatcttt

SEQ ID NO: 57 - DNA, 746 bp, Zea mays
acgtaaaaatttcattgctggctcagcttgcgccataccgcgtcgtgcggagttcttctctccttccgctcgaagagaagagaaaaaagaacggtccgtgctcggctgccgtgaatctctctcacctccccgaagcaagcgagcggggcagcgcgccaggaaggatcggaggagacgccatcaatcagcacttgcacgcgcgcggtcggccgcaggtggaggaagaagatgggcctgtgctcgtgctgctgccggtgcctggagctgctgtgctcggtcctcctcccgcccctcggcgtctgcctccgccacggctgctgctccatggagttctggatcagtgtgctgctcaccatcctcggctacctccccggcgtcctctacgccgtgtacgtcatctgctccgtcgacccccaccgccaccgcgacaacgacgactacgtctacgtagcatgacaagatggaccggtccccgtggtgctctggtccgtgtctctgctgctacctccgtcctctgtgctgtgtgcatctttttgtttggtttagtaaactaaatccatcctgtggccttctgtaaactgtaaattcgtatgtcgaatctgacaatctggacggattcattccataaactaagatctggtgttgcgggatctgtggagttaattagggttactttgctacctcgttcagttgtgcttgtgaaatgaaactgcagatggttattaaatcccctgcattttccctca

SEQ ID NO: 58 - DNA, 1941 bp, Zea mays
gtgtttggcccatccagcggtcgacttggacttctccgcgactgtgctgttctgtgcagccgtgcagggacgccaacgactccgagctctcctccatccaactctcatggcgggctaccgcgggggctcctccgtctccgcctccaccggcggcgggggcagcgcggtggccgcagccttctccacccggctgctgctactcctcacgctgctgccgctcgcgctcgccgccttcgccttcgcgctccagtggcgcggcggtatgcgggacccggcaggtgcagcctggcccgccgacgcgcagcgcttcccgggcatggagaacagccccctctcctcctcccacggaggagcaggctcctacttcgccgtctcctcctcctcctcctccccgggagccgactgcgccgagatccttggccggagcgccgcgtcctccaatggaatctcgctctaccgcgggtggagcttcgactccgaatctgctataacccccaagatctgtatcacgggaagcacatctgctagcctacaccagattcttccatggttgtattatcacaaggtcattggtgtttcccatttctttctttttgttgaaggagaggctgcaaagccagctgtcacctctgttcttgaatctattcggggtgtaaaaattatttacagaactaaagaactgaaagagaaacaggagaaaagccgcatttggaatgagacgtggctagcaggtttcttttacaagccgtgtaattacgaactatttgtcaagcaatcactaaacatggaaatggctattattatggcaagggatgctggaatggattggatcattcacctcgatactgatgagttgattcatccagctggtgcccgagagtactccctgaggcgattgcttttagatgttcctgacaatgttgacatggttatcttccccaattatgagagcagcattgaacgtgatgacattaaggatccttttactgaggtttccatgtttaagaaaaattatgaccatcttccaaaggatacatactttggcctgtacaaagaagcaacacgtggtaatccaaactacttccttacttatggtaatgggaaatcagctgcaagggttcaggagcatttgcgaccgaacggtgctcatagatggcataattacatgaaatccccaaatgaaatcaaattggaggaggctgctattctgcattacacctacacaaagttctcagacctaacctcaaggagggatagatgcggctgcaaaccaactaaagaagatgtgaagcgatgttttatcttggaatttgaccgtttggcctttataattgcatcaacagctactgaggaggagatgaggaactggtacaaggaacatgttgtatggaccgatagagacaccaatttgaaacttttaaggaagagtgtcttgacacgcatatatgcgcccatggctattatccgtggcctcaaggaatctggcgtctttaccaatgcagtaacatcagcgaaagcacagtcaaaaacgaagtcatcaaacatgggtctcggaaacaaggatcctatccagccaaacggaactgctggtcagtccacactggaaggcagtcatggaaagttgcaggcaaccgtgagaaagatcctggaaatggttgacacacaggaagaagcagcgatgccaccaatgtcgcccccgggttttcttgagctgactgaaagtgtcactgccttttcatgacgctttggtttaaccatgcgtgatgcatgcagccttgagcatacgaatagcattggcttgtttggtcgtcgtcgtatcttgcaaccccagaatgaccagatgtatcgtgctgatgtaaaattgctagttatcaccatgcaaagagctttaaatcaacttcagaaggtattataaagttggtgcaaattataacaaatcca

SEQ ID NO: 59 - DNA, 1282 bp, Zea mays
gcggaccttcagcttctccaccgcggctccgcctcttctttcacggctccaccacgcactaaccctaaagcttccccgcgttgccggcgatgagcagccttcgagccatctcctccctcctccatatctactccacgtccgccgccgccagacgaggagccgggcggctgggcttcgcgccgtcgcccggcgggagattccgggtaccgtcgaattccggtccgcccgcgttcgtgttggacgaggtcgcgagggcggccggcggggttcggaggagggcgtccacgcgcgcggcgagttgggactcggagaaatcgccgtacgagacgcttgagctgggtagggatgcagacgaggagaccataaagactgcctacagaagattggccaagttctatcaccctgatgtttatgatggtaagggaacccttgaggaaggggaaaccgctgaagcgcgtttcattaagatccaagcagcgtatgagctgttgattgatggtgaaaggagaagagcatatgatagagagcatcatgtgaatccgatgaaggcttctcaagcatggatggagtgggtaatgaagaagcggaaagcttttgaccaacgtggtgacatggctgtggctgcttgggctgagcaacagcaacgcgaaatgacgctacgggcacggcgtctctcacgctcaaaggttgaccctgaggaagaaaggaagctatttgccaaggaaaagaaggcatctatggaattctacagcacaactctgaagagacatacccttgtgttacggaagagggatattatgcgcaagaaggcagaggaggagaaggataaggagatcagtagactcctagcggcggaagggcttgagttggatacagatgaagatgaaaacaagacttttctggggtaacgcttttgatacttaccctaatttattctcttcctccattccagcaatcgttcaagatgcagcgacaacgagtgcacaaggcgaaacagttgggctcgtcggaaacgctgtaatctggagatgtgcgccaacaaatattggatcgaaataataatctcccggggcgaagtttagcattttaccggagagcagaaaggaaaggcaaatgaaggatgtgtgatggctgtagtagggttgcaatatgattcaatcaaaaaattagtaaatttcgctgtagtagggttgtaatatgattcaacaaaaaatgagtagatttcggtggcgggcctcgattttatcctgagtctcattaagctatggcacttgaaaattgc

SEQ ID NO: 60 - DNA, 973 bp, Zea mays
gctagcgattggatgtacgggcgtttgtgattggcgcacacgggataagataatcttatctgatggcgctcgtcgtggccacccattccatcttctgctgggtagcagctagcagtatacaagagcttgcttgctgtcctagtcctacctactgacgagctcgccatggcctccctctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaggtgccgagcggcgtcgacgccaccaagatctcgcaggaggagtacctcaacgcgccaggcgagacctactccgtcaccctcaccgtgccgggaacctacggcttctactgcgagccgcatcaaggagccggaatggtcggcaagatcaccgtcaactaattaagctagctatcgatcgatatccattcatgtattagctgttgcttcctgctttgtactccgccgatctgtccatctctacatgttttcgtcttcacacaacaacctctgctacgactacgtatatatgcatgctactagctgattgattttaacgaccaggccgaccccgaaagctagcttggaccaagttttgtacccattaattctaccgatgcatctctcagtttagactcccataatcatacaaactgctagctttcatctgcatctgcttagtacatctaactatttgtaccgcaaggtgacgtttttgcagaactcctaattatataccatg

SEQ ID NO: 61 - DNA, 653 bp, Zea mays
tagacagcggcgggcgccttgccataaaagcacagcgcttctacacccgccgccgccactcgttgcagcatatctacctctacctaccggagcagggagcacgccgcacgagccctttccgccgccgccaaaatggtgaacgttcctaagaccaagaagacctactgcaagaacaaggagtgcaagaagcacactctccacaaggttactcagtacaagaagggtaaggatagcctgtctgctcagggaaagcgccgttatgaccgcaagcagtcaggatatggtggccagaccaagcctgtcttccacaagaaggccaagaccaccaagaaaatcgtgttgaagctgcagtgccagagctgcaagcactactcacagcacgcaattaagaggtgcaagcattttgagattggtggagacaagaagggcaagggaacatctctcttctaagtttctcatcgcccatctcgatgttggatcgaagctgtgggtctactactgttctaaaaactcgtcaaatttcaatgttactagtagttctgaaagcaggtcatgctgtgtatcaaattccaatgcctgacatttgcgctgagtgtgggttgtcttttggctaaatgaagttttgcaccctgaatcttcattgaatgtgttgt

SEQ ID NO: 62 - DNA, 1665 bp, Zea mays
gtccaaaaccctagccctcgcgccgccgccgccgtgcccagcgctcgagctcctcgcctgccgcgagctcgcgccgcaacgccaccatgaagttcaacatcgcgaacccgtctaccgggtgccagaagaagctggaaatcgatgacgggttcgcgatgttgaacttcttggcggctgcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaccaagggccgcttccgtcttcacccaatcagggatgaggatgccaagttcaagctctgcaaggtgaggtccgttcagtttggccagaagggcatcccctacctgaacacctacgacggccgcaccatccgctaccccgacccgctcatcaaggccaacgacaccatcaagatcgatctggagaccaacaagatcatggacttcatcaagtttgacgtcggcaacgtggtcatggtgaccggcgggaggaacaccgggcgtgtaggtgtgatcaagaacagggagaagcacaagggcggcttcgataccatccacgtcgaggactccatgggccaccagttcgccacccgcatgggcaacgtgttcaccatcggcaagggcaacaagccgtgggtgagcctgcccaagggcaagggtatcaagctcagcatcatcgaggagcagaggaggcgcgactttgctgcccaggctgctgccaaggcataagttctctgaatgtgctgcttggagctttttgctatgtctagttttatttttatctgcaaggatatagagctaccttcccaagacttttatcatcatgttttgttgcttttggttcttgaacagcgtttgcagcttagctgtaatgctttaattcgactttctatatattgttgaaccgtgttgtcgacaccatgacagcttgttttgcttctatgtttttgcttgagctacggtggttgtttggaatcttgtatggtggtttgttgtaattctgtcaatcggatcaggaactggccacggcactggatgccactaaccacgtccgtggtggtaccagacgccaatgaccatgctcttgttttgtccgagttggggctggtgctgctcgtctgcgggcgtcctggagaaagccagcgcgtcgtccgcggcaggtgctgaatgactgactgaggagcccggagcgtgttcatgcaagtttgcactggatcttttttttcaatcacaatgtactgtggtagtcgaactcctccatccatttatatatcatatatgtatgtaccgtgcaattggtactggacaaacaaattaaaccatgcacagttccagct

SEQ ID NO: 63 - DNA, 765 bp, Oryza sativa
gttcaacctcccgacccgttgctgccctcttcattcgctcgctcccctcctcgccgcgccgccatctagggtttcgtcttctcctccgccgccgaccgccatggctcgccgcagctcagcaaggtctcgccctgcaccacgtgctgctcccgtgaggaaccctccgcagccagcaaggcaggctcctcctccagctcctgcccagaacggaggtggctctatcctgggaggaattggttccactattgctcaaggcatggcttttggtactggtagtgccatggcacatagggctgttgatgctgtaatgggtccccgtaccattcagcatgagactgttgtctccgaggctgctgcctctgccaccccaatggccaacgccactccatctgactcatgcagcatccattccaaggccttccaagactgcatcaacaactatggaagtgacatcagcaagtgccaattctacctggatatgctgaacgagtgccgccgtggtggtgcatctgcttaggctggtggccttttggaacttttattaattgggcctcgcgttactctcatgattatacatgaataacttggcaaattcatgaacttggtgccactgcttatggctgtactctgataatcgttggtacgcttgggtttgtggtatgctacttctgggagtaggtacattctactatcctaaaatgctagaactgcctacattgctctgggtgtcataaatattatggaattaaacccgttatttctcga

SEQ ID NO: 64 - DNA, 1779 bp, Oryza sativa
acgcccttcctccaactccccccaaagccgccaccaaaccttctcttctcctctcctctcgcgagtgtcgaactccgccaccgcgcgcgcgcgcgccggagacggcggccctcccatccgcggcgggcgccggcaatgcggatggggaagtacgagatggggcgggcgctgggagaggggcacttcggcaaggtgaagctggcgcgccacgccgacaccggcgccgccttcgccatcaagatcctcgaccgccaacgcatcctcgccatgaagatcgacgaacagataaagagggagatcgccacgttgaagctgctcaagcaccccaatgtcgtccgcctccacgaggtttcagctagcaaaaccaagatatacatggttcttgaatatgtaaatggaggagagctattcgacaaaattgcattaaagggtaagttgtcagagaaggaaggaagaaaactcttccagcagctgatggatgctgtaagctattgccatgagaagggagtttatcatagggaccttaagccggagaatgtcctagttgatgcaaaaggaaacataaaggtttcggattttggactaagtgcccttccacaaaatcaacggaaagatggattgttgcataccacatgtggcagccctaactacatcgcccctgaggtccttctcaacagaggttatgatggctctttgtccgacatatggtcttgtggggttatcctatatgtcatgcttacagggaatcttccatttgatgaccaaaatacggttgtcctttatcagaagattctgaagggggatgctcgtattcctaaatggctttccccaggtgcccaagatatactgcgaaaaatcttggatcctaacccaattacacgcttagatataactggaataagggcacatgagtggttcaggcaagattatactcctgctatgcctttcgatgatgatgacgacaacaatatcagtgatggcaacctacatatgactgagaatcaagatattgaaaccagcccagcaatcagccaaatcaatgcattccagctcattgggatgtcctcatgccttgatctatctggattttttgagaaagaagatgtttctgaaaggaaaatcagatttgtatcaaattattcccctacttctctatttgagaagattgagagcactgtcacagaaaagggtttccaggtacagaagaacagtggcaagctaaaagtgatccaagtttgtaaagaaccagcaaatccaagaggacatggaaatttattgatttctgctgaggtgtttgagatcaatgaatctctttatgttgttgagctaaaaaggtcatctggggattgttccctttacagacagctatgtgcgtcactttctgaagacttgggcatatgcaaaaggcaacagcttttgaagaaagattctatgagacaagacctttgtcgatataacagtagcttttgataaaagggtctctctagcttttagttgtgaaggctctagcatttttaacaagagcccccaatacaacgacgtatgacacagttttgtaaaattaaactgtaaatacaaaacaatccaattgtacaccgaaaagagtataccgatcatccaagtatttcctttaggagttcattagtttgtgttctttttgcctttactggtaaatcgctacctcctgggcaaattggctactgacagtgtataaaagtatgatgtagacaatctaagtgtacataaatagttacctcatcttgtgttcctttgaagtta

SEQ ID NO: 65 - DNA, 1018 bp, Sorghum bicolor
tttccccgggggaacgtgtggcgcctgcccaactttatccccgcgcgcgcgcgcgcgcctcagagccccagccgcccgctgccgccgccgccgtgcccccacgcccaacgccttccgcaccgcgcagcgacgtcaccacccgggtgacaccgaccagtccacagttcgctgcaacacccacgcaccgccatggcccctgctgccacgggcgtggggagcctcgccgccgctcccgtcgccaagggctacaccacctacagaaaggccgccgcacgctccgtcgtcaggctggggctgcccgcgctgccgccgctgcccggcctcagactcgcggcgcagggccaggcatccttctgtgagtgcaagcggctggcgaggaacgtggtggccatggccacgggggagcccaccgcggcgcctgtggctgacaacgaggagctcaccgagttcgtcaacgcgttgaaaaaggagtgggacaggatcgaggacaagtacgcggtgaccacgctcgccgtcgccgccacgctcgccatgtggagcgccggtggagtagtgtcggcaatcgataggcttcccttgattccaggtctgatggaggctgttggaatcggatacagtgggtggttcgcgtaccgaaacttgctattcaagtctgacagggatgctttctttgcaaaggtccgggaggtctacgaggatataatcagaagttaacagatggagcactaatgcaagctcatccaaatcaagttcactttaagagatccttctagtttgctgccgttcagttgcttttgctagctgtaatatatttcagtatagcatctagtttgatcctcactcaatgcatgtatggataaacattttttataaaatgcaatctatcgatgctctgttttttttttcgtattagtttttctgattatagtgttttgttgcttatagtcaaggtcattatttatttgaactatcattttgtgctttactttatgttgattgcatgatgtttgagcccttg

SEQ ID NO: 66 - DNA, 1173 bp, Sorghum bicolor
cctcccctcccatcgttaacacgtacgccgcggcctaacacacccgcgcgctagctagtgtcatccacactctagcttctagcagtccggaggccggcggcaaaagcaaagcaaagcaagcagcttggtagcgatggcgtccacctcctgcttcctccaccagtccaccgcccgcctcggcgcgtcgccgcgcgtcgcggccgcgccacgcagcgcccagctgttcgtctgcaaggcccagcagaagcagcagcaggacgccgccgccgtggatcagagcgacgtctctcgccgcgccgcgctcgcgctcttcgccggcgtcgccgccgtcggcgccaaggtcagccccgccgccgccgcctacggagaagcagccaacgtgttcggcaagcccaagacgaacacggagtacatcgcgtacaacggcgacgggttcaagctgctgatcccgtccaagtggaaccccagcaaggagcgggagttcccggggcaggtgctccgctacgaggacaacttcgacgccaacagcaacgtctccgtcatcatccagcccacctccaagaagaccatcaccgagtacggctcccccgaggagttcctctcccaggtcgacttcctcctcggcaagcaggccttcggcggcagcaccgactccgagggtggattcgagaccggcgcggtggccacggccaacgtgctggagagctccacgcccgtggtggacggcaagcagtactacagcgtctccgtgctgacaaggacggcggacggcgacgagggcggcaagcaccagctcatcacggccaccgtctccgacggcaagctctacatctgcaaggcgcaggccggcgacaagaggtggttcaagggcgccaggaagggcgtcgagaaggccgccgcctccttcagcgtcgcataataatgaaattgtgctgcatcggccgggattattatttctttgatggtttggcttcatcaggggatgcacaacgtagagagcatgcttgtgtatgtgttcctttgattgtacatgagaacaacaaagactaaggagagctccatttccatgcatgcaaggatccatcgattttcttcagtcatgcaagctgtttaagaaatcttaattagcactaataatatttttctagataagggaacgaacgaagttcagcc

SEQ ID NO: 67 - DNA, 1196 bp, Sorghum bicolor
cgccacacatatacacacctccttgcgcttgcccacaccacctcgctcagccggaagacccgcacacgcacgccacttgtacaccatggcgccccgggtggcggacaagtcgccgttgccgccggccaccggcctcggactgggcgttggcggagtagtcggaggcgtgggcatgggcccacactacagaggcgtgagaaagcggccgtggggacgtttcgccgctgagatccgcgaccctgccaagaaaagccgcgtgtggctaggcacgtacgacacggccgaggaggccgccaaggcctacgacgccgccgcccgcgagttccgaggcgccaaggccaagacgaacttcccgttcccgtctcagtgcgccgtcgccgccggcggtgctggcagcccctgcagcaacagcaccgttgactcgagcggcggcgccagcggctgtgccgtccaggcgcctatgcaggccatgccgctgcctccggccctcgatctcgatctcttccatcgggcggccgccgtgaacgcggtcaccgcaggcggcatgcggtttccgttcaagggctaccccgtcgcgcgtccaaccccgcaccagtacttcttctacgaacaggccgccgcagccgctgccgcggcggccggctaccggatgcttaaggtggccccaccgccggtcaccgtggccgccgtcgcgcagagtgattcggactcctcgtctgtggttgatcacaccccttcgcctcccgcggtgacggcaaagaaggaggtgggcttcgagctggatctgaactggccgccgccggcagagaactaggcacaccggagtttttagctgacgaattagtagttacttttttttcctttttgccttcatcaggaatgttacttctggttgtttggtcctgtattcttgttctgtagactatgagattgggagccttgtaaatagttttttttttccgcgaagacggaaatgatctgagatctgttcgtctgtctggacggatcaagccggcgttggtacgggcttagaccatggagtattgattatattagtagtataattcctaagtttactgagaatataattgatgaggacaaaaaatgacccaaagaaatctgtatggaaaagcttcagacgtttcctttcgatctttccattcaagaaaagctgtctagcttggttgggaaacgca

SEQ ID NO: 68 - DNA, 1165 bp, Sorghum bicolor
caaaaaaccatttcctaattcccccacttcgcccgccattttcctctttataatcctcctcccaccatcaccaccacattagtgttcttgaaagagagagagagagagagagagacaggagtggagagcagagatgagagagagattgagcatgtaacaggctcgcttctcccatctctgtctctctctctctatctcctctactcaagagtcacacaagcaagagaccgagcgagaggatgatgtggtcgcatgagccggcggcggagcagaaggcggcggcggcggcggcgacacggcagcggagctccgtggccaagctgacgacggcctcgtcctcgtccttggcgaacctcctctcggtcttcgtcggggcgaataacagcaactcctcggcggacccgacgccgccgccgaggcggagcttcgacgagggcggcggcgtcgggctgggcatcgtcgcggccatgagccacgcctgcctgaccggggctggggccggggtcggggccgagccgatcgccatcggcgccgcggctaggcggcggcgcgcgcgcgaggaggacgagagctacacgtgcgtcatcacgcacgtggccggcgctggcggcggcagcgttcggaagagggtctactttgggttcggcgacggcggtggctggctcgtggaagccgacgacgaggcgccggcgccggcgcccgatttcttgagccggtgctgcctctgtgacaagaggcttgatgggctcgatatctacatgtacagaggggagaaagccttctgcagctcagagtgccgatgccagcagatgctaatggacgaccgcgctgacaagtgtggatcggaagccctcatcaggtcaggcggcgactactcgtactcggtgtcgccgcactccaccccgatggccttctcgccaagcgtcgcagcagcctagtgtagtgcaaagactactcgatcgccctcaagctgccccactatgagcaaggagtgtctagctagaagagaagagactgaagtctaaacgggcgcggccgtttaaacaaatatgggtcatatacagagtaatttataaaatgagctgattttcttaattatgacatgaataaaagcgagcaagacagttttgagactatgctttaattaacagcaagatgttaaaca

SEQ ID NO: 69 - DNA, 1706 bp, Sorghum bicolor
aacacactggtgtggtgagtggtgagtggcccgcctgtcgagtctcctctcctcttccgtcctccaccacccaccaatcatcatcaccaccaaagctgagctgagctgagctctcctgagtccctcactactagctaagctaagctaagctaagctagtagctcgaatggagaggatgctggcaaggctgatgcggcggcggagctcctcccccctgtccgacctcctccaccatggaggagcagcagcggcgggctcgctgcaggccgccgccggcgccactgcggcctccccctggctcttctcccaccaccagcagcagcagcagcagcacacggcggccgccgcgctgccgggtctcaagatcagggactccgcgtcccagctgattgggaggacaccgatggtgtacctgaacaaggtgacggagggatgcggcgcccggatcgctgccaagctcgagttcctgcagccttccttcagcgtcaaagacagaccagcaatttcaatgttggaagatgctgaaaagaggggactgatcactccaggaaagaccacactgatcgagcccacgtctgggaacatgggcattggcttggcgttcatggctgccctaaaagggtacgaactcattcttacgatgccgtcatacaccagtcttgagaggagggtgaccatgagggcctttggtgcaaacctggttcttaccgacccaacgaaagggatgggtggaacagtgagaaaagcagcagagctttatgagaaacatcctagtgcatacatgcttcaacagtttcagaatcctgctaatgtcaaggtacattatgagacaacgggtccagaaatatgggaggacacacttggacaggttgacatttttgtcatgggcatcgggagtggcggtactgtcacgggagtcggcaagtacctcaaggagaagaaccctaatgcaaagatatatggagttgaacctgctgaagcaaatgttctgaatggtggaaagccaggacctcacctcatcactggaaatggagtagggtttaagccagacattttggatatggatgtaatggaaaaggttcttgaggtgaaaggtgaggatgctgttaagatggctcgagaattggcactcaaggagggtcttttggttgggatatcatcaggagcgaacactgttgctgctcttgaactagcaaagaagccggaaaacaaaggaaaactcattgtgactgttcttccaagccttggggagcgatacttgtcatctgcgctgtttgatgagttgagaaaggaggctgaagcaatggaaccagtgccggtggattaatttggccaatcaaaccgggcactggaatctggatctttggtgcacaataaacttgccggcagatgtgttacaactgccaattgtacttccattcccctcatccaatttctatcatctcatttatgaaccttgtgaaaaaaaaaataatgtaaaattttgaagaagagcaactttagcctctagacatttgtgaaggtcatttcttggcttgtgggttacaaggcttagttcaaaccagcataacatgtgttgatgcaagtttgcaccaagtaaggcaatacaaaacgtgaatactctcgtaaaggatttcgacagtgcattatacattttgaatagagttgaatatgctgcaactggtaagctcctcaccaaccagtcc

SEQ ID NO: 70 - DNA, 2282 bp, Sorghum bicolor
atgagtcatcacacaagaacctctgcctccgtgtcttgctcagcctccgcctccgtctccgcctcggcgttcaacgtgcaaccaccactcagcgagctggaccggtgaggaggccgtctccgcggacgcaacagccaggcctgcccccggcgaccaccgcgagccggcggcatggacaagctcggcacgaacccggccaactcctgcccgctcacgccgctgggcttcctggagcgcaccgccaccgtgttcggcgactgcccctccgtcgtctaccacgacaccgtctacacctggtcgcagacgcaccggcgctgcctccgcctcgcctccgcgctcgtctccctcggtgtctcccgcggcgacatcgtgtccgtgctgctgcccaacgtgccggccatgtacgagatgcacttcggggtgcccatgagcggcgccgtgctcaacaccatcaacacgcgcctggacgcgcgcacggtcgccgtcctgctccgccactccggctccaagctcgtcttcgccgacccggcgagcgtgccgctcgtccgggacgcgctgaggcagctcccgccggggcaccgggcgccgcgcgtcgtccccgtcgaggacccgcacgagaaggagttccccgcggcgccgcccgggacgctgacgtacgaggcgctcctcgacaggggcgacccggagttcgcttgggtgcggccgcgcagcgagtgggacccgatgatactgaactacacctccggcacgacgtcggcgcctaagggcgtggtgcactgccaccgcggcatcttcctggtcaccgtcgacacgctggtggaatgggcggtgccgaagcagccgacgtacctgtggacgctgcccatgttccacgccaacgggtggtgcttcccgtgggggatggcggcggtgggcggcaccaacgtgtgcctgcgccgcgtccacgccgccgaggtgtacgccaccatcgcgcggcgcggggtggaccacctctgcggcgcgcccgtcgtgctcaacatgctggccaacgccccggacgccgcgcggcggccgctcccggggaaggtgcgcatcctcaccgccggcgcaccgccgccggccgccgtgctccaccgcaccgagtccatcggcttcgaggtcacccacgggtacgggctgacggagacggcggggctggtggtgagctgcgcgtggaagggggagtggaacaagctgccggcgtcggagcgcgcgcggctcaaggcgaggcagggcgtgcgcacgcccgccatggccgaggtcgacatcgtcgacggcgagaccggccacagcgtgccccgcgacgggtccacgatgggcgagatcgtgcttcgtggcgggtgcgtcatgctcggctacctcaacgacgacacggccaccagggcggcgatacgggacaacgggtggttctacacgggggacgtcggcgtgatgcacccagacgggtacatggagatccgggatcggtccaaggacgtgatcatcagcggcggggagaacatcagcagcgtggaggtggagtccgtgctctacaaccacccggcggtgaacgaggcggcggtggtggctcggcccgacgagttctggggcgagacgccgtgcgcgttcgtgagcctcaaggaggagaggtcggggtcgccgggcgcggtcaccgcggcggatgtgatcgcgtggtgccgggaccgcatgccgcactacatggtgcccaagacggtggtgctccgcgccgagctgcccaagacctccaccgggaagatccagaagtacgtgctccggaaccttgccaaggatatgggacccacccgcaagggcgccagtagcagcagcaggatgtagtgccagtgctgtgccgtcgtcttgcttggcttggccagcatggaaatggacatggacatgtgctctgctgcagcttgccgttatagcatggggttcgcaggcaaggctcttcattttcttgagatcagcaagccctctcaccgatccttggaatggaaaggatttacgataatgccggtacaacagatatgtctccgtttcaggtggtcattgatacgatgtgaagtttatccgagtttcaatgtatgagtatatctatactaaaaatgaccaacagattcagtacttccgtgtcactgtgtgtgtctttatggggacgaatgaaaacccagattgtactagtgaagttttcattttactttggattgagtttatgatggtaacagctcaaaaatcacaatttaaaaaatagaatcattcaaaagtcc

SEQ ID NO: 71 - DNA, 1632 bp, Sorghum bicolor
cgccccaggccccagctgcttaacacccatcgcctctctattctattcacccgcctcccctctctcgctcatcaccgcacgcgcgcacgaacgctcctaccccctcctcccgccgccgccgccaccgccaccgccgccaaaaccccagctcgagtcgagcccgactcggcgtcctcaacctcctcgtcctcggcgggcgcgggcgagccgggcggggagagatggcgtcggaggacgtggtggggaagagcaggggcgacacggccgtcaccaccatcgtcaacctggcggaggaggccaagctcgcgcgcgagggggtcaaggcgcccggacaccagatcctcaccatctgcaagtcgctcgtcgccggtggcgtcgcgggaggagtgtcacgtactgctgttgctccactcgaacgattgaaaatcttgcttcaggttcaaaatccacacagcattaagtacaacggtacagttcagggtctcaagtatatctggagaactgagggcctccgtggacttttcaagggcaatggcaccaattgtgcaaggatcgttccaaattctgccgtgaagttttttagctacgagcaggcggcaaagggaattctgtgggcttaccgtcaacagactggggaagaggatgctcagcttactccactcttgcgccttggagctggagcgtgtgctggtatcatagccatgtctgctacttacccaatggatatggttaggggtaggatcactgttcagacagacaagtctccctaccagtaccgtggtatgtttcatgcactgggtacagtctaccgtgaagaaggctttcgtgctttatacagagggtggcttccatctgtaatcggagttgttccatatgttggcctcaactttgctgtatatgagtccctcaaagactggctactccagacaaatccatttggccttgcaaatgacaacgagctgcatgtggttacaaggcttgggtgtggtgctgtggctgggactattggccagactgttgcatatcctcttgatgtcatcaggagaagaatgcagatggttggttggaaccatgctgactctatcattactgggaaaggcaaagaagcactccagtacaatggcatgatcgatgcattcaggaagactgttcgtcatgaaggcgctggtgctctgtacaagggtcttgttccgaattcagtcaaggtggtgccctcaattgccattgcatttgtcacttacgaggttgtgaaggatgtgctaggagtagagatgaggatatcagactgaagaagcgggggtagtgctggtcgttatcaactgctatttttgtaggttttggggagtttctgtttttgtaggcagggcgagtaggaggatatgactgcggctacatttcagcatcaggccctcccagcccatgttgatatatcctgctactggcttcaggtcctagaattgttgctggatcgcgcgaaaagtaataagttggctgtaaagctttaagcatttgcctaactcataaaaaatctgtcccttgttgatgtaccgagattgaacttaaaagcggtattgcgtgctgctaatagttgattctaatgatttttctctgccgttgtcgcgtttcattttc

SEQ ID NO: 72 - DNA, 1955 bp, Sorghum bicolor
ctcgtgtcctcttccgccaccaccaccctcaattgtcaaatcaggcatcctccaccaccacccaccaccaaagcacccgtctttacttgagtctctcctctacccgcgaatccgttgcgagctgcgggtcaaactagactcttcctccttctctggggtgagagtctgagtttgctgctgctgcctgcctgcctgcctgcctgccggagatgatggacgccggaggaggaggggtgcggtcgcagggggtcaacccggactgccccaacgccgctaaccccttccaccgctgcgccgaatactgtcccgtccccgccccggccgccaacaaagccgcctccgcctccgccgctgcggcgcgcggcaagccggccccgcctcgtccgaggacgacgacggtggcgcagaacgggacagccaagcacggagacggcgctgcgcgcgtcgttcccgccgccgacgcggaggaggaggagaacgacggcggcgagagggaggagtcgcgggcggtcgacccgggctactacccggccagtaagacgtctccgcctcgtcaggggccggcgccggtgctgggctacgcggcgcagaacgggaccgcgcgccgtgtcgtggaggaggagtgcgagattaccgtcgtcgatgacgcggaggagcaaggcgagagcgtcgagaactacggggcggaggaggagcagggcagtggcggcaggacgaggacgagcgcccggtcgccggccacggacggggagggcagcggcggcaggacgaggacgagcgcccggtcgccagccacggacggggaggccggcggcgagaggcagtggcaggcggtcaatccggactgccccaacgccgccaaccccttccaccgctgcgccgagtactgccccgttcccgtccccaaggtgccgctgccgccacgtggatacgaggggagcacgcacagcgaccctggcgcgccgcatcccaggccgcgccgccgcgacaagggcggctccggcggcctccccctctacgtcttcctgcgcgaaggttctgatggcgacgggaagaaggtggatccccgctgccccaacgcgcccaacccgttccatgtctgcaccgaccactgcctcgccaagatagccgacgccggccgctcgtcggagggcgccaagtcgcccatttccctcttctcgcgccactcccgccgttcctcatcgtcctccgaagagggtagcttgaagtccccggggagtaggaaggtggatccaaagtgtccgaatgctggcaatctgttccatgaatgtggtgagcattgtgccaccaagatgcagcagacagagcagcacaaggggttcaatatcaaatccccacgcagaaaagggggaaagaatgctacagtgattccaaattggaaggttgatccaaggtgccctaatgcgtccaatccattccatatgtgtgcccagtattgctttgatcatctcagtgaaacagcgcagacaagtgcaaccaagtcagacaagagtagaggcaaggatattcctaaagatgagcgaagaggagaaatcaactctgattgtgtcaatgcatccaacccctaccacaagtgtggtgaccactgcaagagaagagggtgataggtagacgaggaaggctggcgagacaagatctcttcagagggacgatcgacgacgacgacgatgaaaaattactaagtaaattccatcgacggaccataggctttgagctgcagcagaggctgttttgtagggtgttgcagctgtttgaatttgaatcctttccttgtgtgttcctcccctgtgtgcttccatatcatcatcattattattatttttttatttcgccatttccagcctatactagtgaaatgcatatatggcatattgtagttccattgtaatgtatatttttttcccctgatgatgaaggctgtacaaatagaagca

SEQ ID NO: 73 - DNA, 1886 bp, Glycine max
agggccgtctattactggatcttcttgtcttccaactctctctctctctctctcttgtgaaggctctcacttttgcaactcaaaagcttcaaacccaaagaagtagtacttggcttatagccagtgatgaacactaactgcattatgtaaagattgcatttttgctcccacaaggacaacccatttgtcaaatatggattacgagaggatccaaaagcctcagggtgttgggggattttcgcctggaaaattgaggagcatgctactgggtgtggagaagaagagaaaagaagaggaagagcttgattctactttgaccacgagatctcagaattcagacatggatgaatctggtggtagcagttctgatcattgtaaagacgtagatgttgtgagtgtccttcctgattattcaacttctgctatagttcgcactagtagcatagaggcagttggtggtgatcgttttgtgaaggccaatgcagcagtgaattcaaggaatagagtcttagaagacccttcttcagattatgatagtgggcacgataatatgagcatgtcctcatcaatgttcgaatttcaaaaggcggagcgtgccccacagagggtgcccgtggggccattctcaaaaccagcaccatctaaatgggatgatgcacagaagtggatagcaagtccaacttcaaacaggccaaagacagcgcagacccaggggcaaggtgggcatgcaggaccgcgtaaggctggtagtcttggttatggaagccggcaatcttcgatgaaggttgttgttgaagttccagatcaaaaagaaattgctttagatgaaccagataccaagaaaattgatacaaatcaaactaagatggatagtggaggacagaaatttgtgagttgggaggctgatccctatgcaattgcaagtttttgtgttagtctcagccagcacaatttatctcttgcaatccaaaatgaaacaacatttgttcctcccccttcaacagctcggtctgtgtcaatgagagatatgggtaccgaaatgacccctattgctagccaggagccatcaagaacaggtaccccagtgagggcaacaacaccaatgcgcagccctaattcttcccggccttctactccccccagagcctcccctgcatctactttaactgatctacatagtgacaatctgaatctcaacatgaatgagttgtccgaaaaggagctacaaatgaaaacaaggcgagaaataatggttctcgggacacaactaggtaaaatgaacattgctgcctgggctagcaaagaagaggaggataaggatgcatccacttccctgaaaacaaaagcagaattacctaagagtgtcgttgaagcacgtgcagcagcatgggaggaggctgagaaggccaagtacatggccaggtttaggcgtgaggagatgaaaattcaagcatgggaaaatcaccagaaagcaaaaacagaagccaagatgagaaaaattgaggtagaagttgaaaggatacaaggtaaggcacaagataagctaacgaataaattagcagctgcaaggcataaggccgaggaaaagcgtgcagcagcagaagccaatagaaatcatcaagctgcaaaaactgaagagcaagcagagtatatacgaagaactggtcatgtcccttcctcatatttatcattttcttgctgcaattggtgctcttaaaaaaagccaatctttgtcaatgtttattttttgtttctataggtatgaaatgccttttgctgcttacacccaagcatgttaaatatgcctgttgcatttccctcctggtgtaaaatgttacattgttctgaagaataattgcaatttgaaagtgctttgctatttgttc

SEQ ID NO: 74 - DNA, 2916 bp, Glycine max
attcaggaaattgaaaacccttcgtccaacaaaggcccgttattaatatatatttctttctcttttttagttttttcttctgagaatgacggggaagaagaatgtgaaggcgatgaccacggcggaagaggaagatgatcaggggaagcacacgacgtcgtcttcgttttcgtcttcttcttcgccgtcgtcgtcttcggacgagagagagtacgaggtgcaggacctgcgtgaccggttgaaatcgtcgcaagggagcatgttcaatctgatagagaaccagttgggactcaactcgacttggagcaagttcagtcgccaagctcttctccatggaatccgaggcttctccatggacttagttaaagacttcgttattcatcctgataacaggtggtatcgggcatggacaaatttcatattggtatgggcagtgtattcatccttcttcaccccaatggagtttgggtttttccgtggcttgcctgagaatctctttatactggacatcattggacaaatagcttttcttgtagatattgtcttgcaattctttgttgcttatagagacagtcagacctatcgtatggtctacaagagaacccctattgctctgcggtatctgaaatctaacttcatatttgatcttcttggatgtatgccctgggacatcatctacaaggcttgtggaagaaaagaggaagtgaggtaccttttgtggatcagattatatagggtgcggaaagtcgaagactttttccacaagttggagaaggacatacgtgtcaattacattattacccggattgtgaaactgatagtagttgaactctactgcacccatacagcagcctgcattttctactatttagctactacactacctgaatcccaagaagggtacacatggataggaagtttaaaactaggtgactttagttattcacatttcagagaaattgatctttggaagcgctatacaacatctctgtacttcgctattgttacaatggctacagttggctatggagatatgcatgcagtaaatatgagggagatgatattcataatggtatatgtttcatttgatatgattcttggtgcctatttgattggtaacatgacagctttgatagtcaagggatcaaagactgaaaagtttagggacaagatgacagaccttatgaaatatatgaacagaaataggctcggaagggatatccgtgaacaaataaaaggtcatgtgcggttacagtatgagagtagctacactgaggcttctgtcattcaggatatccctatttctattcgagctaagatatcccaaacattatatttgccgtacattgaaaaggtttctctttttaaaggatgctcttcagaattcatcaatcagattgttattaggctccatgaggagttctttcttccaggggaagttataatggaacaaggaaatgttgtagatcaactatattttgtatgtcatggagtactggaggaagtaggcatagctgaagatgggactgaagaaactgtttcacttctgcagcctaacagttcattcggagaaatatctattctttgcaacattcctcagccatatactgtccgtgtttgtgaactgggtagactcctgcgacttgataaacaatcatttacaaatatcctagacatatacttttatgatggaaggaaagtgttatacaaccttctagagggaaaagagtcttttcgagataagcagttggagtcagacatcacatttcatcttggaaagcaagaagctgagcttgctttgaaggtcaatagtgcagctttcaatggggatatgtatcagctaaaaggtttaattcgagcaggagctgatcccaacaaggcagattatgatggaaggtcacctttgcatcttgcagcatctagaggatatgaagatatcacaattttccttattcaagaacgtgtagatgtcaatattatagataacttcgggaacacacccttacttgaagcagttaagaatggacatgatcgggttgcttctttacttgttaaagaaggggcctctatgaagatcgaaaatgctggtagttttttgtgtactgcagttgcaaggggagattcagattatcttaaaagacttttatccaatggcatggatcctaacttaaaggattatgattaccgaagtcctcttcacgttgctgcagctgaaggtttatacttcatggcaaagttgctattagaagccggagctagtgtttttacacgagacagatggggaaataccccgcttgatgaagctcggatgtgtggaaataagaatctgatcaagctactggaagatgcaaaatcttctcaactgtcagaatttccatcccaagaatttacagataaaatgcatccaaagaagtgcacagtgttccctttccacccgtgggatccgaaagataatagaagacatggaattgtattatggattccacactctatcgaagagctaatcaaatcagcagcagaacaaatagaaatttctggcggttcttgtattttatcagaagatgctggtaaaattactgatgtggacatgatcaaggatggtcagaagctgtatttagtccatgaaacacattaggcctccatattatggctctttacaaccatataattaagtgccttgtaatgtgttgtgctttctacaaattagcacgtgatttgatcttgttaaccgttcaaaaactgttttatatatcctgtcaaaatacagacgggtgatgaagatcaatactgcttagtgttgataccgtgatttcaatactgcttagtgttggtcatccattttgctattcagtattggctcggaagatttctttgtttttcttgtctgagcattaatattaattaagagatagttaa

SEQ ID NO: 75 - DNA, 1354 bp, Glycine max
gtggccattatttttgcacacagcaccacaattttaattacctcagcagtgctagaagtgaccctcaaaatgcaaaatatctgaccaacatgacagtttaaagctacaaacaaaaccagcaatcttatctgttgtgttctgctcatcactccaaccttgctttccatagataacatcttcggcatcagacaatagacaaaaacatgcattccttaacatgcacaccactttcttcttcttattcttctcatcacaccactctaaagccaaacctcaaccctctgctgggtgctgatgcaacttttaggccatgttctctacccttgaaaagaagaacatgctttactaccagagccattctctcatccaccagagaagatgtcttgaagcatttcagcgagcgaagagctctcaagattatctcaggcctgcagaatttcaataaagacaatgttgcctcggttgtcactgctgctgacaagggtggagcaactcacgtggatatagcatgtgaccctgagttggtaaagctggccattggcttaacttcttgtccggtttgtgtttcttctgtagatcctgcaacatttccagctgcagttgaagcaggagcactaatggttgagattggaaactatgattcattctacgagaagggaatatttttcactccagagaagattctaggtctaacaaaggagacaaggaggatacttccatctgtagtcttgtctgttactgttccacacacactaagcctccctgatcaggtcaagcttgcagagtcactggagcaagtaggtgtagatattattcaaactgagggaggaaaatgttctaatcctacacaatctggtgttatgggtttgattgagaaggcaacaccaactttagcagcagcatattctatatcacatgctgttaagatccccgtcatgtgctcatcagggttaagcgctgtcacagcacctatggctataactgctggggctgctggcgtgggtgtaggctctgcagttaatagacttaatgatgtggttgctatgattgctgaggtcagaagcattgctaattcattgcaggcaccatttcggatatccactacacatgcagtagaaactcaaaggcagtagtttatgttgcaagaaacagatgaaggaggtgtaggtagtgaataaaacatgcaaagaaaatttgaatcctttcttaatagtaagaactttaggttccatatttctttgtcctttatattttggacttgttctctgatccaaatatttgtgttcctgtgtggatgttgatcccgctatgtcaaagaattaaaagaaatagtgacctattggaattttgcttc

SEQ ID NO: 76 - DNA, 1592 bp, Glycine max
aagatttgtttcaaaacgacgtcacttttgctcacattatcttcttcttcttcttcatcgaactgcggaggcacttagcagcagtagcagaaatggccaccacttctgcttcattcgcgagcttctccgtcatcttgcgaccttcttcgtccaatccccaattcttcctcttcaacgtcgctccccgaaccggaacctctcattcccgaacccgttcgactcggttcaggtgctcggccggtcagaccgggttcttcacgaaactagggcggttgataaaggagaaggcgaagagcgacgtggagaagcttttctcgggattctccaagacccgcagcaacctcgccgtcatcgacgagcttctcctctattggaacctcgccgacaccgatcgggtcctcgacgaactcgaagaggctcttttagtgtctgattttggtccaagaatcactattaaaatagtggagaatttgcgcgaggatatattttcagggaagcttaaatcagggaatgagataaaggaagcactgaagaggaatgttttggaattattaacctccaaggggagtaaaactgaacttcaacttggatacaggaagccagctgtaataatgatagttggtgttaacggtggagggaagactacatctttgggaaagctggcctatagattgaagaatgaaggggctaagatattgatggctgctggtgatacatttagagcagctgctagtgatcagttggaaatatgggccggacggactgggtgtgagattgttgtggctgaatcagagaaagcaaaagcatcatcagtgctttcacaggctgtaaaaaagggaaaagagctaggttttgatattgtattatgtgatacatctgggcgtttacacactaattacagcttaatggaagagttgatttcctgtaaaaaatctgttgctaaggtcattcctggcgcacctaatgagatcctactggttctggatgggactaccggtttgaatatgttgccacaagcaagagaattcaatgatgttgtgggtgttactggtttaattttgaccaaactggatggttctgctagaggtggctgtgtggtcagtgtggttgatgagcttggaatccctgtaaaatttgtgggtgttggtgaaggtgttgaagaccttcaaccctttgatgcggagtcctttgtgaatgccatttttatttaaaccaatattgtgggtttgcaaaaacagcttgacatgaacattcagagcaacacctggtcaacaggaaagatggcactttattatggaaaccgttattgggaagggccaagcattgcgaataagtgtacatgattttgaggtgcagagctgttgttgcttttgaggaacgctgagtgtatacaatcttccttttgcatgctgtgtctgaaagtttctgacaatgcaaatgagacgtagggtttataatcactcctgtttatgaacagaaggattttattgtggtgtgcatatagatgatacttaaggaaaatgtaaatacattgctccattgtctgtcaacatctgattaatgacaactatttttatttcttcgacctctca

SEQ ID NO: 77 - DNA, 3220 bp, Triticum aestivum
gcagtactcattcattcattcgctcacccagctacccggtagatacacaccactgctgatacggttgcgtacacgcgagagtggctcgattacgttagcatagcactagccactattttgttcatttcgtctcatcggcgatctgtcacttgcaccacgctactagcagtagttgctgcggcgactccccgagaaaggaaaaagaggttgctgcggtgattccaaccatggaggtgtgctgctgctccacctcgtcctccctcctcgccagcggccgcttcgccgcgccggtggcgtccgcgcgggcgcggcagtggtgcgcggcggggggcgggagggcggtcgtgctggcgcacccgctgcgcccggctgccgccccgaggtccgcgcgccgggcgcgccgcggggtgacccgggccgtcttcgagcgcttcacggagcgggccgtcaaggcggtggtgcactcccagaaggaggcccgggggctcggggagggcgccgtggcgccgcgccacctgctgctcggcctcgtcgccgaggaccgctccgccggggggttcctctcctccgggatcaccgtcgagcgcgcgcgcgaggagtgccgcggcctcatcggcgccgcctcccagaaggcgggcgggcttgacacggacgtgcccttcgacgggggctgcaggcgcgtcttcgaggtcgccgtcgagctgtccaggaacatgggctgcagcttcatctcccccgagcacctcgccatcgcgctcttcacgctcggcgatcccaccaccaacaatctcctcagaagcttgggagcggatccgagtcagctagcgtcagttgcagtcacccgactccatgaagagcttgcaaaagatggcagagatctcgcaggagtatcttctctcaaagtgcccgagaaagcacccgctggagctggagctggaagatctgccttcggcaaatccttaagcaaaaagaaagataaaggcgcgctagatcagttttgtctagatttgaccacacaagccagtggagggtttattgaccccattattggccgcgaggaggagatcgaaagggtagttcagataatatgccggcgaacaaagaacaatcccatccttttgggtgaggctggtgttggtaaaaccgcgatcgccgaagggttggctcttcggattgcaaatggagatgtccccattttcctcgtggcaaagcgtataatgtcactagacattggcctgcttattgctggcgcaaaagagaggggcgaactggagtccaggatcactagtttaattcgtgaagtccgtgaagcaggtgatgttattcttttcatcgatgaggttcacaatcttgttggatctggaactgctggaaagggtaagggtgctggccttgatattagcaatctactgaagcccccgcttgccagaggtgaactgcagtgcattgcagctacaactttagatgaacaccggatgcattttgagaaggataaggctttgaaccgcaggttccagccagtatttgtagatgagcctagccaggaagacgctgtgaaaatattacttggtcttcgtgagaattatgaagcttatcataaatgcaaattcactctagaagccatcaatgcagcagtttatttgtcagcaagatatatcccagacagacagcttcctgataaggctattgatcttattgacgaagctggcagtagagctcgaattgaatcatatcaaaagaagaaggaaggacagtcttccgttctcttaaaggagccggatgaatactggcaggagataaaagctgtccaggccatgcatgaagtggtgttatctaacaagatgaaatattctccgaatgagaataagcaacagaatgcgagtgttaacactgaagcgccacatcaggataaggctgagtcaacaattgaggagcctattgtagttggaacagaagaaattgcaagagtcgcctcattatggtcgggtattccagtccagcagctgactgctgatgataaaaagatcttagtaggactggatgatgagcttagaaagcgtgttattggtcaagatgacgctgttgcggcgatatcgcgggccgtgaagagatcacgtgtaggcctcagtgaccctgacagacctatagctacgatgctcttttgtggtcctacaggggttggtaaaaccgagcttaccaaagctcttgcggcgagctactttggatcggaatctgctatgcttagactagacatgagtgaatacatggagaggcacacagtgagcaaactgataggctctcctccagggtacgttggatatggtgaaactggtactttgacagaagcagtcaggagaaaaccattcaccgtggtactgcttgatgaaatagagaaagctcaccctgatattttcaatatccttctccaaatttttgaagatgggcatctggcagactcacagggtcgcagagtttcgttcaagaatacattgattgtcatgacatcaaacgttggttctacgtcaatttccaacggacgacggagcatgggtttctcaacagaggacaccgaatcaagcagatatgtcgcggtgaaatccctcgtgatggaagagctgaagggattcttccgtccagaattgctcaacagaatcgatgagacggttgtattccgtcctctggaacagactcagatgctagcaattctcgatatcctcctagaggaactgaagggcaagctcttggccgtcgggatcggcctagaggtctccgacgcgatgaaggagctgatctgccgagaaggctacgacaagaactacggcgcgcggccgctgaggagagccatcacccagctgatggaggatgtcatcagcgaggcgattcttttcggcgagtacaagcctggcgacacgatactggtggacaccgacagcaaggggaagccttgcttgagtcgtctgaaccaaccaccgatcgtccaagtgtctgactcaacacggacattctgaagtgaagctctctctcgtgtggtagacttggtagagtagaggcctaatttcctattctttcgatttcgagtaacgagataagtagtaattctttgataggtagataccaaatattcggttatttctttatgtacataacattgagggaattcgtcccagcatggtcttattcggcaagtatatatccaactgtatattgtcctccggtttat

SEQ ID NO: 78 - DNA, 1790 bp, Triticum aestivum
ccacgcgtccgcgcactgcttccacacgatcggactgagccgagagattctggactgttccacacgatccatgacgtccacggtgaccacgcccacgcccagccgcccgctcccggcggggccccagcggcgccggtacaggcccacggtgctcgccatcgccggcggtagcaagccgccgcgccgccgggcgcccgccgccgccaccagctgcgcggcgctcgcggcgcccgagaagcagagcacggcgccctccaagctccctgctccgtcgccggcgcccgagggcacggactacgacgaggtggccgccacgctggagacgctgtacaagctgagccccgtcatcgtggaggaggacgggaagaggagcaagaagcaggcggcgaccaagaagaagaggaagcaggggagggcgaaatcgggagcagcgacgacgacggcggcgacgccgaggaggacagtggtggtgaggagccagcggcggcgccggatggacctggggaagcgggtggagatgcgggatctggccgccggcaaggaggacgaacaccgggacggggagcgcgcgttcgaggaggcgctgctgcgggagcacgccgtgtcgacggacatgggcagcctggactggaggtggatgaagatcccgccggtgctctccgccccgcagagcgcccgcctcttcaagatcatgcagcccatgaaggccattttggaggtgcaagagaacctgcggaacgagctgcagagcgagccgacggacgtggaggtcgccgaggccatgaacatgccggtgcagcggctacggcggctccgcgacgtgggccaggcggcgaggaacagcctcatcaagcacaacctacggctggtcctgtacgcgatcaacaagtactacccggacatgaccggcgacgagaggttcgcggacctgtgccaggccggcgccaacgggctcatcacggccatcgaccgcttcgagcccaagcgcggcttccgcatctccacctacgcgctcttctggatccgccactccgtcgtccgcgccatgacgctctccagcttcacccgctttccgttcgccatggaatcggagaggcaggagatcaacagggcgagggaggagctgtcgttcgagctcgggagggcgccgacggacgaggagacgatgaagaaagtggggctgtcgccggcgaggtaccgcgacgtggtgcggatgacgaggcccacctactcgctgcactcgcggaaccgtgtcacgcaggaggagctcatcaaggaggtcaccgacgtggacgccatcggggtcgacacccacaagcacaaccgcctcctccgcctcgccattgacgacctcctggattcgctgaagcccaaggagagcgtggtgatcaggcagaggttcgggctagacggcagggggaggcgcacgctgagcgagatcgccggcaacctgaggatctcgagggagatggtgcgcaagtacgagctcaaggcgctgatgaagctcaagcaccccacccgggtcgactacctgcgaagatacatgtgaaattatctgtatatatctcggtcgcgcacatacataccggttctctaatttgattatgctgcatatacttacattgcaagatggcatagactcatcattgattccgtatttcggacatgtatataagtctgtatatacgagtgagattgtatatataatatttgatttagacctcgcgctgatgtaattcatagcacgcagaaaagaaaatggtctctggtttattagaagaaaaaaaaaa

SEQ ID NO: 79 - DNA, 2751 bp, Triticum aestivum
ccactcccatcgctctcccgaatccccccaatccgagccaaacccccctgctccattaaattcataaaccaccacagtcacaggtctcacgcacacgctcggcaaccatgggcacgtcgggctccaagggtctggacggcgtcgggggcctcggcgcggcggcgctcggcggcggcagcgggggcggaatgggcggggacgagggcgacggcgccgtgacggggtcgtggcacggcggcgcgcagctctacgtgtcgctcaagatggagaacgcgcggatcatcggcgacctcgtgccgcacgtctacggctccgagcccatcatcggctcatgggagcccgcccgcgccctcgcgatggagagggagctggcgtccatgtgggagctcagcttcgtcgtgccgccggaccatgaaacactcgacttcaaattcttgctcaagcccaaggatgcggagaccccttgcatcattgaggaagggccgacgcggcttctcaccgggggcatgctcgagggtgatgtgaggcttgcaaacttcaggcttaacggagatgatgagttgcttgagttcagggttttcaacaaggccgacatcgtgtctccgcttgatcttgccgcgagctggagggtatacaaagaaaatttccagccttccaaggtccggggaattcctgatatcagtataaatgaagcacccactcatgcgaccgaggatggatctggttctagtttggagcttgacttagagcattatgttgttccaacgccaactgcaccaccaactgaatatgcagcaaaccttgctgcaaccccagcatccttagatcagcctgaaacaccgtggacaaatgatatgcttcttagtgatggcattcagagtccaagaagtgctgctgcagattttaaagatgatagttaccataataaggatactgaggcttcaatagcagattcttctaattctaagaagttacaagtttctggaatggtagagtcaaaatcagttggtaccttaatacaactgcaaaagaaggacaggccacaagggctatacgttgacaggggtgttgtctctcctaagcttggaaaatcatttagtgcatgttccctggcatctggccttaattttggatcaacaaaggccatgccagaagcagccggagctgttgcagctgcagctgtagctgataggttgcacggatcaaaggaggaccggaaactggctattgttctggttggcctaccagctcgtgggaaaaccttcaccgcagttaagcttacaaggtaccttcgttggctaggtcatgaaacaaaacatttcaacgttggaaagtaccgccgtctgaagcatggagcgaatcagtctgcagattttttccgccctgataaccaagaggggatcgaggcacgtaatgaggtggctgctttagcaatggaagacatgatagactggatgcacggaggaggtcaggttggtatatttgatgcaacaaacagcacaaggaaaagaagatatatgctaatgaagatggctgaagggaactgcaagataatatttctggagacaatatgtaatgatcgaaacataatcgaaaggaatgtgcgcctgaaaattcagcaaagccctgattatgctgaccagccagattatgaagctggattgcaggacttccttgaacgtttgacaaattatgaaaaggtctacgagccagtgcaggaaggctcatatatcaaaatgattgatatggtaaaaggggagggtggccagttacaggtgaacaatatcagtggctatctccctgggcgtattgtctttttcttggtgaattctcatcttgctcctcggcctattttgcttaccaggcatggtgagagtttacacaatgttagaggaagagttggtggtgacacggtgctaagtgaagacggagagctttactcaaagaaactagccaactttattgaaaagcgcctcaaaaatgagaaaactgcaactatttggactagcactctacagagaacaattttgacagcaactccaattgttggattcccaaagatacaatggcgtgctcttgatgagatcaattctggtgtatgtgatgggatgacgtatgaagagataaagaaaattatgcctgaggaatatgagtcacgtaagaaggacaagctgcgttatcggtacccgcgtggggagtcttaccttgacgtgattcagaggttggagcctgttatcatcgagctcgaacgccagcgagcaccagtggtcgttatatcccaccaggccgtattgcgagcgctgtactcgtattttgccgacaggcctttgagggaagttccagacatggagatgccactccataccataatcgagatacaaatgggcgtcaccggtgtcgaggagaagaggtacaagctcatggattgagaatctgagatacaggtaggctcagcacaacagcaagttccggactggctgctccagatacaaccatacagacagtatatacatacagttaactcaatacagtaaccagctattcatctctcctctccggacggcgtgaaagtaaaactaacccctccggtgtaaaatattcgaccgaaaacacctactggtcattgtaaaaaaacatatagtactagtaccgctaataaggaactgtaaaaagatactgtaccagaagatgtaactgctggtaatgataagaaaaatgcagattcatctgggaaaagaaaaaaaaaaacga

SEQ ID NO: 80 - DNA, 1319 bp, Triticum aestivum
cgtggagcagtggcctgcagacgcggagctaccgagagccggaagccggaagcaagtgagctgagcgcaggcgggtggaggcggacggacgcgacgatgagggcggtggcgatcgcgagccccggcgggccggaggcgctgcaggtgcgcgaggtggacgacctcccggcgccgggggagggcgaggtgctcgtcgcggtggccgccgccggcgtcaaccgcgccgacacggtccagcggcagggccggtacccgccgccgcccggcgcctccccctacccggggctcgagtgctccggcaccatcctcgcgctcggggccaacgtgcccccgcgctgggccgtcggcgaccaggtgtgcgcgctgcttaccggtggcgggtatgcggagagggtggtggtgccggcggggcagctgctcccggtgccggagggggtgtccctgaccgacgccgccggcttgcccgaggtggcctgcaccgtctggtccaccgtcttcatgaccagccacctctcccccggcgaatccttccttatccatggcggatcgagtggaatcggtacattcgctatacagattgcgaagcaccttggtgttaaggtttttgttactgcaggaagcgaagaaaaactagctgcctgcaaaggtttgggagcggatgtatgcataaactacaaaactgaagattttgtagcgcgcgtaaaagaagaaaccgatggaaagggtgttgatgtcattctggacaatatcggcgcatcttatctccagcgcaatctgaacagcttagctgttgatggtagactcttcatcatcggtttcatgggaggcactacaactgaagtgaacctgcaggcgatgcttgcccgaagattgaccatacaagctgctggattgcggaacagaagcctcgctaacaaagcccagatcgtcagcgaggtggagaagaacgtgtggcctgccgtcgtgtcgggcaaggtgaagccggtgatttacaagacattccctctgtctgaagcagctgaatctcacaagttgatggagacgagctcccacattggcaagatactgctgattccatgattggatatggtgtatcatgtattcatgtgtacactagccgctgtgggcactgtttactgtggtgaactatgcatggacatgcccttttatattgtaataagctggatctctaagtgctggtgaaattggatatgtatctcgaggataaatagtcacaataaaatgttggaacttggaagtcttgtcctttcatcttatgggaggattattgatgttgagatttttccacaaaaaaaaaa

SEQ ID NO: 81 - DNA, 768 bp, Triticum aestivum
cagagttgtgcgtgtgggagttgaaggagatcgagatggccacagcatatgctcctccgatggcgagccaggtgatgaagagcggcttggtgtgctccaagccgcggggcatgtccggcgcttcgctcaccaggaggccccgcctcgtcgtcaaggccgtcaagtctgacaagccgacgtaccaggtggtccagcccatcaacggcgacccattcatcggcagcctggagacgcccgtcacctccagccccctcgtcgcctggtacctctccaacctccccgcctaccgcaccgccgtcagcccgctcctccgcggcatcgaagtcggcctcgcccacggctacctcctcgtcggccccttcgcgctcaccggcccgctccgcaacacgccaattcacggccaggcaggcactctcggcgccatcggcctcgtctccatccttagcgtctgcctcaccatgtacggtgtcgcgtccttcaacgagggcgcaccgtcaaccgcgcccgcactcacgctcacaggccgcaagaaggaggccgacaagctgcagaccgctgaagggtggtcgcagttcaccggaggcttcttcttcggtggcgtctccggtgccacctgggcctacttcctcctctacgtgctcgacctcccatacttcttcaagtagattaattattggcatgcatgtacgatgggtgcagatcatgtgatctcttcccgatggcggttgcttcaaagagtccatgtataaatgaattcacacattcctc

SEQ ID NO: 82 - DNA, 2031 bp, Triticum aestivum
gagggaagcaacacccacacggaactcgcggaagcgagcagaaaattatcggtttatcacctatcgagctcccgcgagagacgatgggaagcgcaggagcgctgctctcccaccccccaccgcaactcggcagcatcctcctccgtcgccaccacatctctcttccccatctctcctcatgcatgcccgagcccctccactgccgccgccggcaccttcgctgttccgccgttgaggggagcagcagacaggacacgaatttgccagcgtctcaaagagaagagtctccatcgagcagcctcggcgccaccctccaagatccacttccaggacgtgtcgaaaatggttcttttgaaggtgtcacacaggaagaagatcagagtagtctatataattttctttatccaagcaaagagctacttccagatgataaggaaatgagtatatttgatcatctagaggaacttcgtgcgaggatatttatatcagtattggctgttggagcttcaataattggttgttttgctttctccaaagatataattaagattcttgaagcgcctgttagtgttcagggtgtcagatttttgcagctctcccctggagaatttttctttacaacattgaaggtctctggttattgtggcctcctaatcggaagtcctataattttgtacgagatcatagcatttgttctccctggtttaaccaaggatgagcggaaattcctagggcccattgttttgggttcttcagttctgttctaccttggcattttattctcctacactgttcttgctccagcagcattgaacttcttcgtgaattatgccgaaggagcggtggaatcgatatggtcaatagaccagtactttgagttcgtacttgtgcttctgttcagcacaggattatcttttcaggtccctgtgatccagctgttgctggggcaagttggactggtttccagcgaacaaatgctctcaatctggaggtatgttgttgttggtgcggtggttgctgcggctgtgcttacgccctcgactgatcccttgactcagatgcttttggcgggtccactgcttggtctgtacttgggtggtgcgtggatggtcaggctaactgggcgctaactgcaacaagcgttgtagtgattgggtattgtgtgttagtgtactagaaatcatagccgtgttgattggtccgagtggtcaccgtcccccactgtaacatagtcttgtataaaattaactcggctgcttctcatctacgagcacattatttggccctctttctcaatacgtggaggccatctgtgaagccagtatgactataccttgccgaagtatttgcaactctattctgactatgaagagtatcttgctgaagcatttgcaactttattctgactacgaagaagtttatgtgaaataaggatcagtttggctgctaccctgggccaggtgcctgggagaaaatgttgcctggcctgcgcctgagattttgatttctgtagcctggccgcattgctgtttggagtatgacctgagcctgggagttcaccagggattaaaaaaatatatataatactgacaaacggcccagatcctacgtataaataactggattagctctaggctagtaccgccacccgcccaggcgaccaaaaggagacgcctggcaggctaattatttgctcgggtagtccaggacaggcttgctccacatttttcagggcttcatccaaacaaagaccagacagcaaccaggcaagctccaggccaggccttctcaagtgtagtgtggaagcgtaccaaactagctctaaagtatctaccagcctttaatcctttaaattctagcactagatgactgtacgccaaatgttccaaagaatcattggagaagatagatagggccgtggacaagtcagatttcacaatggccggacgctttgtatgttgtatagcaagtgctccctgcctaactgttagaagggaatacagggatttgtggaattgttcttatggaaaa

SEQ ID NO: 83 - DNA, 1710 bp, Triticum aestivum
gcagagccaaacgccaagacgcaaagcgatcgggagcttcccgatccccctgtcctgtagccgcgcgtgggaaaggaggctgcaacttttcctcggtgcggcggccggtccgcgtatatatagcaaatggagaggagctggttcgggtggaggaaggcgaagcagggcggaggtggcggtgccggcggcggcggcggggagagggaggaggaggatcaggccaaggtggtggtggacgggtcggggatacgggagctggtggaggacagggaggcgttcggcatgttcgcggagaccaagttccggcagctcgacgccgacggggacggccggctgtccgtgcgggagctgcagcccgccgtggccgacatcggcgcgtcgctcggcctgcccgcgcagggctcctcgcccaacgccgaccacatctactccgaggctatgagcgagttcactcatggtcacgggaaccaagagggggtgagcagggcagagttccaggaggtcttgtccgacattctcctcggaatggcggccgggctcaagaaggatccgatcgtgatactgcgcatcgacggcgaggacctcagggacttcgtgtccagcccaaggtatgagccggcagtcgctgccatcttctcacaagttgggtctgaagatgcccctctccggcagtgcctgctagccgccgttcagcagctcggcgtcgaccacggcatgcccccagccgctgacccttgggtggtagagaacgtggtagagccggcattgcagcagctctccgccgatgagctcgagcaaccggcgtcccgggacgtcttcttcgagcagctgaagaagctgctgggcagtgtggcggaacagcttcaggagcggcacgtcatcgttgcgcacaccgagaacaccttcgacgggagcggcgtcaggaggctgctgggaaacaagttcgagctggacaagctgctggattctgtgtggagggacgtgccggcagagcacaggaagaaggcgcccaagggcaaggagcacctgcgagtcgcactcgataagatggccgatgcagcaagcttaccacctcatggcgctgttgctcaggtggacgccgtggtggacgaggcgctcaaggtggcggacgccggcgacgggaaggcggttgaagaagccgagttcaagaagctgctgacggaggtccttggagctgtgatgctgcggctgagcggccaaccaatcttcttctccaccagcaccgtcgtccacgagccgctatccacttcggccaccctgttgccctcgccggcggcggcatcgccgccgagtgagtagcaatacgagcacacgaaaggtaaatagcatgggatgggcataaggcctcctccgtaagctgtgcctgtggttgtgctttttatctgatcacgagcattcatgctttgctatggttggttggaacctgacggaatgcagcgttgcagttcgtcaaatactccagcagtatgtatattgaccctgcttgatgtataagtttggaataaggcttccaagccagaaagacacattgtcaatgggaaatgttactgcgtgcgaatgcattggtttgacaagatgctatattactacgtgcgagagcatccatctgttttttttaaacggaggcaaaagatttgcctcatatattaaatgaggaggagataagagtttgttaaaaaaaaaaactca

SEQ ID NO: 84 - DNA, 1420 bp, Triticum aestivum
ggggaacggggaaagggatctcgccgcaacgcaccatggagctcgccgcaaccagcgctgctgccctccggcgatcgttggcgtcggggtatccggtggtcccgagggagaggaggagggggatgccggccagggtgtcctgcgtcggccgcggaggcagaggcgtaggcgggggattcgccgacgaggcgcacctcaggtactacgaggcgccgccgcggaaggcggtggaggcggcggcgagggatcttaccaagctccgggccatgggccttgtcgccggcgacccagccaaggagaagatcctctcggaagccactgagctgctgctacaggagttgaatcagatgaaggatgcagaggacgagctgaagaagaagcagaaagaggagaaggctgcgatgaaagcactgaagaagcagcagaaggaagccaagaaggccgcgatgaactgtggagatggctcctctgaatcgagcgagagtgagtgtgaggaagagcaatccatgaaaatgagctgtgttgccaccacatcgatgcctgcagttgagcaaggaatggcgatgtcaatgtcagtgccccaaattgctgcatccaacatcgcaacagctccggcaatggattttgacaaggctgcgatgaaggccatgaagaagagggagaaggaacaaaagaaagctgcaaagaaggccatgaagatgaaaaaggaggaagagaagaggatggccacactgaattcctgcaaggatgaagacagctcatgctcatcggagtccagcaacagtgagtgtgaaggggaagtcgtcagaatgagccgctgtgccaccatttctgcgcctcgaacaccacctgcaagcacagttttccccatcatagtgcctcaaatcccagactccgttgcactggatgctcagatcttttccgggtctgcaaatgcaatgcagtgcactgccaccagcattgcggttgtcgaaaaaccagtgctgaacagaatcgaggtctgcatgggcggcaaatgcaagaaggcgggctcgctcgccgtcctgcaggagtttgagacggaggttggcacgggcggcatggtggtcggttgcaaatgcttggggaaatgcgggctaggcccaaatgtgcggcttcggagtgagggctctgtacagaagaacagtcccatctgcattggtgtaggcttggatgatgttggcaccatagtggcaggcttcatcggagatgacgatctgggcatgaactgatacgatggttacctggactcaggttggtatttacagacctgtattactacaacttgttttgtctggcaaatgtactactacaactttgctgcacaataatacattgtagataatcacgcccctgacgagctgatgtatgttctgagcttaatgagctgttgtttactata

SEQ ID NO: 85 - DNA, 994 bp, Zea mays
cacgcacccacgcacacgcacgccccccagagcgagaaccgagaaggacaatcgcgtcccaccgccgctgcacaagacgaggaagaggttcccggtcccggcgccgccactatgtcgtcgatgatgaacgcgctgtcaaactggctggtgaacccgcgccgcaacccgctcgcgcgcctccacatgcacaccgtctcctcgcgcctcaggaaatacgggctgaggtacgatgacctgtacgacccctacttcgacctggacatcaaggaggcgctcgggaggctgcctagggaggtggtcgacgcccgcatccagcgcctcaagcgcgccatggacctctccatgaagcatcagtacctccccgaggacctccaggcacagcaggtcccattcagaggatatttgagtgacatgttggctctggtgaaaaaggaaaacgctgagcgtgaagcactgggagcccttccactctaccagagaacgcttccctaaatcgctggctaaacatggttgcaagtcttctctttacggcaaatcagaatgcatgcaataaaatgcagtgggtgttttttttggttccaaccaaagttccattttacttgtccacgcagtggtgcattgaccatgcgctctagctgtttttttttcttccgattaatgggagcaaattattgtaacactataattaacttgtgaatcttcagctgcgggtggctgacgtagtgttctttgatcgtgattttttgtatccattgagctttttttcgaggttgacactggctctacggccttgtattaagaactagctcagttgaatgacgagatgctgcagctagtgcaacattttttttaaagtttgagaacgtatccgcccaggcatgcgagtcctggatcctaactcctagcgggctgagatagcactagcacatgcgcagccgaattacaagagcgtggaacatgcacgaaactttaaataggaaaaaaaagaaagaaa

SEQ ID NO: 86 - DNA, 1579 bp, Brachypodium distachyon
tgactcctcttccccgcaaattcctcaccaaaccacccaaaaggactaaaccctcctctccacgatgtccgccgccgccaccgccggccccaactccatcctcctccaccggcccacctcggccgggcccgccgtcgcctcctccatccgcctccccgcacgcgcatccaaggtctcctgcgccgccgtcgcggcgccctcctccccccatgccctcacgggcgccggcgagcgcggggtgtacaacttcgcggcggggccggccacgctcccgctctccgtgctccagaaggcgcaggcggagctcgtcgactaccgcggctccgggatgagcatcatggagatgagccaccgcgggaaggagttcgacgccgccatcaagaaggccgaggccgacctccgcgcgctgctcgccgtgccggacacccacgaggtgctcttcctccagggcggcgccaccacccagttcgccgccgtgccgctcaacctctgcgccggcgcctccgacccggtcgacttcgtcgtctccggatcctggagcgacaaggccttcaaggaggccaagaagtactccgccgcctccgtcgcctggtctggcaaggacggcaagtacaccgccctcccgcaattcgacgccatcaagcagaacccggaggcgaggttcctccacatctgctccaacgagaccatccacggcgtcgagttcaaggactacccggagcccaagaacaagtccggcatcctcgtcgcggacatgtcctccaacttctgctccaagcccgtcgacgtgtccaggttcggcatcatctacgccggcgcacagaagaacgtcggcccctccggcgtcaccatcgccatcgtgcgcaaggacctcgtcggcaacgcgcagcccatcacgccggtgatgctggactacaagacgcacgccgacaacgcctcgctctacaacaccccgccctgcttcgccatctacatctgcgggctcgtcttcgaggacctgctcgcgcagggcggcctcgcagaggtggagaagaagaaccagcacaaggctggcatcctgtatgacaccattgacgccagcggcgggtacttcatctgcccggtagagaagtctgtccggtcactgatgaacgtgccgttcacgctggccaagggagcagacttcgagaagcaattcatcgccgaggcagccaaggagggcatgttgcagctcaagggacacaggtcggtcggcggagtgcgtgcttccatctacaatgccatgccgctctctggcgttgagaagctcgtcacattcatgaaggatttccaagcccggaacccttgatttacccgcggccatgatactctggtatcgcttcagtaggatggtttgctgttcttcataacataagcatgctctctgcaagagctgcatcgtctcgcatatgtgatttccgatcctctgtagtattatggtgactgttttgcaatgctgctgcattttttcctgtttgcgagatctcatttccattgctcaacatagagattggaaaatatcgtattggggaataaaaggtttgatggtcaattgtcctga

SEQ ID NO: 87 - DNA, 1128 bp, Brachypodium distachyon
gagcctcattttgtactaccgccagaagggtctaaaataacccgcggtaaacttccgccgaacttctgaccatctccagttccctttcacctctccgatctctgttccttcgcccaactctagcagagccagggcgcgaccgcgcgaaggaagcaaccaaaacccaaagaaattccaaaagctcccaagggagagagccaggtctcggaggcagaggcggggagcggcgccaaggatccatggatcggccccaggtcgtcagtgagaattatgccaatcctataacatgcctcttccacgtgctcttcaaggcggcggcgctggcgttctacatcctgttctcgctctttgtgaagagcttcgtcatcatctttgttatcaccgtgctccttgcggcgcttgacttctgggtcgtgaagaatgtgagcggcaggatactggtcgggctgcggtggtggaatgagattgacgatgatggaaatagcgtgtggaagttcgagtgcctagatgcggagtctcttgctcggatgaacaaaaaggactcgtggctgttctggtggactctttatttgacagctgctgcgtggatcgtcctcgggatattttcactcattagacttgaagctgattaccttctcgttgttggagtttgcttgactctaagccttgcaaacattgtggggttcaccaaatgcaacaaagatgccaagaagaacatccgggcttttgctgaaaatgctgctcaaaacgccatcacctcccgcatcacctcatctctgcaatcagcattctcagttatctgaagtccatattatgtagaggctcaaatattacatataccagtgtacaacctgtcaaaaggaccagcacctgatatccgcatgagtttttgacatgtacaccaaactggttacttttgattggaacgacactatgacagacaacaacatactggataattccacacttgtctcctacactaatggcatgctttctgcatttcttgtaccctggtgtggcctagaggtctttgaccctggaacctgtcatccaatgcaaaaatgttattttcttgttgatgttttgctaaagacatgcaatatgttctccttaattttattcatcaag

SEQ ID NO: 88 - DNA, 3151 bp, Brachypodium distachyon
cggtcccggggggctagtggaactgttgggcgacgggaaggggaaaagaagattattgctgtggttgggcagcctcggaacagtttcggctgataaaatggagtcgcatgatggcgtggctgatgacttgccaccaccaccacctctgccgccaagcatagagcctcttaaacctgaggaagctgatgacttgccacctccaccaccactaccaccaaacgttgagcctattaaagttgaggatgcaaagaagcctaggaggacgctgatctcacgtcctgggtttggcaagaatgggaagccgatacagcttgtgacaaaccattttaaagtttccttgaaaacaactgatgagttctttcaccattattatgtaaatctgaagtatgaggatgacaggccagttgatggaaaaggagtgggtagaaaagtcattgataagctacaacaaacttatgcatctgagcttgcgcataaagattttgcttatgatggggaaaagagtctttttaccataggtgctctaccacaagttaacaatgagttcgttgtggtgcttgaagatgtttctagtggaaagactgctgcaaatggcagccctggaaatgacaactctccaggaagtgataggaaaagagtcagaaggccatatcagactaaaacttttaaagtggagctcaactttgcttctaggattccaatgagttctatcgcgatggctctgcaaggtcaggaatcagagcacacgcaggaagcaattcgggttattgatatcatattgagacaacacgccgccaagcagggttgccttttagtccgccaatcctttttccataacaatccatcacaatttgtggatctgggaggcggtgtaatgggctgcaggggatttcactcaagcttccgagccacaaagagcgggctttctcttaatattgatgtatctacaacaatgattgtgaaacctggcgctgtcgttgattttctaattgccaaccagaaggtagatcaccccaataaaattgattgggcaaaggctaagcgtgcactgaagaatctaaggataaaaacaagtccagcaaacacagaatttaagattgttggactgagtgaaaggaactgttatgaacaaatgttttcactgaagcaaaggaataatgggaatggtgactctgaagccatagaaatatctgtttatgattactttgtgaagaatcggggcatagagctaagatattctggtgatttcccctgtatcaatgtggggaaaccaaagcgcccaacatattttcctattgagctctgctcgcttgtgcctttgcaaagatataccaagtctttaagtactctccaaaggtcctctcttgtcgagaagtcgaggcagaagcctcaagaaaggatgtctgttttgtctgatgtacttaaacgcagcagctatgacacagatcccatgctaaaggcatgtggaatttcgatagctcaaggttttacgcaagtgcctggtagggtactgcagccccccaagctcaaagctggaaatggtgaagatattttcacaaggaatggccgatggaatttcaataacaagaggcttgttagagctagctgtgtggaaagatgggcagtggttaacttttcggcacggtgtaactgcaatgatcttgttcgagacctcatcaagtgtggaggcatgaagggcattaaagtagatcagccttttgacgtgtttgaagagaattcttcaatgagaagagcacctgctccaaaaagggtggaggctatgtttgaaacagtgaagacaaagcttcctggagcacctaagtttttgttgtgtatccttgctgagaggaagaattcagatgtttatgggccttggaagcgaaaatgtctagctgaatttgggattgtcacacaatgtgtggccccaactagggtcaatgaccaatatctgacaaatgtcctgctaaaaataaatgcaaagcttggtgggatgaattctttgctgcaaattgaactgtcccctgcaatccctcttgtatcaaaggtcccaactatgattttgggcatggatgtgtcccatgggtcccctggacaggctgatacaccatctattgctgcagtcgttagttctcgtgaatggcctcttgtctcaaagtacagggcctcagtgcgttctcagtcaccaaaatcagaaatgattgattcactgtttaagccacaaggaactgaagacgatggccttattagggagtgcctaatagacttctataccagttctggaaaaagaaaacctgatcagattataatcttcagggatggtgttagtgagagccaatttactcaggtgctaaacaaggagttagatcaaataaatgaggcatgcaaattcttggatgaaagttggtcccccaaattcacactaattgttgcgcagaaaaaccaccacacaaagtttttcatccctggatcaccggataatgtccctcccggcactgttgttgataacgtagtttgccatccaaagaactatgatttctacatgtgcgcacatgcaggaatgataggaacaacaaggccaacacattaccatatcctgcatgatgatatacactttaccgcagatgatctgcaggatctcgtgcactcgctctcttatgtgtaccaaagaagcacaacggccatatcagtagtctctccaatctgctatgcccatcttgctgctgcccaagtgtcacagttcgtcaagtttgatgagatgtctgagacgtcttcaagtcagggaggcggaggccacacctctgcaggcagcaccccagtgcaagagctgcctcgcctgcacgagaaagtcaggagctccatgttcttctgttgaagcagctgcctgtctctgggcttcttctggtggatggttggtctttgatgttaaatctgtagcggtcgtcgtaacctgtaacacctggtccttgggatgtttccttttgctggttgccgcacttggtgcctcagtacctttggattctgccgttaggatgtgttgaacctttacttctgaaccttatgatttgctttgtgttggtctgtcttctgcttgcttgatttgctttgtgttatgtcttgtgattctgtctatattatgtcttccgaaacttga

SEQ ID NO: 89 - DNA, 1127 bp, Setaria italica
cgctcgagcacaagcatctcatctgccggcggcgctctcttctctttgcgctggtagtcttcttcggaaacacaggagaagaggggagagaggaagagagagagagagcaaaatgatgagcggcaaggctctccttgtcgccgtgctcctggtgggcgtcgcctctcggtgctctgccagcaggggcctgcagggagatcacgtcgctgagcagaagtacggtggcggtgggtacggaggaggcggcggcgggtacggcgggggaggcggtggcggtgggtacggtggcggcggcggcggcggcggtggcggtggcggtgggtacggaggcggcggtggcggctacacgcccggctactccggcaccggaacctgcgactactggaagagccacccggacgcgatcatctcgtgcatcgggtcgctggggagcatcctgggctccttcggcgacgtgtgcagcgccttcttcgggagcaagctgcagacgctgcaggacgcgctgtgcaacacccgcaccgactgctacggcgacctcctccgcgagggcgccgccgcctacctcaactccatcgccgccaagaagtacgcctactccacgcagcaggtcaaggactgcatcgccgtcgcgctcacctccgaggtcgccgccgccgcgcaggccgccatgttcaagaaggccaacttcgcctgccactacttatgatgatgaagcttccatcgtcagcgtagtcgtcgtgcttgttaaataagtccgtgtgtgcatgatgatggatgcaggtccagacgtgtctccccggatcgaggggccttatattagtttctgcgcgtcgtcttcacatggccatgatgatgcatgatgccgtgccgtctcgttgtctgcttcgttcttcagtatagtgatgcttcccttattgtcgttgttgctgatgtgagaaataagatgagttggttggtagtgaaacataacggtggttgttcttacgaactgcatgtgtactcgcgctagcttgtttctgtcagtgtcagcactggtggttgggatgtaatcgtgtacatgggatgtaatccacgtcaggatttccttatttcctctcgcaaaaaaaaaagatttccttatttccatg

SEQ ID NO: 90 - DNA, 2527 bp, Setaria italica
catttcgtccccaccccggcccccagatctgctccgccgccaccgacacctcctcctccccttcctccggcgagctcctcgccggagcagggccaccaccgccactcccaacccccgccgccgcccagatccgcctagaacccaaactcgaagcccccgatccagatccaaggccaggcgatggcacgcctcggcgcgctcctcctcgtcgccgtcgcggcggcggcggcgctgctctgcgcgctgccgggcgcccggggattctacctcccggggagctacccgcacaagtacaaccccggtgagccgctcagcgtcaaggtgaactccctcacctccatcgacaccgagatgcccttcagctactacagcctccccttctgcgtcccgccggagggcgtcaaggacagcgccgagaacctcggcgagctcctcatgggcgaccgcatcgagaactcgccctaccgcttcaagatgtacaccaacgagtccgacgtcttcctctgccgctccgccccgctcgcccccgacgccttcgccctgctcaagaagcgcatcgacgagatgtaccaggtcaacctcatcctcgacaacctccccgccatccgctacaccaagaaggacgactacttcctgcgctggaccgggtaccccgtcgggatccgcgtcggcgtcgactactacgtcttcaaccacctccagttcaccgtcctcgttcacaagtacgaggacgccaatgtcgcgcgcgtcatgggcgccgccgacgccacagacgccatccccgccgggggcaaggacgggggctcctcctctggctggatggtggtcggcttcgaggtcgtgccgtgcagcatcaagcacaacccggaggacgtcaagtcgaccaagatgtacgaccgctaccccagcaagatcaagtgcgacccgaccaccgtgtccatgagcatcaaggagaacgagcccattgtctacacttatgaggtgtccttcgtcgagagcgacatcaagtggccgtcgaggtgggatgcctacctcaagatggagggggccaaggtgcactggttctccattctcaactccctgatggtgattgccttccttgctggtattgtgtttgtcatactgttgaggactgtgaggcgtgatctgaccaagtatgaggagctcgatagcgaggcgcaggcacagatgaatgaggagctgtctgggtggaagcttgtggtcagtgatgtattccgtgcaccaagcaacccaatgctgctctgtgtcatggttggggatggcgttcagatccttgggatggcggtcgtgaccattctgtttgctgcacttggtttcatgtcccctgcctcgcgtggtaccctgatcacaggcatgcttttcttctatctggtcctcggaatcctggctggatatgctggtgttcgtgtatggaagacgatcaagtgcggggatcactctgggtgggtgggtgtttcgtggcgggtggcctgcttcttccccggcattgccttcctgatcttgaccacactcaacttcctgctgtggggaagccaaagcaccggtgccatccccttctcattgttcgttgtgctgcttctgctctggttctgcatctctgtgccgctcacgcttgttggtggattccttggtgcgaaggcaccacacatcgagtaccctgtccgcacgaaccagatcccccgtgagatccctcctcagaggtacccatcctggttgttggttcttggtgctggcacactgcccttcggcaccctattcattgagctcttcttcatcatgtcgagcatatggatggggcgtgtgtactatgttttcggattcctcttcatcgtcttgctgctcctggttattgtctgcgccgaggtttcactggttcttacttacatgcacctgtgcgttgaggattggaagtggtggtggaaatctttcttctcatctggatcggtggcaatatacattttcttgtactcgatcaactatctcgtttttgacctcaaaagcctgagtggaccagtgtctgcgaccctctacattgggtactcactcttcatggtgattgctattatgctggcaactggaacggttgggtttatttcttcattctgctttgtccactatcttttctcatcggtgaaagcagactgagtttattcctactgaggagtcaatcactcaattgagaggtgagcataatggacattgaaaagtttgtagtcacaaaaatcttagttcatgtcatcttttggtatacagagcctgaataactattgtaatgattactagggttcatcaatggattttatgaagaggtgctagcagcatgcacgatgtaatagaatgaattgctttattcacatgttgtgttattttagttgcttagtatcatatattcttcaagttacttttagtgatattgcccctggactggcagatccatttatctccttatgctaatagatccttgctagttgctgcaaattacgatgatatgatattgccttttgtc

SEQ ID NO: 91 - DNA, 1164 bp, Zea mays
ggccactgggcctttcgtgttgggccatccgagactggaaagtggggcccacgaggcgtatcgatcaagcaccgtccactctcacatcaaaggcggaggtgagctccttcggctctgcgcctttgcagttgcggataacggggaggaggcggagcgaccaacggcacaggcaccatggcgatgcgagcagctacagcggcggcgacaggcttcttctctccatccaccgtccctccgaggcgcttctcgtccgttacaccgccggcgtcactctgcaccgcgcgctgcatccagcgtcaccgtctccgcgccttcccaagcttggaaatacctctagaggaactcaacccatccgtcgatctacttaggagaactgcggaggccgttggcgatttcaggaaaacgccaatctatattgttggtacggattgcacagccaagcgcaacatcgccaagctgcttgcgaattccataatataccgctacctcagcagtgaggaactgcttgaggatgttcttggtggcaaggacgccctcagagccttcaaggaatctgatgagaagggttatcttgaagtcgagaccgaagggttaaagcagctcacgtccatgggtagccttgtactgtgctgtggagatggcgccgttatgaactcaaccaatctagggctgctgaggcatggtgtctccatttggattgatgttcctcttgaaatggcagcaaatgacatgttgaagagcacgggaacacaagctactacagatccagactctttttctcaggcgatgagcaagctccgtcagcggtatgatgaactgaaagagcgctatggggtttctgatattactgtttcagtacaaaatgtggcttctcagcgggggtacagtagcattgacttggtgacgcttgaggacatggtccttgaaatcgtgaggcaaatcgagaagctgatccgtgcaaaggagatgatggaagctgcagggaagccattctaaacaagatacacatacacaatagttctgctccggcatacctattttctggccagttaccagacctccgatgcttcgctgttcaagaaaccgattgcagttgcctacggctcaaagcacaagcgcgtgaaatctaaggaactgaatctggttgttccactcgaatatgct

SEQ ID NO: 92 - DNA, 1584 bp, Zea mays
aaactttaaaagttttattgtcaagaatgctatagaaatgattcaaaaatcaaaatcaataaataagggattcgaaatggaagggacttagaaattaaaaataattgtcaaaaatgggatttgaaccaatgccctttcagttcggtacctaaaactgatactttaaacactcgaccatcttaactagttgacttacatgcagattattaaaataatagtatattacatcattacgtttggcaaaacatctgttctcctacttaaacagaaaggacagaaccctgagccggaacaaaatggcggcgctcataaaccctatataccgccgactcgccgccttcgcctgccgccggatctctgcaccggcggtagagaagcccgtgctgcccctcgtgtatcaccggaacttgcagcaaagacacaattccagtttggtggatgcgagtggaggattcagcgagatgcttgcctctacacggaggtgctatgtatttggaggcaaaggtggtgtggggaaaacaagcatggcggcgtcgcttgctgtgaagtttgccaaccatggtgaaccaacagctattgtttcgacggaaccatctccgtcactcggtgatttatttgaacaagacatgggtgttggcggcaaaactgtacgcatcactggatttgactctctttttgcagttgaggctggtcagttcaagataaagggagaacctgaagatcttggatcttttatcaacaatttacttggaaagatggggcttggaacacattctgatattatgtctatgattagagagatgctggatggaatgccccctggacttgaagaagcgcttgtactatcaaaggtgataaaatctattgacgtgcaagaggccgatatacttcggcgtttagtgctggatgctccatccactggacatacacttaagcttctgtcagcttctgattggattgaaatgttccttactttgagcattaagggcataaaagtggcttcgtccatgccatcgtttaatatgtatcttgaggacgtgcaattcatctctgccaggctagaggaactaaggcagcaggttcgcagagtgcgtgagattttgtttgatccacaatcaacagaattcatcgttgtgacaattccaacgatgatggcagttactgagtcatcaaggtttcacgagtcattaaagaaggatggtgcacacacaagaaggctcgtcataaatcaggtgttgccaccgtctgcgtcggactgcagattctgtgctgcaaaacggagggaagaagcacgtgccttccgtgcgatactggaggaccgagaactcggcggcctgaagctgatccaggctccgctccttgatatggaggtgaaaggcgtccctgcactccgattcctcagcgattcagtgtggaagtagcgagaaacactaggtcaaataaaagattaatctctgtcggtctgttcggattctttcatttggttggagttagaatctagttcatgaatttggcctagaatctggcattcgaccacgttctatcactcttctcaagtatagacctgtgtcaaattcagagggc

SEQ ID NO: 93 - DNA, 1375 bp, Zea mays
cctgttctgtccatctctaccgttccattccaattccatccccggaaagcgcaagccgcgggagagcggccggcgtacgtaccacgaggaccgccagcccagggccatggccgccggtctgtccggcgccgcgatgaccggcttcgtcgccaagaacccgctgctggcggccgcggcgcgccgcagggcgctgcctcccctcgccgggcgcgccctgccgttctcgccgctcaccaccgccagggccccgcgccgccgcgggctcgggaccgtcacgtgcttcgtgccgcaggacacggagcacccggcggcggcaccggccccggtcgctcccgtgccggagacggcgctggacgaggaggccagggccgcggcggcgcggcgcgtcgcggagaggaaggcgcggaagcggtccgagcggcgcacctacctggtggccgccgtgatgtccagcctcggggtcacgtccatggccgtcgccgccgtgtactatcgcttcagctggcaaatggagggcggcgcggtgccggtgagcgagatgttcggcacgtttgcgctctccgtcggcgcggcggtcgggatggagttctgggcgcggtgggcgcaccgggcgctgtggcacgcctccctgtggcacatgcacgagtcgcaccaccggccgcgcgagggcccattcgagctcaacgacgtgttcgccatcgtcaacgccgtgccggccatctccctcctcgcctacggcttcttccaccgcggcctcgtgcccggcctatgcttcggcgcgggcctcgggattacgctgttcggcatggcctacatgttcgtccacgacggcctggtccaccgccgctttccggtcggccccatcgccaacgtgccctacttccgccgagtggctgccgctcacaagatacaccacatggacaagtttgagggcgtcccgtatgggctcttcctgggaccaaaggagctggaggaggtcggtggcctggacgagctggaaaaggagctcgcgcgaatcggccggaccatctgatggattcgtccggattccggcgcggcgatctccgctccgctccgtgattccggcgcagcctcattgtcggtggggagcccacgaccagaacctccagaagaccagaagggatttggtttggatgcgcgagcgtagatcttgacctgcatttcggatggtctgtggagggctggacagctcgtacctggagatgtctagtgccatggaattacttttcttttctttttttcctgacattttcttatggctaggattctgtatataacttgtagagacatgttatgaaccaccagctcaatgaagctaaaaattccggtggttggaaacagcgctgaaaaatca

SEQ ID NO: 94 - DNA, 2117 bp, Zea mays
gccccacttcttccaatcataaatcctggcggccaccgtctacttccccgcagcagtccgtaccggcaggtcccggtcccggtcccggtcattgcaagtttgcaacacggtcccgcaccgctctcctatcgtctcgtctcctcggaccacccagtgggcacggcacgccagttgccgacgcgcctcctgccacgggcgctcccgcgggatttcagttaccggccgcttcgtccccggagccaggcaggcaggcaggcggcggcaatgctgctgggctcgcccgtgaagcgcctgctgcggcgggcggccaagcggcggctggagaaggccgagctggcgtggctggccgccgcggcgctgctgctgctgctgctcctcctcctcggcgccgcctcgctccgctgctcggccgccgcgctggtggccgcgcacgggaggctgtgggccggcggggtctccatcgcggcatcggcggacgcggacgcggaccaccggcccgtctccgcgcctcgtgctgcggcggcggggagtggtggcggcggtgaggccgccgccgccgccgacgacgaggaggaggaggagtgcgacctgttcgacggggagtgggtctgggccggcgccggcgccggcggcgggtacccgctctaccactccagcgactgcccgttcctcgacgtcggcttccgctgcgccgagaacggccgacccgacgcgtcctacaccaagtggcgctggcagccgtcgcgctgccatctcccccgatttgatgccaaaggcatgctggagaagctacggaacaaaagagtggtttttgtcggtgattcaattggaaggaaccaatgggagtctctactttgcatgctctctagcgctgttcataacaagagctctatctatgaagttaatgggagtcccatcacaaagcacatgggtttcttgattttcaactttagtgactacaattgcacggtggaatactacagatccccttttatagtccttcaaggccgtgcgccagcaggagcccctgagattgttaggtacagtattcgagtggatgcaatggattggatgtctgaccgcggcaagtggaaggatgctgatgtattgatcttcaacactgggcattggtggaacaatgagaaaacaatcagagggggtgcctactttcaagtaggagatgaggtcaaaatgggcatgaatgttgcagatgcttacagaagatcgatacagacattgtccgattggcttcgcaaagaagttaacccaagcaagactcatgtcatctaccgcacatatgctcctgtgcatttcagaggtggtgactggaagaccggtgggagctgccacttagaaactcttccagatgtgatgccagtgaagtccctggacgaatgggccgacttgcttcagcccgtggacgatttcctagggagcaacctcagatccaagctggctggattagacctgcttaacgtgacgagaatgacggcgcagagaaaagacggccacctctcagtatacctgagcccctcaggacctgtgccccgctacaaacaggattgcagccactggtgcctgcccggagtccctgatgcctggaacgagcttctctacgcccttgtcatgaggaggcataagaagatgggtcagaatgcttcccttgctggcgctaggacacccaacactgaagagggagatggagatgtcttcagccgaccatcatgacaaaacgagcttcatagccatcctgggcgatgggttgggacacaccagttagtataggatgccagagtggcgaaacacaattttggaccatgggtgttgtttgcaggaagctgcgtaccgccctgttgtgtgctgtgtttgcatatggtgaggttagtgaatcgctgagctagaggccagtggtagtatagctttgtgtggtggaggcaaattgtatggctcgtggaattggcattggcagtgtacctagctagctagggttactacagcgaatggtgtaaatatgtagctgcggaagtgggggggtggttttaactgagacctcacagcagttacgaggtgcatgttcatgtgattcaataatttctaagctgtacaattgttgctca

SEQ ID NO: 95 - DNA, 2326 bp, Zea mays
gatccacaaacccggcggcgacattcctcgttgccttgcctcactcgaagcaaagcccgtattttccttcccttatatataaactattaaaataaaacatctcatcttttgtgcgatgcgacctttcccgtccctcgcagcaccgatcctgccgtccacctgttaataaatcgcctgagtttagtcgaaacacaatcgttaaaatgcagtaaagtaattcacgacccccgggcgcccccgtctccgctcctttattaatatcgccgcggcctcgcacctccatctgttctatatcgccccattgctcgctcgccaagagttcttcttgttaggcaaggcaaaagcagaagcaaaaaaagaaaggtcttgttgccgatggggagctcagggttctcgtggacgcttccggaccaccccaagctccccaaggggaaaccggtggctgtcgtcgtgctggacggatggggcgaggccaaccccgaccagtacaactgcatccatgtcgctcagactcctgtcatggactcgctaaagaatggcgctcctgagaaatggagactagtgaaggctcatggaacagctgtgggtctcccatctgatgatgacatgggcaacagtgaagttggtcacaatgcacttggtgctggtcgaattttcgcccaaggtgctaagcttgtcgatcaagctcttgcctccggaaagatttatgatggagatgggttcaactacatcaaagaatcttttgaaagtggtactcttcaccttattgggttgttgagtgatggtggtgtccactcccgtcttgatcaactgcagttacttctgaaaggtgtcagtgagagaggggcgaaaaaaatccgtgtgcacatccttactgatggacgtgatgttttggatggaagcagtattggtttcgtggagaccctagagaatgatcttttggagcttagagcgaagggtgttgatgcacaaattgcatctggtggtggaaggatgtatgttacgatggaccgttatgagaatgactgggatgtggttaaacgtggttgggatgcccaagtgcttggagaagcaccctacaaattcaaaagtgcacttgaggctgtgaaaacactgagagcacagcccaaagccaatgatcagtacttgcccccatttgtgatagttgatgacagtggcaatgctgttgggcctgtattagatggtgatgcagttgtcactatcaacttccgagctgatcgcatggttatgcttgcgaaagcactagagtatgcagattttgacaactttgaccgtgttcgtgtccccaaaatccgatatgctgggatgcttcagtatgatggtgagttgaagcttccaagccgttaccttgtttccccaccagagatagatagaacatctggggagtacttggtgaagaatggcatccgcacctttgcttgcagtgagacagttaaatttggccatgtcacatttttctggaacggtaaccgttcgggatactttgatgcaactaaggaggagtatgtagaagtacctagtgacagtggtattacattcaatgttgcacccaatatgaaggcgcttgaaattgctgagaaagccagggatgctctcctaagtggaaagtttgaccaggtacgtgtcaacctgccaaatggtgacatggttggtcacactggtgatattgaggccaccgtagttgcttgcaaggcagctgatgaagctgttaagattattttggatgctgtcgagcaagttggtggtatttaccttgttaccgccgatcatggcaatgctgaggatatggtgaaaaggaacaagtctggcaagccgttgctcgacaagaatgaccgtatccagattcttacctcgcatacccttcagccggtcccggttgccattggaggccctggccttcaccctggagtgaaattccggaacgacatccaaacccctgggctcgccaacgtagccgcaaccgtgatgaacctccacggatttgaggcccctgctgactacgagcaaaccctcattgaagtggctgacaactaaacactggccacctgtgtccaattttggttatatgtagttctgagaatggacattcaataatttatgtttgcaagcacgttgctcaaactcaccaaaacatcgagggatgccttttgactttggcatttacagcattttcgtttggctttaatccttatcggtttctattgcttctgtttcatttctatgtatcatagctgcagtagttcgaacaactgtctttgcacaactcattagatgctctatttatataccgttgacgattgcctcc

SEQ ID NO: 96 - DNA, 1353 bp, Oryza sativa
cccagtgccaagcatccacggcgatggccccccgctcgccgccaccgtgtcacgccggcagcctcaggttcgcctgacgacgcaacgccaatgccaagaaccaccaccaccgcccatgaaacctggagacgcgccaagagtacgcagaggctgagctgagccaggacgacgtacgacgacgacgactatggcggcggcggcgttgctgttggcgccagtggcggcgccatggtcgcgtgtaccgtctgcagggaggagggttcggtgcgcggcgactgcgccggcgccgatgggggagaagacggagtaccgggacgggccggtggagcgcgccttcatggggctgttcgcgcgcaagatggagaagtacgccgtcgtctccagctccggcgggaaggggaaggagaagaagaaggagaagagctcgaggtcggtgtgggagtgggactacgagagcttcgtggacgtgtcgcggcgggtgatggtggggcggacgcgggcgcagcagcaggaggccgtccgcgaggtgctcctctccatgctcccccccggcgcccccgagcagttcaagaagctcttcccgccgacgaggtgggcctgcgagttcaacgctgccctcaccgtccccttcttccactggctcgtcggcccatcagaggttgtggaggttgaggtcaatggggtgaagcagaagagtggagtgctgataaagaaatgcaggtacctggagaacagcggctgcgtcggaatgtgcgtcaacatgtgcaaaattccgacgcaaaacttcttcaccaacgagttcggactccctctcaccatgaatccaaattttgaagatatgagctgtgaaatgatttacggccaagtgcccccacccttggaagaagacccagcatcaaaacagccctgctatgccaatctatgttccatctcaacaccctcagcgccaatttgtcccaaacttcagacttagagcacatcacatcaatgctgaattcagatgttggacgttttcagtttcttatgaaaacgctcgcaccacagctcatagcccatagtagctacgccaatcgacagttcatacgttgtaccactctttatcatttggtatatagatagacagatcacagaaaaccgtcagtgatctccttgcctgggaaaattaaggctttgcctttgagctcgagaaatttccacataaatattttactagttagatagtttccgcaataatcccttatttattcctcatgtaaaaaaatgcagtgcttgtatacagaaattcttgtgcccactacctgtaattaaagatccatcatggtattaatatagtacaaatgcaatacttcaaat

SEQ ID NO: 97 - DNA, 1417 bp, Glycine max
aaagtattttgaaatattttcaaaagacctatatttggtaagccaatcaaattggacattaataaaggaatggagagggcagaacaaattggaggaggcaaagctgtggccacagtcctagccattggcacagcaaatccacccaatttcatccttcaggaggattatcctgacttctactttcgggtcaccaatagcgaccatttgcaccgcttgaagcaaaagttcaagcgcatttgcgagaattcaaagatagaaaagcgacacatagtccacacggaagaatacctaaagcagaactcagacagcggcacgtacgatggccttcccttggagacacgacagaatgtccccacggaacaggtaataaaattaggtatggaagcagcatcaaaggccattaaggaatggggcgaacccttatcagaaatcacacacctcatcttctacaccacttcttgcttcggctccgttcccggtcctgaccactacctctccaaacaacttggactccgctcaacggtcaaccgcctcatgctcttcagccacggttgccacgctggcggcaccattctccgcgttgccaaagatatcgcggagaacaaccctggctcacgtgttcttgccgtctgttccgagaccatgtttgcctcgtttcgcgctcctagcgaatccaacgttgaggttctcgtaggacaggctctgttcggagacggtgccgccgccgtcatcattggcgcggatcctaagcactccatcgagcatccactcttcgaactcgtgttggcttctcaaaccactgtgcctgacaccgagaatgcgatcaaaggaagtcaacaagagaataggttggtttattatttggataaggacattcccaatattgtaactaacaatgtgaagaagtgtttggttgatgagttgggtgaagttggtttcgtcgacgaaattgattggaacaagtttttctatgcaattcatccgggtggggctgttattgtgagtggggttgaagagaagctagggttagagaaagagaagctgagtgcgacatggcacgtgctgagccaacacgggaacatgtggagtccaactgtgatttttatcttggatgagatgaggaacaggtccaagactgaggggaagagcacaaccggtgaagggttagagtgggggattttattagggtttggtcctggtgtggcaatggaaactgtgcttttacgtagttatccatgttgataaatagttacaaggagttacaaatactactactgctactcatgtttatgtatttatgggtattttttttaagaataaatgtggtaactttcttagtaagagaaattaaatgtaacataatcgttgtatgtcacgattgttttaagagtttggatattgtaataatgatttagac

SEQ ID NO: 98 - DNA, 1601 bp, Triticum aestivum
atcactcactctcacagccccccagctagctagtgccctctgcatctcgtgctcggagaacttagatcagcacagagcgagggtcgattagcagctgatcggcagatcatgggcgtggagggctgctgcaacaagaaggtgatggaggaggaggccctggtgaagaagatcaccggcctcgccgcggccatcggcgagctgccctcgctgagcccctcgccggcggtgaacgcgctcttcaccgagctggtgacgtcctgcatcccggcgagcaccgtcgacgtcgacgcgctgggcccggaggcgcaggagatgcgcgcccgcctcatccgcctctgcgccgacgccgagggccacctggaggcgcactactccgacctcctcgccgcgcacgacaacccgctcgaccacctcaccctcttcccctacttcaacaactacatcaagctcagccagctggagcacggcctcctcgcccgccacgtcccgggcccggccccggcccgcgtcgccttcctcggctccggcccgctgccgctcagctccctcgtgctcgccgcgcgccacctgcccgacgcctccttcgacaactacgacatctccggcgaggccaacgagcgcgccagccggctggtccgcaacgacgccgacgccggcgcgcgcatggcgttccgcacggcagacgtggccgacgtgacgaccgagctggcgggctacgacgtggtgttcctggcggcgctggtgggcatggcggccgaggagaaggcgcgcctggtggagcacctcgggaggcacatggcccccggcgcggcgctcgtggtgcggagcgcgcacggcgcgcgcgggttcctgtacccggtggtggaccccgaggagatccggcgaggcgggttcgaggtgctcaccgtgcaccacccggaggacgaggtgatcaactccgtcatcatcgcgcgcaaggcggcggcgccagcagccgtcgccgccgacggcgacgtgccggtgaacaacggcggcatgccggcccagtgcgcggtggcggtgagcagaccgtgcctgggctgcgcctgcgagctggggacgagggcgcaccagaagatgaaggagatggccatggaggagatggaggcgtaggccggccggcactccggcagacaccgtcaccgtcatcgcccagagcacggtgatgcatgaactcacccaccgattaatatttgcccgattaatcaccgaccgatacatacatgcatggtaataattggtttgtcctcatgcatggatggatggacgtggctacttatttaccataattattaatccttgcctgcgtatggctggctggattatttattttctaccgtaatcgtgccgtgtttgttttagcaatcgtctgacagctgctatatgcctccgggtttaacatagaggagggggatgatatgtgtcgtgttgtggtgtggtgagatcgagtcgagtcgagttgcctgcctgctagctgttgttgtaataagtgtttttgacactctatatgactcaagtgatccatcatcaccaagaagcagtgtaacaccgtaccgatgctttcctaattgattcccttgttt

SEQ ID NO: 99 - DNA, 1344 bp, Triticum aestivum
acggacggcatagcgtagggaggggatccatccaacagagcagagcagagtagcgaccggtcggagcagagcagtggcccaccgggtcggttgacatggattaccaccagcagcagcagttcctgatgcccccgcccgcgtcgctgccggcgcagcagcagcagctgtgcgcgccgatgatgggcatggacatggagatggagatggaggagcagctgtgcttcgtggggaggggcggcgggggtcgtggggcggagaggaagcggcggttcacggaggagcagatacggtcgctggagtccatgttccacgcgcaccacgccaagctggagccccgggagaaggcggagctggcgcgcgagctgggcctgcagccgcgccaggtggccatctggttccagaacaagcgcgcgcggtggcgctccaagcagctggagcacgacttcgccgccctccgcgccgactacgacgccctccactcccgcgtcgagtcgctcaagcaagagaagctcgccctcgccgcacagttgcaggagctgagcgagaggctgagggagagggacggcggcggcggtggcgcggcgaccgccaccgccagcagcagcagctgcaacggaggcggccgggagctggacgacgacaagaggaacgtcgtcgacgtcgagccccccgagagctgcgtgctcggcgggacggcgtgcggcacgccggcggacgtctcggcgtcggtggagtccgagtgcgacgaccacctccactacgacggggcggtcttcccggagtccttctgcgccacgccggagctgtgggagccgtggccgtggccgcccgtcgagtggaacgcggtggcttgaggccctggagtagtatatacatgttgtgaacccacgtaggcggcttgtgtgtgtagcttcacgtacgtacgtgcatgttgtgctcgatttcccatctggttggggatacatgcgagagaggcgaacgggggcgcggcaatgacgggtgggtccgtgtaagacagagggtgatgcacctgaatccagagaagtgacctgaaaccatggaggcgaccgcccagccaatgggatcagggattcggatgctgctaaaatgttgcgagttagagatcattggtggagtttgcatcagctgttctgtttgttgttgcacccgctgtgaattcaaatgttggaggtaggaccgatccatcaattgataatactacaaaatactgcttctcaactttagaatctcgtgtggagcatcggcagtaggttcttgtctaggattgtccaaacgttcatcatggttagccgtttcgctaattaactttctgcagcccgcttc

SEQ ID NO: 100 - DNA, 608 bp, Hordeum vulgare
ggctgcagggacgtgcagggagccgtcctgctgcggtcagcccgctgttcgcggagctggcggccggcggcgtggacgtggtgcccgtggcgctgcacctggcggtggacatgttccacggcacgacggcggggggcaggaagatgctggacccgctgtacctgctcatgaaccccgtgccgtcgtacctggtgcagttcctcgaccccgtcgagtgcggcggccaggaggcgcgggccgtggcgaacgaggtgcagcggcgggtggcggaggcgctcgggtacgagcgcaccgggctgacgaggagggacaagtacctcatcctcgccggcaacgaaggggtcgtcggcgcccacgacggcggcatgaagaattagctgcagctgatgccagcgaactctattattgacgactagcactacaaagcacaatactgcactacaaagcttaattagcttgttgtcgctgctgatggtgtacagtgcgtatgcatgtcctggctcgtcatggattatgcgtgtcttccggggtgctttgtgaagatatcacactaatacagtgtgcaatttatttatttttgcaatcataatatacagcggttttgcttg

SEQ ID NO: 101 - DNA, 1659 bp, Hordeum vulgare
ggcgattctcctccgccactgccggataacctccggtgccgcagaagtgatggtaagaagtggcgctgctcagctcgtgcactccccactgtcagcttttgcgagtatcattatgccaaggctagcaagggcaagaaaccgccagccgatggggaggtccttgccgtggctctccaacggcaaaagaagaacaagagaaagggaagaaagcgcttaaatctggcgccagaatcaccaaaggccacaagggatctccctaatggattgatgacaatttcaccggggagcagtgggccgctaggctcccctgtgactacaaaggttggagtggatattcccgcaccactccggcggtgctaccgttccaagaatgctgagccagtgcctgttggccctgtgaaggtcgttcctcatgcaatgagtaaagcaaaggcagcacagatgtcatgccaccgttgtgggttgaagaaggtagcacgcgttgtcaagtgcaagaactgtgaaaacaagtacttctgcaacagctgcatcaataaatggtattctgggatgtccaggaatgatataaagatccaatgcccggtttgccgtggctgctgtgattgcaaaaagtgcacccttggtcagaccaagggaggtatgcggaaggaatcaccaggtggtcaagggaaactaatcaggatcaaaatctgcaatcaccaattttacaagcttttacccttgaaacttgaccaggaacagcttgatgaattggaaattgaagctaaaatacaaggaacaaagttatccaatgtccgcgttcaggtagctgaagatgaccagagcgggtcactttactgtaataactgtaagctgtccgtgcaccaagccttgagaagctgcccaagatgcccttttaagctgtgcctaagttgctgtcagaagatacgtgaagggagtatgtcaggcagcacccctgaagataaatttacacaacgactgttgcagcaagagtcagcccatgaggatggcagcataagttgcccttccattgagttgggtggctgtggcgactctctgttaaacttgatatatacatccccatctgatgaccagtcgggggaactaagttcaggagacgagctagatgctccaggcaatgactctggagttaaagatgcacaagatcattcctcgcctttagccgagagtaatggtagtcttgccagattatccggtggtcagcaggaatcgatgtccacataatctctggtgattttgcagcagatacccacccatgcatcttttggtgtgtgagatgggatatggtctgaagtgggtagaggttagagtggcttatttagtgtgattatcggctgattttaggtctgtgacctacctggggatattctcgagtaattgtttggtgttgttcatcttggatttatacattatgtttgttgtcagtgtaaatagggtatgactatttatcatccatgagtcggaagcttgtatcggttcggtcgtattgtggttaatttagaaaactgtctgtactctatcggctattgcagtgttcgagaaagtgagggattctattggattagtcgtctgaaataaaagcgactttgggatggttacattgaattggatttgtgtatcctgatttcctgccctgtt

SEQ ID NO: 102 - DNA, 1866 bp, Hordeum vulgare
gaccgacgggctcatccgcatcaaggtggggcttagcgggatcctgatggtgaagggctcgccctactcccacatgaaccaggtccgggaaaacgaggagatgcacggcaccctcctctcggagaacatcatcggcgtcatccatgaccactatgtcaccttccgcctcgacatggacgtcgacggcgccgacaactccttcgtccgggtcgacatggctcgccaggacaccgcacccggcgagtccccgcggaggagctacctcaaggcaacacgccacgtcgcgagcaccgagaaagacgcaaaggtgcgtctgaagctctatgagccggccgagttccacgtaatcaacccgaccaagaagacgcgtgtcgggaacccggtgggctacaaggtcgtccccgccggcaccgccgccagcctgctggaccccgaggacccgccgcagaagaggggtgcattcacaaacaatcagatttgggtcacgccctacaacaagagtgaagaatgggccggtgggctgttcgtgtaccagagcaaaggggaggacacgctggctacttggtcggagagggaccgtccgatcgagaacaaggacctggtgctgtggtacacgctggggttccaccacatcccttgtcaggaggacttccccatcatgcccactgtgtcgtccagcttcgacctcaagccggtcaacttcttcgagagcaaccccatcctcaagcagcgacccaccatggagaaggatctccccgtctgcgtcgctaccgcgtgagaacatgcaccacaatacatgtgtgctctcgacgtaccgaaggcattacattcaacataccaacactgggatgttgcccggggcatgaggtcgtgcgtaggcttccggaatcaccatggtgtgtccagtacactggggacttggctactcttggctccgcctgtggttggccaatagcctagtatgtatatacagctttatgtttgtgttgtactgtgttttgagtgtggacaatctgaacccatgcgttgttggcttttgaacgtgcgtatgcagctgtacaggcgtgcctacgcgattcttgcttcggccggctacttgacggaacttgcgtaactagcgacacgaataaaactgatcgatggatttgatggctaaaggcccgtgtcgagcctttgctttgtattgcttttcgtttttctggtgttacaatcaacacccctagggtgtcttttatacacgtccacaagggactatggaaatagactaggactaggaatcctaatactactaggactcggtttggctttctttcctaatcctaaagaaacaacatgattaacttctacattcacctccttaatcttgttgcttgacttcacttcttgcactccgactttcctcctcatctcgatgaacttctgtcgactggggacttggtgaaaatatcggcaagttggtctttcgtgttcacatgttgaacctcgatcaacccttcttcaatgcactcccggatatggtggaaccgggtatctatgtgcttgctcctttcgtgatgaaccggatttttgcacaacgagattgcagcttggttatcgatcttcagtgacaccttctgcacctcccgctttgcaagaatagctaggagtcttctcagccacactgcttgacaagccgccgtgcttgccgctatgtattctgcctctcatgaagacagtgccaccaccttttgcttctgagaattccagctaatcggattcgggccaaggtagaaaaccatgcccgttgtgctctttcggtcatcaacttcacctgccatgtcgctatctgaatatccacgaaggatcaatccttcatttccctttcta

SEQ ID NO: 103 - DNA, 1532 bp, Hordeum vulgare
cggcacgagggcgcgcgatgctgctgggcgtggagaggcgccgcaaggacgacggcgtggaggggcggcagcaggaggaggaggaggaggaggagtacggcgcggtgcccatggcctccgtcagatccgacgacgacgcgcgccgaggaggcagcgtctgcgaagaatacaaggacgtggacgtggtgagcacgatgtcggggtcttcgtcctcgctggacaccgggagcgggcaccggtcgcgggactcccactccatgggctcgaggttcagggtgcccgaggaggactcgtgcgattcagagagcgtggcgtccaacttcgagttccataaggagcgaggggcctccgctcggtcagcgcccacggcggtggtcgcaccgttctccaagcccccgccgtcgaagtgggatgatgcccagaaatggatcgccagcccggcgacgaaccgtcctggtagggctggtggagctttcccaaggaagatggagaaaactggctttggtggagggaggctgccgccgacgaaggttgtgccggagccctatccagaagtggagccttgtgcaaagtctgcacctggtgcagaaagtactataattgattcagctgttactttgagctgtgattcatctaccacacttcatagtgccactgcatgcatacctcccccaccaacaggccggtcagtatcgatgagggacatgggtactgaaatgaccccaattgcaagccaagaaccatcccggacaggaacacctgtgagagcaacaagcccggattgctctcggccaactactccacgaaggacattgggtatcaatgcagctggcggtgttatcaaccgcggtgaatgtagcaatgcagatttaagcgaagaggagttgcaaatgaagactaggagagagataatgcttcttggcacccaactaggtaaaaccagcatcgcggcatgggcaagtaagaaggaagaggaaaaggacgcatcactttctctcaagacagtgtcatcagaccaatctgcacaaaatgcaaccgaaatacgtgcagctgcttgggaggaggcagagaaggccaaatacttagcaaggttcaaacgagaagagatcaagatccacgcatgggaagatcaccagaaagccaaaatcgaagcagaaatgagaaaaattgaggtcgaggtggagaggatgcgagcccgtgcccaggacaagctgatgagcaagctcgcgtccacaaggcacactgcagacgagcagcgagctgccgcagagtcgaagagggaccagagcgccgcgaggactgcagagcaggcagagcacatcaggagaaccggccggatgccgccctcgcttggctgctggaactggtgctcgtagccccagaagaagaaaacagcatgtgttgttcctctcaactggtgaaggaaatgaatctggcattgtagaaacttcttctcttttgattggttcagtagatatgtgacacgagaacagatcacctgtgtaactatgtatatgtaagatgtgagcttt

SEQ ID NO: 104 - DNA, 615 bp, Hordeum vulgare
ttcggcacgagggctgcctccgtagcccgcggtgccgccggccgtgtcgcgctcgcgccggctgcatctccatcaccgcgtcgctcgacctcaccgaggacaacgtccggcaggccatcgtcgacgctaaagccgagctggcccagctgttcgacacgtcggtcggcataacaggacaagttgatctggcggagctggacgggccgttcgtgaagctccgactgaagggaaagttctggcacacccgcgccaccgtcgtcgcgcggataggcaactacctcaagaaccgtataccggagattttggaagtggagatcgaagatgaggaccagctcgacgacagccccgcggcttactgagattactgaagacctgaactgaagttgttgaaggacctaatacatataccggaacagattattctagcactttcttcgctagcatgggtaaagaacatgcgagtcattgctgagggcgcctacttttctcagtaccactgggtttggtaggatcatatttttgtaagtgtgcaccgtctgtaccaaacaattcttctctcttaattaatatataaggcaaaaaatttgcctccgtttcgagaaaaaaaaaaaaaat

SEQ ID NO: 105 - DNA, 633 bp, Hordeum vulgare
cacgcgtccgcattattctcccgccaagcttcctatcacaagtgacgtcccggaaggctgtgtgatcatcagagaacacgtccccatctcgaacctcttcacatgtctttggttcaatgaagttgaccgtttcaccgccagggatcaaatcagcttcagcaccgtccgggacaaaataaggtctaaagtcggctggatgccccagatgttcctggactgcgagaggcgcaactttgttgtccaggcataccacagggagctgctagagcagatgatcgcgtccggcaggaacacgcctccgaccgccgtcgagccatcgcggaaaatcaggccgggtggcagcaggagagctcccccgtcgaagaagcctgtcgtgaagcggaaaaaggagaagaaatcgagctcgcggaggcgggtcccgaagccggttacgtgggccatggatgctgtgtgactgacggaggttcacagggatggacggactcctgtcactctatcgatagttgggcgtggccgtgtcgcagctggtgccgctaggggagggagggaaagaaagggggaatggaggattgtaattttttgccggccacgaaatggaatttgttcatagtcaattcttgattgttgttgtaa

SEQ ID NO: 106 - DNA, 416 bp, Hordeum vulgare
gctaatcctctcagtttccttgccgagcaggcaggggggcgaggctcggatggcaaaaccagaatcctctccattcagcctgtgaagctgcaccagaggctgccattgttccttgggagcatggaggacatgcttgagctagaaagctatggggatgtccagcagaaagtcaatcctggatacgatgtttaatgttaagcatgaggtgataccttcaggtattgtagcttacaatgaggtaaccattgtatatggcaaagtctatatttgcaagcacaatgttgtttctgtgtattgttttgtttgccttcttttgcctaggcaattgcagagtactgcataatggaggtcagaaaaatttgctgtagttcactgtggaaacaaaatatgcaatatggctatttgtttgtaacttc

SEQ ID NO: 107 - DNA, 1152 bp, Brachypodium distachyon
catcctgatgtccgtcgcgtccgctgccgccgtccggtccgcgtccggccgccgctgcggcgtcggctctggcctcaacggaggcaataagtttctgatgatgcagaggagagacatcgtgaccaaggggatcgcgctctccgtctgctcctcgctcctctcttcctccaacggcgacgctcaaggattggagaggttgccgttcaaggcggacgggtacaacttctggacatggcggggccgcaggatccactacgtggagcaaggggaagggcagcccatcgtgctcgtgcacggcttcggcgcgtccgcgttccattggaggtacaacatcccggagctggccaagaagtacaaggtgtacgccgtggacctgctgggtttcgggtggagcgagaaggcgctggtggagtacgacgccaccatctggatggagcaggtctccgacttcctcagggaggtcgtcaaatcgccctccgtcctcgtcggcaacagcttagggggattcacgacgctgttcacggcgacggagctgccggagctagtccggggcctcgtgctgctcaactccgccgggcagttcggggaccccaatgcgccgccgcccattgaagcagaggaggaagtgggcgtgttgagcaggctgctcgtcaggccgatcaaggaggccttccagcgggtcgtgctcgggttcctcttctggcaggccaagcagccggccagggtcgagaaagtcttgaaaagcgtgtacaaagaccccagcaacgtggacgactacctcatcagctccatcacggcgccgacggcggaccccaacgccggcgaggtgtactacagactgatgtcgcggttcatggcgaaccagagccggtacacgctggacaggctgctggggaagctgtcgtgcccgctgctgctgctgtggggggacctggacccgtgggtcgggccgtccaaggcggcgcggatcaaggaattctacaaaaactccaccgtcgtcaacctgcaggcgggccactgcccgcacgacgaggcgccggagcagttcaacgcggcgctgctccagtggctcgacacgctggaggagactggcaccggcggcaagtcggccgagcccagcctccaggccgtgtgattctttgcttgcacccg

SEQ ID NO: 108 - DNA, 4350 bp, Brachypodium distachyon
ggggggttttgccttcggcaatggagatggctctccgggcgcagagcccgctctgctcccggagccggccggtgctcgtcgtgcggccggccaacgccgccgctgccctcgcgcagcctattgtgaagtgcagcagatttacaagaagcaggcttgttcgatgcatggtagcaagttcagattatcctaagaggaatccaaggagatcatcaactcctaagcccaaaggcacagcctctagaggatatgctccaagacctgctgcggaatccagcacgaagaagattgaacagagcagcactgatgaaggtgatcttgccagaagcaatgtgatgctcggtagtgcaggaatagagcagacaggtactgcagaagaatcatctgaggtcgacctctcaggaaatgttcccagcagcgaggcactggagggagtgaatgagactgagaatgaggaagagattgaccaaaagctgccaccagcattgtcttccacatccatggatgctgagtcaattagtgaagcagcagatcagacaagtaccgttgaagaagcatctgaggtggacttctcaggaaatgtttctagcagcacggcactggagggagtgaatgaggctgaggctgaagaaaaggtcgaccagaagcagacttcagcattggcttccacctccatggatgttgagtcaattgacagagaacttgaggagtaccgtggcaaaataagtgcactggtggcttcaaaccctgggccatcatctcttgctagcaatcaaggacaggacaaaccaatttttggtgttcatgagcaagacaaatcggtaattaatttccatgagcaaggcatatcaattgttgatgtttccaaacaaagtcagttggctgttggtgtcactgaagaagatccaacgaaacaaaccaccataattggtgaacaggatatcgctgaagaagcagtggaggatatagacagcaaattttttgaggatgggcagcttgctttatcagaagatgatgctgggacaagtaaatatgcgcaagaagagccttcagttgctggtgatcaactgaggatatcggaagatggacatgatgaaccagagattcaagaactggtacagaaggatgttaatcttcaagtgctaaagcgaaggcttgaagagcttgctaatgaaaactactcgatcgggtataagtgttttgtttttcctgaaatagtgaaagctgattcagttattgatctttacttaaatcgtagcatcactgccttagccagtgagtccactattcttataaaaggggcattcaatggttggagatggaacctttttactgaaaaaatgcatagaagtgaactagccggggattggtggtgttgcaagctccacataccaaagcaggcatacagattagactttgtgttctttaatggtgacactgtctatgaaaataacaattataatgattttttcatagaaatagaaagtgacatggatgaacactcatttgaggacttcttggtccatgaaaagcaaagggaacttgaaagacttgctgcagaagaagctgaaagggaaagacaggctgaggaggagcgccggaaggaggaagaaagggccattatggaggcttatagggcacaagcaaaggctgaagttgagacgatgaagaatagattgcagcatgtgttgggttcagccagcagacacatggataatctatggtatatagaacctagcacatataaaggaggtgatagggtcagattatactacaaccgaaacttgagaccactaatgcatagcaatgagatttggctccatgggggttacaacaactggactgatgcactttctattgctgaaagactagtcaaatctcatgaaaaagacggtgattggtggtatgcaaatgtcactttacccaaaagtgcattggtgttggactgggtttttgctgatggaccacctgggaatgcaaggaattatgataacaatggaaagcgagatttccatgctgttgtttcaaagagcatatctgaggactttttttgggtggaagaagaacacaggatatttaaaagatttcaacgagaaagaaaagaaagggaggatgcggatcggagaaaggctgaaataactgcaaaaatgaaagctgagatgaaggagaagactatgagagagtttcttctctcacagaaacacatcgtgtatactgagccactcgaagtgcgtgcaggaaccaccgtggatgtcctatacaatccttctaacacagttctgaatggaagccccgaagtttggttcagatgttcctttaaccgttggactcatccaagtggtcctttgccaccgcaaaagatggtgaatgcagaaaatggttctcacttacaagctaccgtcagggttcctttggatgcatatatgatggactttgttttctccgagtcggaagaaggcggaacatatgacaaccgaaatggaatggactatcatattcctgtgtctgattccatggcaaaggaaccacctatgcatatcgtgcacattgcagtagaaatggctcctattgcaaaggttgggggtcttggtgatgttgttactagtctttcacgagctattcaagatttgggccacaaggttgaggttattattccgaagtatgactgtttaaacttaagcaatgtgaaggatttacactgttgtcaaagttttacttggagtggtacagaaataaaagtatggtttggaaaggttgaagacatctctgtttatttcctggaaccacagaatgggatgttttgggttggatgtgtctatggaaggaatgatgaaagcagatttggcttcttctgtcattctgccctggagtttctccttcagagtggttcttctccagatatcatacattgtcatgattggtcaagtgctccagttgcttggctgtacaagcaacagtatgttcataatgggttgccaaatggtcgggtggtatttaccatccacaatcttgaatttggagcaaatcaaattggcaaggcaatggcgcattgtgataaggctacaaccgtttcgtacacatattcaagggaagtgtctagacatggttctattgctcctcactatttcaaattccatggcattcgtaatggaattgattcagatatttgggatccctataatgacaactttatcccggtccattatacttctgacaatgttgttgaaggcaagagctccgcaaaaaaggcattgcaggagaagcttggattacaccaaactgatagccctgtagttggaattatcagtaggcttacagcccagaagggaattcatctcatcaaacatgcaatttatcgaactcttgaacggaatgggcaggtggttttgctaggctcagctccagatcatcgcatacaaagtgactttaccaacttagcccgtaaacttcatggtgaatttgatggccgggtgaagctttgtttgacttatgatgagccactgtcacatttgatatatgctggtgccgactttattctcgttccttccattttcgaaccttgtggtttaacgcaacttaccgccatgcgatatggatccatcccaattgttcggaaaactggaggcctttatgacactgtttttgacgtcgatgatgataaggagcgagcccgtgaacaaggcctagagccgaacgggttcagttttgaaggagctgatatcaatggcgtagattatgctcttgacagggcgatcaccacatggtacgatgctcgcgattggttccactccctctgcaagcgggtcatggagcaagattggtcctggaaccgccctgctctggactacatggaactgtaccattctgctcgcaaaaactgagactaactgacaggaagaagaaaaaatgaatctccagggaataggtttaccaggtttctgtaaaatgccaatgcttcgccgtatgccattttcggtggccattatttcatcaaatgggcaatgagagcaagtatggcttatacatctccggcgtctgcaagaggctaaagagctgtttactgtgcccagcgatttgcgagctcacaatcacgtggcgcaaatgtgcagtttcacaagcatgcaccgatgcaaatatgttctgtctttacgtgtctgtagttcttcagatgtacatattttgtaagctgactttagattcttagggccgactctctccatgtagttcctttcctgcacatctctgaagaataaagtgcgtatcaaatggttacatgatgtatctcaaactcaaaaggtgtagtactttaagcatcattaaccattttgtgaataccagttctctaattatgcc

SEQ ID NO: 109 - DNA, 631 bp, Brachypodium distachyon
ccatggaagccctcgcctcctcctcgccccggctggctctcttctcccgcacagcaacggccgcaaactgggcctcgtcgtcgtcgttggtcaggcggagtcctgctgcccgtgtcaaggccgccgcagagccggccggcgaagcgaagccggccgccgccgccgccgcgacagccgatggcgcgccggcgcccaagaagatcctgaagaagaagcccgtctactccatgaagaaagggcagattgtgcgcgtggagaaagaaaagtacctaaacagcataaattacctgtcagtgggccatccccccttctacaaggggcttgactacatttacgaagaccgtggcgaggttctggacatcagagtctttgaaaccggagaatatgccctgatcgcgtgggtagggattccaacccctccggcttggctaccgacttacatgctcatcaagtcggacaagctcgactacgagagaatgtgattggtggatgagagtttgcacagaatcaggaaagatgatttattgtccacagattcattgttgtgccacgttgctccatggatttatacaaacctgaggagttgtaagaagaaccaaaagtgaaaatacaaaagttgttctatttgaat

SEQ ID NO: 110 - DNA, 965 bp, Brachypodium distachyon
gaccgcatttcccccacctcatggccgattccgccgccctctcctcctccctgccccgctccctggcgtccaggaggcccctctcctcctcatcatcctcctcccctctccgcggctgcggcggcaggtcccgatccccgcgccgctgccgcttcgggtcgcgcctgcgggcccgcgcgaggaaggacgaccccgaggacccctacgggccctacccctgggagcagcccttggatctctcctctgggttcgatattgagtgggtgcaagaagataaaatcacattgttcacttctgatgggcttgttcaaatagggggttccctggtacctcgtcgattgtctgcttccgagaagaggaaacaaaaagcaaaagggacacataaattccgccggtttcaggagagttcttacatggatccaaatcaaagtctttgccttggatcactatttaacatagcagcgacaaatggcctagacatgggtagaagattatgcatctttggcttttgtcggtctattgaaatgctaagcgatgtggtggaagatacagtactggagcacggcggtgaggttgtcattgcagagaaggcgagcaacgatggccttcaggagaagctaactatgtctgtcgccgtaccactcttgtggggcgttcctccagcatctgagaccctccatgtcgctgtgcggagcggtggaggtatagtggacaagatctattggcaatgggacctgttctaaacgctcaggacccatacacattaacaaacaatccatcccacctgtatatatgttccttcctcctaattggctgcacgcatcgtgtcagcaactgtgttcgtgccatttctacccaaccggcaaacttcacgtatataaacctgtacagacctgtttcctctcgtgctatcgtgcatataaataaataaaaaggctctgagctcacggcccatgttcaatcaa

SEQ ID NO: 111 - DNA, 1761 bp, Brachypodium distachyon
gatggagcatggcggcggaggggctgggagtggcggcgggggagccgcgccttcgagcagcaacagcggcggcggggggagcggcacgagcgggagccgtggcggcggcggcgaccaccacccgcatcacccgttctactacgcgggcccatcggtggcggcgcccaacaacaacagcaacaacgtgcagcagcagcagccgcagcagttcatggggtcgctcgccatcaccaccgccgccgtggccgccgaccaggccccggctaacaaggagaaggcggtggcggcgccggtgaccccgtcctcgtcgggcgcggtggcgaagcggccgtccaaggaccggcacaccaaggtggacggccgcggcaggaggatccggatgccggcgctgtgcgcggcaagggtgttccagctgacccgggagctgggccacaagtcggacggcgagaccatcgagtggctgctgcagcaggcggagccggccatcctcgccgccaccggcacgggcaccatcccggccaacttctcctcgctcaacatcacccgcgcctccggctcctccgcatccgtttccgccgccgcacgcgccgcaacgccgttcccggccctcgcgctccacccccacgcgcaccaccaccacgacatgtccaccatgctcggctaccaccaccaccacctcatcccgccgcagccgcagccgcagcagcaggagccgccccatgaccccaacagctctggcggcggcggattcatgaggaagcggtatcgggaggacctgttcaaggaggacgacgagcgtcaagatcccaaggcgcgcgagcagcagcagcccgcggcaatgtgggccgtggcgcccaacagcgcggcccccggcggcgccttctggatgctccccgtgtccgcgagccaggccgccggggcccggcccaccgagcagcccatgtggtccttcggcggcagcggcggcgggggcaccagcaccgtgcaggcgccgctgcagttcatgtccagggtcaactaccccaccgccgccgggatgggcggctcccccgccgacaccaacatcggcatgctcgccgcgctcaactacagccgcggcggcactgaggaccagcaggagcagcagcaccagcagccggagatggagcagcagcgcggcggcaacgagggcgaagaggaggaaggcggcgacgacagcggcggagaggaagaccacggcgccaacaacaacaacagctcacagtgagttaacctcgtcgcaagaagaacctcatcatctgcagcaaacaaaaaaaaactctgaatccgccatgatcatatcgcaatcgtgctagtgggtcactgcgtagcagcaggcaccccccataggactggaattcgaatcgaatcctgctgccttttcccctgagatgccatcattgagttagaagggaagattggagaaatcaagcgaatggaactgaagaagaagccaagccaaatagccaatgcaggaagaacttcttgctagtcccattagcctcttgttatttgttttgggtcgaattttttcgtctgttaatttcctttggattgattccatgagttgaatgattgtcttcgtttcgttttagtagtagatgggtgttatgattagcagtgggtcccaattcaggaggggccaagaatcgaacaagaagaagaaactgagtttgatttgtacagctgatcatcttgatttgtgctgcaagttttaatttctagcatccgtattatttttct

SEQ ID NO: 112 - DNA, 2183 bp, Brachypodium distachyon
cacggcacggccatggcacgcatcctatcgcgcgcccttccgttcgcctcgcactcgcacctccagttttcgccgcccatccgtggcgcggcgctgctcagctccgcgccgctcctcccgcacctccctgcggcgtccacggtctcactgctctcctggcgcgggttcactcccacccccgagccctcgcgctctgtgccgcctttcgcgggattcctcgctggcatacgtggcttccgaagggcgcggcgcggacaggcggcagcgaagcgagaacaggcgcaggaggaccctgcgcccccgcccccaccaaaggagagcgagatcgagctctacgctcgcatcggtgtcgacgaggacttgcccgatgatctcgaagtgctgaacattatagaaatcctgaaattaaatgttccgatggcgatgaaaattgcactagatgggcttttggagtacaactacaacacacgagacacttcaataagtgatgttgggaagtatgaaaaggttgaggtttctgtgttgctaggcaacgacaacttcatccagaatcttaacaaagagtggagaggcgaggactgcgctactgatatgctctcgatgtcacagtacattcctgatcttgatgttcctattcttatgttgggtgacatagcaatctcagttgagacagctgcaaggcaagctgaggagagaggccatacacttcttgatgaactgcggacactagtggttcgtggcctattgcatcttcttggttttgatcgtcaggctagtaatgaggctgcagtggaaatggagaaagaggagctgctcattttaaaaagtctgaggtggaaagggaaaggttttgctaagagtgctcttgatttgagcaagcctcgcacagaaacatcggatggacgagcgacgaatggtctaaagaaagctggcagcctaagattttatagaccaaaattcaaatatatcttctgtgatttggacggtacgctgctcaacagcaaaagtcgagttacagcaagaaatgcagaggctcttaaggaagctaggtcaagaggagtaaacatagtaatcgccacgggaaagacacgcccagctgcaattgatgttcttaatatggtcggtttatctggaagaaatggctttgtttcagaatcctcgcctggtgtatttcttcagggactggtggtatatggtttggaagggcaagagatttataaaagaaatttagaccaagaagtatgcagagaggcattattgtattctttggagcacaaggtaccactagcagcatttagcaaggaccgaagtttctctctgtttgaggacccttcggttgattctctccattatgtataccatgaacctaaggctgaaatagtatcatctattgatcagctcttagggacagctgagatacagaaagtactgttccttggtactcctgaggggatttctaccacgttgaggccatactgggaaaaggcgataggtgaaagggctggcgttgttcagggacagcctgatatgcttgagcttgtaccacctgcaacttcgaaaggcaggggggtgaagatgttgttggaccatctttgcattagcccggatgaggtaatggcaataggagatggagaaaatgacatagaaatgctacaactagcatcactgggtgttgctatggcaaatggggctgagaagacgaaagcggtggcaaatgtaatcggcgcaaccaacgacgaagatggagtcgcgcaggctatttatgactatgctttctaacagctgctgacactaaggagtatcgtttctttggttccccacggtgttctgggttcaccacccagtttcacatgtctgcacatctatctgacaaaactatacagggttgtgatcagcagcacccgttaagaggaacatttgaactgttaggcagagttattttttggctggcaatccatgaggagccaccacccatttttggctggaatatctgtaaaacgttttcaatctctgataaccaacgaccggtgtctgtgttagctaagctactttttcttccttgttgtattgagagtttaggattcagatttgcatgggatgttgtttaaccaatcactgcggtcaaaagaaatgtccggttacaacttgtctagttatttacaaattacatcaatatcttcgtg

SEQ ID NO: 113 - DNA, 1654 bp, Brachypodium distachyon
tacatgacctcggcgtcggcgcagttcgcgccggcgcccctcaggatgggcatgtacgagcgtcccccgccgcagcagccgatgccgccgtcgccgcagccggtggtcggcatgtggaacaacagcgtcgacacctacaaggtcgacagcggccaggccaccagcgggtccaccatcatggaggccgacaccaagttcgacgacgccgagcttgaagaggttccagggatggaggaactggagccaaccagggatgtcgatcaggaagcgagcaagccgccggataaggtgttgagaagactcgcacagaacagagaagctgccaggaagagccgcctccggaaaaaggcttacatccagcagctagagacgagccggataaagctggcgcagctagagcaagagctgcagcgaacgagacagcagcagggcctgtatcctccgggtcactcgggcatggcggggttcggcggcgtcggcggggtgcccatggattccggcgtggcggcgttcgagatcgagtacgggcactgggtggacgagcagaaccggcacacgcgggagctccgcggcgcgctgcagcccgggcagcagaccacggagctggagctccggatgctggtggagaccgggctcggcaactacgaccacctcttccggatcaagaacctcgccgcctccgccgacgtcttctgcgtcatgtacggcttgtggcgctcccccgccgagcgcttcttcctctggatcggcgggttccgcccctccgaggtcctcaaggttctgaggccgcagctggagccgctgacggaccagcagctggagcaggtgtaccacctgcagcagtcgtcgacgcaggcggaggacgcgctgtcgcagggcatggagaggctgcagcagacgctggcggacgcgctcacggccgccgcagaccccttcgcctcccccgacggctactccgggatgaacgacgccatcggcaagctcaaaggcctcgtctgcttccttcaccaggcggaccatctccggctggagacgttgcagcagatgcagaagatcttgacgacgcggcaggcggccaggggactcctcgcgctcggggactacttcgagcgcctccgcgcgctgagctcgctctgggctgctcgcccgcgcgagtcggcgataagctgaaccttctgctcgtggaaccaaaaaaaatggttgcaggatcagttcctctcgtagtatgatcagttgtgtagttcccgggtcaagggccgccgccagtgaaggatgaagaaatccaatcacgctagctgctgggttccgggagaattatctgagtttatgacgccgtacgcgcttgcattgtctgccagatgaaggagtagttccagattccgaagagtaagtaaaaggagagtgtaaaggtcgatcagattgggcaggtcgatctcacgatcgagagaatgtgtaaatacatgttttgtggtgtcacatgcctgatcgagacctctatctgctgccgtacagattttattttgcggtgatggtgaccatcgatgatcttgttgaagtagccgtgtaattgcacaaaggggtacgcactagtttacgcgctatgtatatatacgtgtatgatgtaattcttatttttattttgaagtgaaggtgt

SEQ ID NO: 114 - DNA, 1484 bp, Setaria italica
gccagccgtcctggtgtgcgtcactgcgtctcgtgcagacagacgcggtccacagctcgccacggccatggacgtggaagcgcgcaaggacgcggcgcccgcgcgcggcaaggcgatgcgccgcctcctggtggcgctcaactgcgggatgctcgcgctgggtgccatcggcgggccgctcctcagccgcctctacttcagcaagggcggccaccgtcagtggctgtccgcgtggctcgagaccgccggctggccgctgctgctggtccccgtggtggcggcttacgtcgcccgccgcgcgcgcgaccgggccgccccggccctcctcaccccgccgcgcatcctgctggccgcggtgggcctcggcgtcgccacgggcgtggacgacttcatctacgcctacgggctctcgtacctccccgtgtccacctccgcgatcctcatctcgacgcagctcgcgttcacggtgctcttcgcgttcctcatcgtgcggcagcggctgaccgccgcgtccgtgaacgccgtggcgctcctcaccgtgggcgccgtcgtgctggggctgcacgtctcctccgaccggccccccggggtcaccaggggccagtactggctggggttcatcctcacgctcggcgccgccgcgctctacggcctggtcctgccgctggtcgagctcgcgtacaggcgcgccgccggcggcgggcgcgccgtgacgtacgcgctggtgatagagatgcagctggtgatggggttcttcgccaccgcgttctgcaccgtgggcatgatcgtgaacaaggatttccaggcgatcccaagggaggcgaagcacttcgagctaggggaggcccggtactacacggtgctggtgtggtcggccgtgctgtggcagtgcttcttcctgggcgccgtgggggtcatcttctgcgtgcacacgctgctcgcgggcatcctcatcgccgtgttcatcccggtcacggaggtggccgccgtgatcttcctgcacgagaagttcagcagcgagaagggcgtggcgctggtgctctcgctctggggcctcgcgtcctactcctacggcgagtggagcgactccagggccaagaagaaggctgaggccgccgcggaaggccaggcctcgtgattcttatactgcaactgtggacgatgatgagagatcgaggctctgatctcttcccgttgtactttctatatgctgtgattgtggccgtgtcgatggagtcgcgtaagtcgtcacctgcaactgtaggatggtcaacattcttcagttcagttgggtgggtagtactgtactgcatggtgcatggaggtgtgtatgtcatactagtactgtaccgtacagtacatgaaactgctcgctacgtttgaagtcgtagcaaagcgatcggcgcacttgtaacccgattccgggtatggttagaacgaatacaaaatatgtttctgtgactattctccacagttaaaacgag

SEQ ID NO: 115 - DNA, 992 bp, Setaria italica
gttcgatccatctctcctcccctcccgaccgtcgtcgcatcgcatgcaaccacccctgccgctgctgcgttgcttgacggcctcctcctcctccgccctcccgctctcggtgttggtgcgcaagcacaagctaggattattattctccacggccatggacgacggcgtttcttcgcaagacaagaagacgtctccgccgccggcggggggcgtcgcggagcgcatcatgccgcatctcctcaacatctacggatcgcgcgcgacggcccgggacttcgagatttacgcgcccaacgccacgtttgaggacccgctcatgcgagcccacggggtgcagcagatcaagtcctcgttttacacgcttccaaaggtgttcgcggaatccaagatcgtggagtacactgtacatgagaatcccacgggccccggcaaagccgagattctgatcgacaacaagcagcactacaaggtacttgggaaggcggtggagctgaccacgctcatcaggctccaactccaggacggcaaggtggtcacccacgaggactggtgggacaagaagcctctcaagaaccgggacacggtggggttcccgctgctgggccgcgtcgcggaggccacccgccggggagcaatgctgctcacccacgccctcatgggattcggcaaggaccctcctgctcacccaccgccggcatcctcctcctcttgatctacttgtatctatatatatatatatatgtgctgatgatgattactgcatgctactgctacgccaatggcgtagtgatcaaataatctaccactgtacttaattgttgtcctactggtagtgcctttaatttttatccttcttcgttttctttttgccagtatattaattattactatgctgcgtttgaaggatcacattttgcatgcgctattgtatatgttgtagcagttaatataagcaaagattaatgtgacatgctcctagccactagccctgc

SEQ ID NO: 116 - DNA, 1845 bp, Setaria italica
atgaacggccgcggcagcggcggagggggagggggaggggaggaggagatggaggaggacggcggcggcggcgccggctgcgcgcagggggccggggcgggggcggagaataaggagcgggtggtgctgatgtggggctacctacccggcgtgtcgccgcagcgctcgccgctgctcgggccggtccccgtgaggctccccccggcggcggcggcgcccggcggcgatgggtggagggacgtgtgcggcggagggtgcggcttcgccatggccatctccgagtctggaaaactcctcacttggggttctgctgatgacatgggccaaagttatgtaactgctgggaagcacgaggagactccagaggttttccctcttcctagtggtgttgcaatggtgagggcggatgctggatgggcacattgtgttgccataacagatgaaggggatgtctacacgtggggttggaaagaatgtgttccaactggcagggttgttggagaccagtcttcagttggaaccatggagaaggatgaaagacaaattgcaatggccactgaccaagtgagccccaggtcacaggtatctaggacgagcagtggagcagcatctggtccttctgaaagcagaggcactgacgatagcacaaagcgacgaaggttgtcttcagcaaaacatggacccgagagctcaacatctagtgatgaaagtctttctgcacccccttgtgttgtgacatttaatacaggagtgaaaatagtggctgtagctgctggtggtcgtcatacgttagcactatcagatttaggtcaggtgtggggttggggatatggaggagaagggcaactaggtctgggttccagaatcagaactgtttcttctcctcatcctgtaccgtgcattgaatcggcactgtacagcaaggatcggccgtcagctatgaaaggtaacaagaccgctgaagggcacatcagtaaagtcatgggaaattgcgtgaaggcaattgcttgtggaggccgtcatagtgctgtagtaacagattcaggagctcttctcacatttggatgggggctgtatggacagtgcggacaagggaatacagaagatgttttaagtccgacgtgtgtatcatctatcctgggaatcaagatgcaagatgttgccgcaggtctgtggcacaccgtatgtacatctgtagatggtgatgtctattcgtttggaggaaaccagtttgggcagcttggcactggttcggatcaagctgagactgttccaaaattggtagatgctacaagcctggaaaataagaatgccagatctgtttcttgtggagctcgccacagtgctattataacagatgaaggcgaggtattctgctggggatggaacaaatatggccagctcggcctcggcgactcgatggacaggaacgtgccttgcagtgtccccgtggacacgtaccacccgctgaacgtgtcgtgcggctggtggcacaccttggtgctcgcggagtcgcctacctgaaacctgacaggaattaccgtagattgacaattttgttaggaacatgtaggctcgtgcaggtgcggatgctgcatttcatcgtgtacatacatggcagtgcatacagatgtgtgtattcattctttccggtgcgctcttcaacgtgtgcaacgtagacgaatcttgtatcgccctgcgtatacagttgagtaggattgcctgtacaattacgcttgaaactgggttcgctgacgcttgccaagcggttatgctgctcccacattgggtaaccggattaccagattgccgactccagccgtccatgttcttcgctactggagc

SEQ ID NO: 117 - DNA, 3933 bp, Zea mays
atccaccgtcatcgccgctacctatggcttccccgtcgggtcgtctcttgcctcattctgttccccgccgctgctctcgccacccactatcggaggcattgtgtccagaaacatggttaagagggtatgctgtctgagcgccagggagatccgaacggtgatgccctctactcgcttcccattgtcctagagtcaggcaaatggaggaacatgagtcagtggggctgccatagttggagaatgcggcgtaagcaggccgacgacggcgagttcctcaacatgtactccgcgagatgcgcgtgaagacatttggattcgtccaccaccacatcactagtctcactctcacctgtaatatatctgcacccaacgagcaggtaccaagcaattagcaagagaaacacaaggtcgaggtggtgaggtatggagctcgccttgggggccatgaccagcttggcccttaagctaggcgacctgctcatggaggagtatgtcgtgcagaagggcctcaagcccgacatcgagtctctctccagggagcttgtgatgatgaacgccgctctcatcgacgcgtcccgggttccacctgaccagctcaccgaggtggaaaagctttgggcacgcaaggtccgggacctgtcgtatgacatggaggacgccgtcgacgatttcatcctgcgtgtggctggtggtgacgactctgccgccgactcaaaattcttcaagaagacccttgccatggtcaaggacgtgatgtcgatgaagaagttcaaggatcggcgccagatctccgacaaggtcaaagacatcaagaaactctccaacgagttagctgaacttcgtgccaagtacacggtaaggggtgtgggcgctgatctcgccgcgagcaccggcatcgaccctcgtgtcatcaatctgtacaagaaagagacagatctcgttggcatcaagaagtcaaggaacaaagtcattaggatgctgtctatggagaccaaagatgatgatgcacttgagtcccatcaggctctaaagatagtgtctatagtcggggttggaggactaggtaagactactctagccaaaacagtgcatgacatgcttaagaagcaattcgactgttctgcttttatttctattggtagaactcctaatctgaataggacattcgagaagatgctattgaaacttgatcgtgagtataaacaagttgacatggccagatgggatctagaacaatttaaaaacgaactggatgaattcttgaaggacaagaggtacttgatcgttgttgatgacatatgggatgttgactcatgggaagcaatcagatatgccttgaaggacaataattgtggaagtagaataatcatgactactcgtaattttgggattgtcacgaaattagaagaggtttatagattaaaacctctttctaatgcaaactccaagaaattgttctacaaaagaatagagagtcaggaaggagaaagccttgatggtgaactctctagtaaaatcatacataaatgtggcggcataccattggctatcattgcaatagctagtttgttggttgaaagatcacgtgaggagtggtcagaagtgtacgacaagattggtcttgggaatgaagacaatacaacaaagataatgtcatacagctactatgatctgcctccttatctcaagccatgtctgctgcaactaagcatatatccagaagactgtatcattgatacaaactctaccatatggaagtggataggtgaaggtctagttcatcttgagaaagaagagggtagcctatttaaggttggagaaagatacttcaaggagcttgtgaatagaagcatgatccagccgacagaggacaaaaatgatcggtttgtagaagggttccgtattcacgacattgtgtttgatctcatctgtaagttgtccaaggatgaagacttcattaccattagcgggcaacattcatctcgggatagtttaagaagagagaagaaaacatgtgtgcctcgctcagactgcaagctacgtcggctggccgtccgaaatcaacgtgtgcagcgcttccctgaagaaaccatggacatgccagaggtgttgaggtcacttagcattatagattgtaatattgcggttatggccccaattgatagcttcagggtttgccgtgtgctgcatatagaaaacaactacgtacccatcaacctaaagcatctagggaagctgttgcatctcaagttcctacagatatctggcacgactattgatgagctccctagagaaattgggcatctgaggtctcttcagacactgatattagccgatactggactagacgagctgccaccggctgtttgctcacttacacggttgatgtgcctgatagccctggagttcgaaaggttaccagctgacaggatggggaacctaacgtccctggaggagctacgactacatagggtagttggccggagtgccacccaagccctagtggcagagcttggcaagctgacgaggttgagggtggtcgacatcaccttttcagagcagctagaggagagcttgcaagaagcattggtgcaatctctgtccaatctgcggggactccaggaactaacgcttttgtttaaaatgacacggtggggaagcgatatgtggggagactgggagccaccaaggcagctccggcgcctgattattgaaggcatcatcgtcttctcacgacagcctcgatggatcaaccgctcctgtctgccacgcctctgctacttatctctgatggtgcacactcttgaagcacaggacctagataatctagcgaggttgccagagctccagtacctcacgctagatggtctcagctggcctccaaggtatactgttggcccagacgacttcaggaatctgaggttctgcaaagtgggcacaacgttcgagtttcgtaagggcgccatgccaaggctcgaagtgctgcaatttggagtttttgcagggtactattgttgggcatacaatggtgtgccgttcgagcagttcccaacgaaggatcttgacttggacctggataacgtccttttacttcagcaagtaatagtcaaagtcaactgcgtaggtgctactgtcacacaagtggaggaggtggaggccgtggtcatgcgtgccgtggaaaatcatgccaaccgtccaaccataaaaatgaatcgagcatatgaaatagctatcctatccgacgaagggcgggaggctctgcttcggcgacacattgaaaaggattgctgcgtgcgcacgatgaaggataaatctgatgctttcttcatcagccagctgcggaggtatcgacatcttcagaaagccattattttcatcgactgttcgggtgccagcatgtgtgaggtgcagaaagtggaagcagcttttagacatgcagccgaggttcatcctaaccatccaagtattgaacttatcagaacaaacaccgacggaatggcctcctcctcatctgaccatcccaacacagagcccaggaattgatggctcggtttgtcagatccttccaacccaggagcaggtaaatgtgagttgcttaagtaccaaagagagaggtcctgttcagcaagatgattagaagcattggcaattggcatggcttgttaattagattcgtggttcttagtctaaaatcacattgaagagggagacggacccaagtgatgcagttcatgtgttatctgtatcagtctctgtttttataagctgtcatatattttctcgaaactatcttgtgttgattttgtgtgaagtgtacttttaatggcacgggccattgtgtatttgcttgaaagataaggatggtattatctttgtatttgaactctaaatgcttaaatgaagtgatcattctggatggagatatgtatggtg

SEQ ID NO: 118 - DNA, 2807 bp, Glycine max
gcgatgaccacggcggaagaggaagatgatcaggggaagcacacgacgtcgtcttcgttttcgtcttcttcttcgccgtcgtcgtcttcggacgagagagagtacgaggtgcaggacctgcgtgaccggttgaaatcgtcgcaagggagcatgttcaatctgatagagaaccagttgggactcaactcgacttggagcaagttcagtcgccaagctcttctccatggaatccgaggcttctccatggacttagttaaagacttcgttattcatcctgataacaggtggtatcgggcatggacaaatttcatattggtatgggcagtgtattcatccttcttcaccccaatggagtttgggtttttccgtggcttgcctgagaatctctttatactggacatcattggacaaatagcttttcttgtagatattgtcttgcaattctttgttgcttatagagacagtcagacctatcgtatggtctacaagagaacccctattgctctgcggtatctgaaatctaacttcatatttgatcttcttggatgtatgccctgggacatcatctacaaggcttgtggaagaaaagaggaagtgaggtaccttttgtggatcagattatatagggtgcggaaagtcgaagactttttccacaagttggagaaggacatacgtgtcaattacattattacccggattgtgaaactgatagtagttgaactctactgcacccatacagcagcctgcattttctactatttagctactacactacctgaatcccaagaagggtacacatggataggaagtttaaaactaggtgactttagttattcacatttcagagaaattgatctttggaagcgctatacaacatctctgtacttcgctattgttacaatggctacagttggctatggagatatgcatgcagtaaatatgagggagatgatattcataatggtatatgtttcatttgatatgattcttggtgcctatttgattggtaacatgacagctttgatagtcaagggatcaaagactgaaaagtttagggacaagatgacagaccttatgaaatatatgaacagaaataggctcggaagggatatccgtgaacaaataaaaggtcatgtgcggttacagtatgagagtagctacactgaggcttctgtcattcaggatatccctatttctattcgagctaagatatcccaaacattatatttgccgtacattgaaaaggtttctctttttaaaggatgctcttcagaattcatcaatcagattgttattaggctccatgaggagttctttcttccaggggaagttataatggaacaaggaaatgttgtagatcaactatattttgtatgtcatggagtactggaggaagtaggcatagctgaagatgggactgaagaaactgtttcacttctgcagcctaacagttcattcggagaaatatctattctttgcaacattcctcagccatatactgtccgtgtttgtgaactgggtagactcctgcgacttgataaacaatcatttacaaatatcctagacatatacttttatgatggaaggaaagtgttatacaaccttctagagggaaaagagtcttttcgagataagcagttggagtcagacatcacatttcatcttggaaagcaagaagctgagcttgctttgaaggtcaatagtgcagctttcaatggggatatgtatcagctaaaaggtttaattcgagcaggagctgatcccaacaaggcagattatgatggaaggtcacctttgcatcttgcagcatctagaggatatgaagatatcacaattttccttattcaagaacgtgtagatgtcaatattatagataacttcgggaacacacccttacttgaagcagttaagaatggacatgatcgggttgcttctttacttgttaaagaaggggcctctatgaagatcgaaaatgctggtagttttttgtgtactgcagttgcaaggggagattcagattatcttaaaagacttttatccaatggcatggatcctaacttaaaggattatgattaccgaagtcctcttcacgttgctgcagctgaaggtttatacttcatggcaaagttgctattagaagccggagctagtgtttttacacgagacagatggggaaataccccgcttgatgaagctcggatgtgtggaaataagaatctgatcaagctactggaagatgcaaaatcttctcaactgtcagaatttccatcccaagaatttacagataaaatgcatccaaagaagtgcacagtgttccctttccacccgtgggatccgaaagataatagaagacatggaattgtattatggattccacactctatcgaagagctaatcaaatcagcagcagaacaaatagaaatttctggcggttcttgtattttatcagaagatgctggtaaaattactgatgtggacatgatcaaggatggtcagaagctgtatttagtccatgaaacacattaggcctccatattatggctctttacaaccatataattaagtgccttgtaatgtgttgtgctttctacaaattagcacgtgatttgatcttgttaaccgttcaaaaactgttttatatatcctgtcaaaatacagacgggtgatgaagatcaatactgcttagtgttgataccgtgatttcaatactgcttagtgttggtcatccattttgctattcagtattggctcggaagatttctttgtttttcttgtctgagcattaatattaattaagagatagttaa

SEQ ID NO: 119 - DNA, 1505 bp, Glycine max
cagaaatggccaccacttctgcttcattcgcgagcttctccgtcatcttgcgaccttcttcgtccaatccccaattcttcctcttcaacgtcgctccccgaaccggaacctctcattcccgaacccgttcgactcggttcaggtgctcggccggtcagaccgggttcttcacgaaactagggcggttgataaaggagaaggcgaagagcgacgtggagaagcttttctcgggattctccaagacccgcagcaacctcgccgtcatcgacgagcttctcctctattggaacctcgccgacaccgatcgggtcctcgacgaactcgaagaggctcttttagtgtctgattttggtccaagaatcactattaaaatagtggagaatttgcgcgaggatatattttcagggaagcttaaatcagggaatgagataaaggaagcactgaagaggaatgttttggaattattaacctccaaggggagtaaaactgaacttcaacttggatacaggaagccagctgtaataatgatagttggtgttaacggtggagggaagactacatctttgggaaagctggcctatagattgaagaatgaaggggctaagatattgatggctgctggtgatacatttagagcagctgctagtgatcagttggaaatatgggccggacggactgggtgtgagattgttgtggctgaatcagagaaagcaaaagcatcatcagtgctttcacaggctgtaaaaaagggaaaagagctaggttttgatattgtattatgtgatacatctgggcgtttacacactaattacagcttaatggaagagttgatttcctgtaaaaaatctgttgctaaggtcattcctggcgcacctaatgagatcctactggttctggatgggactaccggtttgaatatgttgccacaagcaagagaattcaatgatgttgtgggtgttactggtttaattttgaccaaactggatggttctgctagaggtggctgtgtggtcagtgtggttgatgagcttggaatccctgtaaaatttgtgggtgttggtgaaggtgttgaagaccttcaaccctttgatgcggagtcctttgtgaatgccatttttatttaaaccaatattgtgggtttgcaaaaacagcttgacatgaacattcagagcaacacctggtcaacaggaaagatggcactttattatggaaaccgttattgggaagggccaagcattgcgaataagtgtacatgattttgaggtgcagagctgttgttgcttttgaggaacgctgagtgtatacaatcttccttttgcatgctgtgtctgaaagtttctgacaatgcaaatgagacgtagggtttataatcactcctgtttatgaacagaaggattttattgtggtgtgcatatagatgatacttaaggaaaatgtaaatacattgctccattgtctgtcaacatctgattaatgacaactatttttatttcttcgacctctca

SEQ ID NO: 120 - DNA, 2642 bp, Triticum aestivum
gtcgagcgcgcgcgcgaggagtgccgcggcctcatcggctccgccgcccagaaggcgggcgggcttgacactgacgtgcccttcgacgggggctgcaggcgcgtcttcgaggtcgccgtcgagctgtccaggaacatgggctgcagcttcatctcccccgagcacctcgccatcgcgctcttcacgctcgacgatcccaccaccaacaatctcctcagaagcttgggagcggatccgagtcagctagcgtcagttgcagtcacccgactccatgaagagcttgcaaaagatggcagagatctcgcaggagcatcttctctcaaagtgcccgagaaagcacccgctggagctggagctggaagatctgccttcagcaaatccttgagtaaaaagaaagataaaggtgcgttggatcagttttgtctagatttgaccacacaagccagtggagggtttattgaccccattattggccgtgaggaggagatcgaaagggtggttcagataatatgccggcgaacaaagaacaatcccatccttttgggtgaggctggtgttggtaaaaccgcgatcgccgaagggttggctcttcggattgcaaatggagatgtccccattttcctcgtggcaaagcgtataatgtcactagacattggcctgcttattgctggcgcaaaagagaggggcgaactggagtccaggatcactagtttaattcgtgaagtccgtgaagcaggtgatgttattcttttcatcgatgaggttcacaatcttgttggatctggaactgctggaaagggtaagggtgctggccttgatattagcaatctactgaagcccccgcttgccagaggtgaactgcagtgcattgcagctacaactttagatgaacaccggatgcattttgagaaggataaggctttgaaccgcaggttccagccagtatttgtagatgagcctagccaggaagacgctgtgaaaatattacttggtcttcgtgagaattatgaagcttatcataaatgcaaattcactctagaagccatcaatgcagcagtttatttgtcagcaagatatatcccagacagacagcttcctgataaggctattgatcttattgacgaagctggcagtagagctcgaattgaatcatatcaaaagaagaaggaaggacagtcttccgttctcttaaaggagccggatgaatactggcaggagataaaagctgtccaggccatgcatgaagtggtgttatctaacaagatgaaatattctccgaatgagaataagcaacagaatgcgagtgttaacactgaagcgccacatcaggataaggctgagtcaacaattgaggagcctattgtagttggaacagaagaaattgcaagagtcgcctcattatggtcgggtattccagtccagcagctgactgctgatgataaaaagatcttagtaggactggatgatgagcttagaaagcgtgttattggtcaagatgacgctgttgcggcgatatcgcgggccgtgaagagatcacgtgtaggcctcagtgaccctgacagacctatagctacgatgctcttttgtggtcctacaggggttggtaaaaccgagcttaccaaagctcttgcggcgagctactttggatcggaatctgctatgcttagactagacatgagtgaatacatggagaggcacacagtgagcaaactgataggctctcctccagggtacgttggatatggtgaaactggtactttgacagaagcagtcaggagaaaaccattcaccgtggtactgcttgatgaaatagagaaagctcaccctgatattttcaatatccttctccaaatttttgaagatgggcatctggcagactcacagggtcgcagagtttcgttcaagaatacattgattgtcatgacatcaaacgttggttctacgtcaatttccaacggacgacggagcatgggtttctcaacagaggacaccgaatcaagcagatatgtcgcggtgaaatccctcgtgatggaagagctgaagggattcttccgtccagaattgctcaacagaatcgatgagacggttgtattccgtcctctggaacagactcagatgctagcaattctcgatatcctcctagaggaactgaagggcaagctcttggccgtcgggatcggcctagaggtctccgacgcgatgaaggagctgatctgccgagaaggctacgacaagaactacggcgcgcggccgctgaggagagccatcacccagctgatggaggatgtcatcagcgaggcgattcttttcggcgagtacaagcctggcgacacgatactggtggacaccgacagcaaggggaagccttgcttgagtcgtctgaaccaaccaccgatcgtccaagtgtctgactcaacacggacattctgaagtgaagctctctctcgtgtggtagacttggtagagtagaggcctaatttcctattctttcgatttcgagtaacgagataagtagtaattctttgataggtagataccaaatattcggttatttctttatgtacataacattgagggaattcgtcccagcatggtcttattcggcaagtatatatccaactgtatattgtcctccggtttat

SEQ ID NO: 121 - DNA, 843 bp, Triticum aestivum
acgggctcatcacggccatcgaccgcttcgagcccaagcgcggcttccgcatctccacctacgcgctcttctggatccgccactccgtcgtccgcgccatgacgctctccagcttcacccgctttccgttcgccatggaatcggagaggcaggagatcaacagggcgagggaggagctgtcgttcgagctcgggagggcgccgacggacgaggagacgatgaagaaagtggggctgtcgccggcgaggtaccgcgacgtggtgcggatgacgaggcccacctactcgctgcactcgcggaaccgtgtcacgcaggaggagctcatcaaggaggtcaccgacgtggacgccatcggggtcgacacccacaagcacaaccgcctcctccgcctcgccattgacgacctcctggattcgctgaagcccaaggagagcgtggtgatcaggcagaggttcgggctagacggcagggggaggcgcacgctgagcgagatcgccggcaacctgaggatctcgagggagatggtgcgcaagtacgagctcaaggcgctgatgaagctcaagcaccccacccgggtcgactacctgcgaagatacatgtgaaattatctgtatatatctcggtcgcgcacatacataccggttctctaatttgattatgctgcatatacttacattgcaagatggcatagactcatcattgattccgtatttcggacatgtatataagtctgtatatacgagtgagattgtatatataatatttgatttagacctcgcgctgatgtaattcatagcacgcagaaaagaaaatggtctctggtttattagaagaaaaaaaaaa

SEQ ID NO: 122 - DNA, 811 bp, Setaria italica
gtgggtacggaggcggcggtggcggctacacgcccggctactccggcaccggaacctgcgactactggaagagccacccggacgcgatcatctcgtgcatcgggtcgctggggagcatcctgggctccttcggcgacgtgtgcagcgccttcttcgggagcaagctgcagacgctgcaggacgcgctgtgcaacacccgcaccgactgctacggcgacctcctccgcgagggcgccgccgcctacctcaactccatcgccgccaagaagtacgcctactccacgcagcaggtcaaggactgcatcgccgtcgcgctcacctccgaggtcgccgccgccgcgcaggccgccatgttcaagaaggccaacttcgcctgccactacttatgatgatgaagcttccatcgtcagcgtagtcgtcgtgcttgttaaataagtccgtgtgtgcatgatgatggatgcaggtccagacgtgtctccccggatcgaggggccttatgatgatgcatgatgccgtgccgtctcgttgtctgcttcgttcttcagtatagtgatgcttcccttattgtcgttgttgctgatgtgagaaataagatgagttggttggtagtgaaacataacggtggttgttcttacgaactgcatgtgtactcgcgctagcttgtttctgtcagtgtcagcactggtggttgggatgtaatcgtgtacatgggatgtaatccacgtcaggatttccttatttcctctcgcaaaaaaaaaagatttccttatttccatgtgcatgcttttgcttttgcttgtcaaaatttagg

SEQ ID NO: 123 - DNA, 1164 bp, Zea mays
gcgcctttgcagttgcggataacggggaggaggcggagcgaccaacggcacaggcaccatggcgatgcgagcagctacagcggcggcgacaggcttcttctctccatccaccgtccctccgaggcgcttctcgtccgttacaccgccggcgtcactctgcaccgcgcgctgcatccagcgtcaccgtctccgcgccttcccaagcttggaaatacctctagaggaactcaacccatccgtcgatctacttaggagaactgcggaggccgttggcgatttcaggaaaacgccaatctatattgttggtacggattgcacagccaagcgcaacatcgccaagctgcttgcgaattccataatataccgctacctcagcagtgaggaactgcttgaggatgttcttggtggcaaggacgccctcagagccttcaaggaatctgatgagaagggttatcttgaagtcgagaccgaagggttaaagcagctcacgtccatgggtagccttgtactgtgctgtggagatggcgccgttatgaactcaaccaatctagggctgctgaggcatggtgtctccatttggattgatgttcctcttgaaatggcagcaaatgacatgttgaagagcacgggaacacaagctactacagatccagactctttttctcaggcgatgagcaagctccgtcagcggtatgatgaactgaaagagcgctatggggtttctgatattactgtttcagtacaaaatgtggcttctcagcgggggtacagtagcattgacttggtgacgcttgaggacatggtccttgaaatcgtgaggcaaatcgagaagctgatccgtgcaaaggagatgatggaagctgcagggaagccattctaaacaagatacacatacacaatagttctgctccggcatacctattttctggccagttaccagacctccgatgcttcgctgttcaagaaaccgattgcagttgcctacggctcaaagcacaagcgcgtgaaatctaaggaactgaatctggttgttccactcgaatatgcttatattgtattgcaagatcacttgccaattgatagtgcaaaaaatgcattttgtagtttggattctctagtattgactttaatccatatgtattgaagtagattggagtgtaactt

SEQ ID NO: 124 - DNA, 1200 bp, Zea mays
cctggtctcctcttccttcccctcctgttctgtccatctctaccgttccattccaattccatccccggaaagcgcaagccgcgggagagcggccggcgtacgtaccacgaggaccgccagccgagggccatggccgccggtctgtccggcgccgcgatgaccagcttcgtcgccaagaacccgctgctcgcggccgcggcgcggcgcagggcgcctcccctcgcggggcgcgccctgccgttctctccgctcgccagcaccagggccccgcgccgcagggggctcaggctgaggaccgtcacgtgcttcgtgccgcaggacacggcggccccggccgctcccgtgccggcgctggacgaggaggccagggccgcggcggcgcggcgcgtcgcggagaaggaggcgcggaagcggtccgagcggcggacgtacctggtggccgccgtgatgtctagcctcggagtcacgtccatggccgtcgccgccgtgtactatcgcttcagctggcaaatggagggcggcgaggtgccggtgatcgagacgctgggcacgttcgcgctctccgtcggggcggcggtcgggatggagttctgggcgcggtgggcgcaccgggcgctgtggcacgcctccctgtggcacatgcacgagtcgcaccaccggccgcgcgagggccccttcgagctcaacgacgtgttcgccatcgtcaacgccgcgccggccatctccctcctcgcctacggcttcttccaccgcggcatcgtgcccggcctctgcttcggcgcgggcctggggattacgctgttcggcatggcctacatgttcgtccacgacggcctggtccaccgccgctttccggtcggccccatcgccgacgtgccctacttccgccgagtggctgcctcgcacaagatacaccacatggacaagtttgagggcgtcccgtatgggctcttcctgggaccaaaggagctggaggaggtcggtggcctggacgagctggaaaaggagctcgcgcgaatcggccggaccatctgatggattcgtccggattccggcgcggcgatctccgctccgctccgtgattccggcgcagcctcatggttggggagccgacgaccagaacctccagaagggatttggtttggatgcgcgagcctagatcttgacctgcatttcggatggtctgtggaggcacagctc

SEQ ID NO: 125 - DNA, 1911 bp, Zea mays
actgaacccaataatccgatcccacagaaactctctcagtccgttcgatcgatcgctgccgtgtcgtttgccagacaccatcagcacccaaaaccatggcctgcaaactggctcagtgcgccaccgccgccgcggcgaccgtcgcgccacgcacccctcgccctgctgcgtccgcgtccgtctccttctccgcgaggaagccggcgggcggcagcctgcggctgcagcgccaggcgtgctgcgagccgtcggtggcgccgtcgcgggcggtgttcgcctgccgtgccgcggcgtcggggagcgcggccgacctggcctccgggggcaggaggtcgtccggcgtgccggtgttcgtcatgatgccgctggacaccgtcaaggagtgcggcaccgcgctgcaccgccgcaaggcggtgcaggccagcctctccgcgctcaagagcgcgggcgtcgagggcgtcatggtggacgtgtggtggggcatcgccgagcgcgacggcccgggccggtacaacttcgcgggctacgcggagctcatggagatggcgcgcaaggccgggctcaaggtccaggccgtcatgtccttccaccagtgcggcggcaacgtcggcgactccgtcaccatcccgctgccgcggtgggccgcggaggagatggagagggaccaggacctctgctacaccgaccagtggggccaccgcaactacgagtacgtctcgctcggctgcgacgccctgcccgtcctcaagggacgcacgcccgtcgagtgctacaccgacttcatgcgcgcgttccgcgaccacttcgccgactacctcggcaacaccatcgtggaaatccaagtcggcatgggccccgccggcgagctgcgctacccgtcctacccggagagcaacggcacctggaagttcccaggcatcggcgccttccagtgcaacgacaggtacatgcgtagccgcctgaaggcggcagcggaggcggccggcaagcctcagtggggccacggtgggccgaccgacgctggcggctacaacaactggccggaggacaccgtcttcttccgcggcgacaacggtgggtggagcaccgagtacggcgacttcttcctgtcgtggtactcgcagatgctgctggagcacggcgaccgcatcctgtcgggcgccaagtccgtgttcggcgccgcgcccgtggaggtctccgtgaaggtggccggcatccactggcactacggcagccggtcccacgcccccgagctcaccgcgggctactacaacacgcggcgccacgacgggtacctcaccatcgcgcgcctcctggcgcgccacggcgccgtgctcaacttcacctgcgtggagatgcgggaccacgagcagccgcaggaggcgcggtgcatgccggaggcgctggtccggcaggtgggcgccgcggcgcgcgccgccggggtgggcctcgcgggcgagaacgcgctgccgcggtacgacggcacggcgcacgaccaggtggtgaccacggccgccgagcgcgccgccgaggaccggatggtggccttcacgtacctgcgcatggggcccgacctcttccacccggacaactggcggcgcttcgccgccttcgtgcgccgcatgaacggcgccgggtcgtgccgggaggccgcggagcgggaggcgcacggcgtcgcgcaggccaccgggtcgctggtgcacgaggccgccgtcgcgctgcggagctgaccgcccgggacgggacggaacggaagcctacgatcgactgtacatacaggggttgggacttgggagggagctcaggttcttgttgggttttcctttgggtggagagcgagggagcgcagtcgacagccagcgagcagtctctcgtgcagtgcagtgcagctccagcgtagacgagattgta

SEQ ID NO: 126 - DNA, 546 bp, Zea mays
ccttctataatacgtctgcggtgtcaaaatttccctctcagccgtgttgctcgccgccgccccgccgtgttgctcgccgacaccgccccgccggcagccaaaatgccgttcaagaggttcgtggagatcgggcgagtggcccttgtaaactacggcaaggagtatggccgcctcgtcgtcatcgtcgacgtcgtcgaccagaacagggctcttgttgatgcccccgacatggttcgttgccaaatgaacttcaagcggctttccctgactgacatcaagattgacattaaacgtgtcccaaagaagactacactgatcaaggcaatggaggaagctgatgtgaaaagcaagtgggagaatagctcatggggcaagaagctgattgttcagaagaggagagcatcactcaatgactttgacaggttcaaggtcatgttggcgaagatcaagaggggcggtgccattaggcaagagcttgctaagcttaaaaaggtggctgctgctgcttagattgctttggtggttcctctattcgatctcttgtag

SEQ ID NO: 127 - DNA, 815 bp, Sorghum bicolor
gtccacgtctagtaggcagcaccgcggcaggcagccaggcctgagacgcccaggctcctgctcccgactcgccggctgcactccccctgctcctggctcctgcagtcctgcatctgtcatctgtgctgcttctgcacatctcggcaacttgagagacaagcagggttgcatcccggcatcccgcaatgtcagctcccaacagtgatagcaacatgcagcagctagtccctatagcaccaccaggaaaggcttctggtgctgacagtgggaaggagctggttgtggcggatcctggaggtaagagttcaggaggtgtaaaactgcgagaggacgaggaggacctggaggtgaagctcaggcgcatcatggagaatgtccctgtgcgtgtcagtaacacatcagggtcctctgctggctctggctctggtgatttccaccagtatcggcaaatgcggaggagagagcaggaccggctagctcgaatggatgctgactaccagaagagaaaagagatggctgagtttgaactgcggagggaggagaggatcaaagctgctgaggagcggacagccaagaagcgcctgaaacggcataagaagaagcagcgtaagaaagagaagcgagctaaaactggtaataatggtggtgaagatcctaacagagtggattcgtctgatgatgatgaaggttcagatgacgatgacaagtccaagcaatgacacgccaatttgcatctgaagatgatttctcactctggttgtctgggcaatgaactaacgcctgtatggcagttgtaacaggctgaatctggtgct

SEQ ID NO: 128 - DNA, 765 bp, Zea mays
catttgaaccggaggctaccgctgcctcaagggcctcctcgctcgctcgccagtcgccacccgctcacggagacagagaggccgatggcgagctcgctggcccgcctgggagcggcgctgccacgcgcgcgcccacgcgctgcgacccgcaccctgccaccgccgcggtgggacgccgcggcgctcggcgcctcccgccgcgccgcaccgaacgtttgcaggtgcctagttcattccgacgttaaagtagcccctacatcggacttcaaggacagtagcaaatctgaaacttggaggatcaagatgctctacgacggtgattgccctctctgtatgcgtgaggtaaacatgctaagagaaagaaacaaatcctatggagcaataaagtttgttgacataagctcgaaagattactctccagatgacaatcagggccttgattatgaaacttccatggggaggatacatgcggttctttcagatggaactgttgtcacagacgttgaggcatttagaaaactgtacgaggaagtaggacttggatgggtttatgctgttactaagtatgagcctgtagctagcatggcaaatgcagtatatggtgtgtgggcaaaataccgtatgcaaattacaggtcgacctccgctagaagagatcatggcatcccgaagagctgcaggtgaatgtaaagatgacaaagtatgcaagatgtgagcataaagatgttctactgtgctacatacctcgcctctagccatgctttat

SEQ ID NO: 129 - DNA, 647 bp, Hordeum vulgare
attaggcgcgtgagacgacgaaccccacgaccagaagcgcagcgcaagtgagccatgctagcctcgccggcgctcgccggcgccacccactccttcctggccttcgtgtcgggcagccgcagcatccacctcccgtccgcatccgcgccctcgcactcgccgtcgcggcgggccgccctggtcgtcctcgccaaggccaaggtgtccacgcccaatgccgaccgcatcgcccgccacgaccgcctccgcaagaaggtgagcggcaccacggagaggccaagactcagcgttttccgctcaaacaagcatctgtatgctcaggtgatcgacgacacaaagtcgtgcactctggcttcagcctcaacaatgcacaaatctctttcaaaggagcttgagtactctgctgggccaacaactgaagtggcacaaaagataggtgaagtgattgccaaatcttgcttggagaaaggaatcaccaaagtggtctttgaccgagggggtttcctctaccatggccgcatcaaagctctagctgatgctgctagagagaatgggcttgagttctgaattttcctgtcgatattgtaatattctcttgttttccccgcctgttgaacaattctttctgtagtcattggagtcgctag

SEQ ID NO: 130 - DNA, 479 bp, Hordeum vulgare
ctctcagacggtcacatagaaagcacactgctgctgctctacttctagttcacttccttccggtctcgtgccaccaagctcccactcccacgaaaatgtctacggtgacccgcgcctacctcgaccagaggctcgctgcagccaagcgctgctccagagaggctgccatggcgggagccaaggccgcggccgtcgccaccgtcgcagccgcagtccccacgctggcgagcgtgaggatgctgccgtgggcaaaggcgcacctgaacccggccgggcaggcgctcatcatctccaccgtcgccgggatggcctatttcatcgtcgccgacaagacaatcgtctccatggccaggaagcactcctttgacaacgccccgccacacctcaagaacacctccttccactaattaggctgtagatcaaataatgcgcagcaagttctatacgcctccccgaacttgtctgctgaaattgggtag

SEQ ID NO: 131 - DNA, 1714 bp, Hordeum vulgare
ccgccatgtccaaagcattcaccaagtccctcctcttgtacaacaagatcctcgtccggcgtctcaagtccctcatcccccgtgcgccacccgcgccgacgtcggccaccgagagactgccaccatcacacaggcgcgagtcgtcgacggcgccgctggacgcgctcccggcgccgggaacgaccgacgatggcaacaatattggtggcggtgctggcggcggcaccatcgtgtgcgaggtggagggcggcctgctgatgtccccatccaccttcccctacttcatgctcgtcgccctcgaggccggcgggcttctccgcggcctcctcctcttgcttctctaccctctcctccgcctcctcacggacgagctcgccatgaaggccatggcgatggtgaccttcgcggggctccggaaggacgcgttcggccggctgggcatggccgtcatgcccaagctgttcctgcaggacgtgagcgccgaggtgttccacgcggccacgtctgctccaacggcggcggccgggggcgcgcggcgaagacggcgctgcgtgtgcgtgagcggcatgccgagggcgatggtggagccgttcctcaaggagtatctcgccatcgacgccgtcgtcgcgccggagctgagggagctcggagggtactacctgggtctcgtggaggacgaaggagaggcggtgaggaggatggatgtggaggaggtcattggggccaagggcggcgccgtcgtcggcattggtgggctgcggtgctcctttcagcacatcttccaaaagtactgcaaggaggtgtacgtgccaacggagtcgacgcggcggcggcgcggggcgctgcacccgcggcggtacccgaagcccctggtgttccacgacggccgcaccgcgttccggccgacgcccgccgccacgctcgccatgttcgcgtggctcccgctcggcgcgccgctcgccctgctccgcaccgccgtgtttctcctcctcccgttctccctctccgtaccgctcctcgccgccctcggcatgcacaaccgcatgatcgcgtcgtcgccgccgaagtacgccggggtcgacaagagcaagagcaagagcaacctcttcgcgtgcaaccaccggtcgctgctggacccgctctgcgtgtccgcggccgccggccggcgcgacctcgccgcggccacatacagcatcagccgcctgtcggagatgctcgcgccgatccccacgttccgcctcacccgcgaccgcgccgccgaccgcgcggccatgcaggcccagctcgcccgccgcggcggccgcggcgggctggtggtgtgcccggaggggacgacgtgcagggagccgttcctgctgcggttcagcccgctgttcgcggagctggcggccggcggcgtggacgtggtgcccgtggcgctgcacctggcggtggacatgttccacggcacgacggcggggggcaggaagatgctggacccgctttacctgctcatgaaccccgtgccgtcgtacctagtgcagttcctcgaccccgtcgagtgcggcggccaggaggcgcgggccgtggcgaacgaggtgcagcggcgggtggcggaggcgctcgggtacgagcgcaccgggctgacgaggagggacaagtacctcatcctcgccggcaacgaaggggtcgtcggcgcccacgacggcggcatgaagaattagctgcagctgta

SEQ ID NO: 132 - DNA, 1479 bp, Hordeum vulgare
ctctctttccgccttcacttcctcccgagcctctcctcttctcctgctcctcacggcggcggcggcggcggcgatgcagatgactgctgctaaaaccgatgtcccggcggcagctgctccgcacccacatccccacgcccatggcccgcaagtaccgcacggtcacgggcacccgcatcctcaccaccacatgccgcagccgcggtgggtggtacttccctacccgccgccgccgcctatggtggccgcgccgccccctcctacgccgcagtatgtgaagcatttcgcgccgcaggcatcggtgactccgcctccgccaccggctggatccggcgggaacggaggtgacgagaaccggacgatctgggtcggcgacctccagtactggatggacgagaactacctccacagctgcttcggccccagcggcgaggtcgtgacgattaaagttatccgcaatagacattctggagtttctgagggttatggttttgtagagttctattcccatgcatcagcagagaaagcacttcagaatttcgctggtcatgtaatgcctaatactgaccgagcttttaagttaaattgggcatcatatagtgttggagaaaaacgctctgaacttgcttctgatcactcaatttttgttggtgatctagctgttgatgttactgatgacatgttgatggaactttttgctaacaaatatcgttctgtgaaaggagctaaagttattattgatgcaaacacgggccgttctaggggatatggatttgttaggtttggagatgatattgacagaactcattctatgactgaaatgaatggcatgtattgctctactcgaccaattcgcattggacctgcaactcctagaagaacttcaggtgattctggcacctctccaacaacacaatcagatggtgactcaactaacaggacagtatatgttggcgggcttgaccccaatgttagtgaagatgaactaagaaaaacatttgcaaaatatggtgatgttgcttctgtcaaaattcctgttgggaaacaatgcggttttgttcagtttatcaacagagctgatgcggaagaagcattacaagggttgagtggatcaacaattgggaagcaggctgttcgtctttcttggggccgcagtccagcaagcaaacagtctaggggtgattctggccatcgacggaatggcatgtactatggcatgcctttctacggtggatatggctatgcgtcgccagttccacacccaaacgtgtatgctgcggcttatggagcctaccctttctacggtaaccagcaactagtgagctgatgatagaggtcgtctctgtttcctcccaacaccagtagaaaacaaggttttggtccagtaagaatactatcatgggatgacatactatagatggccataaaagcgggcgagagagacaggtatatgtatgtgatgtctgcagatttgtgttg

SEQ ID NO: 133 - DNA, 2153 bp, Hordeum vulgare
cagaaccagtaactcgcactgacccccgctccgatctccccaatcccctccaaatccctcgccggaaccctagccccgcgccgccgccgccgccatgcctccgcgccgctctaagggaggggccgggggccagcccgactccgaagccagcgacgccgagcccgtggagaccgcggtcgacgccatgtccgaagacgaggccgacgacggcaactccaacgaggactccgctgagagcggagctgacgatacggacggcgaggcctccaaggaggaagccgccgataccaaggccgaggagatggatgcggagcatgaagaggaagctggcgcaaccaaggccgaggagatggtcgccgaacctgaagccaatggtgcagatgcggggaccaaggtcgaggcggcggaggccaaggtcgaagaggaagccgcccagagcgactctgagcgcaaggcaggtgcccgagaagccgatccagaagcggaggcagaggaaaccgacggcgagaatgaagagcaagccgctcggaccgacggcgggagtggagaggaagctgccgggactgttggcgaggacgaagaagaagccgccggcacagacggcgacaacgccgctgaggttggtggcgagaacgtagatgcggattctgaagccgaaggtgagggtactgatgccgagcctgacgctctggaggaatcccctcccccctctcctccagcccgtagccgccgccgcaagcgagtggtcaaacccgacccgcctactgaggatgacgaggaagaggagacccctctgccttcacgtcggcgccggcgtcgcaaagcaggagaacgtggcgattctcctccgccactgccggataacctccggtgccgcagaagtgatggtaagaagtggcgctgctcagctcgtgcactccccactgtcagcttttgcgagtatcattatgccaaggctagcaagggcaagaaaccgccagccgatggggaggtccttgccgtggctctccaacggcaaaagaagaacaagagaaagggaagaaagcgcttaaatctggcgccagaatcaccaaaggccacaagggatctccctaatggattgatgacaatttcaccggggagcagtgggccgctaggctcccctgtgactacaaaggttggagtggatattcccgcaccactccggcggtgctaccgttccaagaatgctgagccagtgcctgttggccctgtgaaggtcgttcctcatgcaatgagtaaagcaaaggcagcacagatgtcatgccaccgttgtgggttgaagaaggtagcacgcgttgtcaagtgcaagaactgtgaaaacaagtacttctgcaacagctgcatcaataaatggtattctgggatgtccaggaatgatataaagatccaatgcccggtttgccgtggctgctgtgattgcaaaaagtgcacccttggtcagaccaagggaggtatgcggaaggaatcaccaggtggtcaagggaaactaatcaggatcaaaatctgcaatcaccaattttacaagcttttacccttgaaacttgaccaggaacagcttgatgaattggaaattgaagctaaaatacaaggaacaaagttatccaatgtccgcgttcaggtagctgaagatgaccagagcgggtcactttactgtaataactgtaagctgtccgtgcaccaagccttgagaagctgcccaagatgcccttttaagctgtgcctaagttgctgtcagaagatacgtgaagggagtatgtcaggcagcacccctgaagataaatttacacaacgactgttgcagcaagagtcagcccatgaggatggcagcataagttgcccttccattgagttgggtggctgtggcgactctctgttaaacttgatatatacatccccatctgatgaccagtcgggggaactaagttcaggagacgagctagatgctccaggcaatgactctggagttaaagatgcacaagatcattcctcgcctttagccgagagtaatggtagtcttgccagattatccggtggtcagcaggaatcgatgtccacataatctctggtgattttgcagcagatacccacccatgcatcttttggtgtgtgagatgggatatggtctgaagtgg

SEQ ID NO: 134 - DNA, 1344 bp, Hordeum vulgare
gagaagccgagaagcaatcaggtgccagaagcccagagccaaccagcctcagcgcgcgcgcgcgtgtgtggtggtgggaggttcttcagcagcttgcggggctagagcggcggcagcgatggcggcgtccgtggccacctccccggcttgcagccggctcatccccagcagacccctctccgcctccgcctccgccgccgcgccgtccctcgtccgcctggcggggtcctccaggcgcctccgccgggccctgcgggtctcggccgcggcggagccggccgacgcgctgccggggcccggggccggcgacctggacggggtggtgccggcggggctgctggaggacctgccggagggcctcgccttccagggcgatgtgggcgggggtttcgcccccggcggcggcggcgacgacggcaacaagatgctcgaccgcggcatcaacgcggccatcgtgctcggcgccagcacctacgcgctcaccaagctcctcaccgtcgaccaggactactggcatgggtggactatctttgagatcctgcgctacatgccggagcacaactggtcggcctacgaggaggccctcaaggccaatccggttcttgccaagatgatgatcagcggcgtcgtctattccctcggcgactggatagcccagtgctacgaaggcaagcccatcttcgagtttgaccgtactcgcatgttccggtctggcctcgtagggttcaccctccacggatccctttcgcactactactatcacttctgcgagtcgttgttcccgttcaaggattggtgggctgtgcctgtcaaggttgcgtttgatcagacggcttggtctgcgctgtggaacagcatctacttcgtcgccctgggcttccttcgctgggaatctccgttcaccatattcagcgagctcaaggccaccttcttccccatgcttactgctggatggaagctgtggccatttgcacacttaattacatatggtgtggttcctatcgaacaaagacttctctgggtcgactgtgtcgaattaatctgggtcaccatcttgtcaacttactcgaacgagaaatctgaagcaaggatcttagatgattcctccacaacagatacgcaggacaactccagatagcacatacttcatggttttgctgttttatagattggaacagcggaaactgctccggcttcgttatgttgggattgtataaattgtatgtacagttagttgccagcgctgcgtgtgtaaaaaaaaaagccttgcatctattgcaagcaaattgtgctggccaaacaaaacgaaaaagaaattgtctcaagggagatcaactcctgatg

SEQ ID NO: 135 - DNA, 663 bp, Hordeum vulgare
cctcatcacctagctctccttgccttccttcaagttccaactgctatggatgccatcagactcagcctcctcatggtggccgtgatggccgtcctgagcaccgcgtcggcggcgatctacaacgttggcgaaccgggtggtgcgtgggacctcagcaccaactacgacacctgggcgtcctctaggaagttccaacccggcgaccagatcgtcttcaagtactcccctcaagcgcacgacgtccttgaggtcagcaaggccgactatgactcctgcagcaccgccaaccccattgccaccctcaacaccgggaacgacatcgtcacgctcaacgccaccggcacacgctatttcatctgtgggtttcctggccactgcactggtggcatgaaggtcaagatcgacgtcgtgcctggctcctcctcctcctcgcccgccccagccagcggccccagtgcaagcaacgctcctccgcccacgcctgtctctaccgccaactctgtggaggccacggggtttggcctcgccgtcttgcttgcctttgccggtatcatggcttgagtacatgttgtcgccccacgcacatgcatattttatgtatagtcaaggaatcattattagcgagtatacgtgtgtatactcgactaattggatatgcgacct

SEQ ID NO: 136 - DNA, 1425 bp, Hordeum vulgare
aaggcaaacaagactctctctctctctgctttctccccgtttgaggtttgacctctcctccagctccagaggccccccgcaagtctctcgcgacgaccgtcgccggcaatggcggccgcctcggaggagtccgtcaagcagttctccgcgctcatggagcagctggaggagccgctcaagaccacattccagaatgtgcaccaaggatatccaagagggactctgctgcgttttctaaaggccagagaatggaacgtccccaaggcttataaaatgctaatggattgcttgaattggaggcttcagaatgagattgacagcgttctagccaaaccaatattgcccgctgatttgtatagatctattcgtgatacgctacttgttggattaacaggatattccaagcagggtcaacctgtctatgcatttggtgttggactcagtaccttcgacagagcatcggtgaactactatttgcagtctcacatacagatgaatgaatatcgagatcgtgttgtcctgccaggtgcatctgagaggtccggaagacagattaacacctgcttaaaagttatggatatgactggcctgaagctttctgctttgaaccaaataaagatgttgagcacgataacagctgttgatgaccttaattatcctgagaagaccgagacgtattacatcgtgaacgctccatatgttttttcggcatgttggaaggttgtgaagcctcttttacaagaacgaactaagaagaagatcaaagtcttgtatggccctggaagagatgaattactgaaggtgatggactacgcgtcgctcccgcacttctgcaagagggaagggtccggttcaggttcgtcgtcggacgaagtcgactgctactcgtacgaccatcctttccaccagcagctgtacaactatgtgaagcagcaagctgcgaggaaccaggaggacggcgccggccccgtgaagcaagggtcgatgcatgtgagggtgccgacgccggacctggaggaggccaagatcatggagacgatccagtcggaactccacagcctcaagggaggtgacggcatttcccgctccttcaacaggatcaccatcgaaggcccgtgagtgatgatcggagccgatccatgatgatcggagcgcccgagatcgcgccgcggagggaggtaatcgcttatcgctatcttatttgacgccagaagatttctctggggtttatggcggttcttgcttgcattgtaaccgctggctgcaaggctcgactaggatcatgtcggtagaggaagtagtagcagcagtagtaaaacatcggattctaataaccgagttgagtctgtatcgtgttgtcgtaagatggtggtagtaatttagctatgattaaccctgctaatggatgtaatgtaccatttgcgc

SEQ ID NO: 137 - DNA, 2281 bp, Hordeum vulgare
ctccaatggattactccacctccctcctccgcctcaccttcctcgccctcggcgccgccctcgtcctcctcgtcgcccgctccgcctttcgcctgccgctcgccatcgacgccccagccgcctccttcttacacggcgccggcggctgcacccggttctcgccgtgggcctgccgcccaccacgaacagacacgtccccgccacgtcgtccgtcgcacgagaccgacgtcccgcgccacccgctcgacccgctcacggtgacggagatcagccgcgcgcgcgagatcctccgcgcgcacccgccgttcgcgtcggcgccgtcggccctggtcgtgcacgcgctggcgctcgacgagccggacaagcccgccgtccggcgctggcggaagggcgcccacgcgctcccgcctcgccgcgccgtcgcggtcgtccgcttccgcggggagtcccacgtgctcgccctcgaccttgccaccggctcggtcgcccctctgcccacgccggcctcgggctacccgacgatgaccatggacgagatgaccgccctctgcgcggcgccgttcagcgacccggcgttcaacgccaccatcctgcgccgcggcgtgcgcctgtccgacgtcgcgtgcctgcccatctcccccgggtggtacggccccgccgaggacgacggcggccgccggctcatcaagagccagtgctactcgacggagggcaccgccaacttctacatgcgccccatcgagggcctcaccgtgctcatcgacatggacaccgggaaggtcgtccgcatctccgaccgcggcgccggcatccccatcccggccgccaagaacaccgactaccgccacgccgccaacgcagataaattcgggtaccagacggtgcgggcgccgtcgatggagccggcgccggaggggccggggttcgaggtgtcggacgggcacacggtgaggtgggcagggtgggagttccacctgaaggcggacgcgcgggcggggctgatcgtgtcccgcgcgacggtgcaggacccggcgaccggggcgaggagggaggtgatgtacaagggcatggcgtcggagctgttcgtgccctacatggacccgacggaggcgtggtacttcaagacgtacatggacgccggcgagtacgggttcggcctgcaggccatgccgctagtgccgctcaacgactgcccgcggcacgcgcggtacatggacggcgtgttcgtggccgccgacggccggccgtacgtgagggagaacatgatctgcgttttcgagcggtacgccggcgacatcgcgtggcgacactccgagagccccatcaccggcatggacataagggagtcccgggcgaaggtgacgctggtggcgcgcatggcggcgtcggtggccaactacgactacatcgtcgactgggagttccagaccgacggactcatccgcatcaaggtagggcttagcgggatcctgatggtgaagggctcgccctactcccacatgaaccaggtccggcaaaacgaggagatgcacggcaccctcctctccgagaacatcatcggcgtcatccacgaccactatgtcaccttccgcctcgacatggacgtcgatggcgccgacaactccttcgtccgggtcgacatggctcgccaggacaccgcacccggcgagtccccgcggaggagctacctcaaggcaacacgccacgtcgcgagcaccgagaaagacgcaaaggtgcgtctgaagctctatgagccggccgagttccacgtaatcaacccgaccaagaagacgcgtgtcgggaacccggtgggctacaaggtcgtccccgccggcaccgccgccagcctgctggaccccgaggacccgccgcagaagaggggtgcattcacaaacaatcagatttgggtcacgccctacaacaagagtgaagaatgggccggtgggctgttcgtgtaccagagcaaaggggaggacacgctggctacttggacggagagggaccgtccgatcaagaacaaggacctggtgctgtggtacacgctggggttccaccacatcccttgtcaggaggacttccccatcatgcccactgtgtcgtccagcttcgacctcaagccggtcaacttcttcgagagcaaccccatcctcaagcagcgacccaccatggagaaggatctccccgtctgcgtcgctaccgcgtgagaacatgcaccacaatacatgtgtgctctcgacgtacaacactgggatgttgcccggggcatgaggtcgtgcgtagg

SEQ ID NO: 138 - DNA, 591 bp, Hordeum vulgare
aagaagccaccagcctcctcctccctcgccgccgcccgccgaggttggtcgccggacgccatggctcccaccaagaagtcgaagaagagcacggagaacatcaacaacaagctgcagctggtgatgaagagcggcaagtacaccctcggctacaagaccgtcctcaagacgctccggagctccaagggcaagttgattatccttgcaaacaactgccctccactcaggaagtctgagatcgagtactatgctatgctcgccaagatcagtgttcatcacttccatggaaacaatgtggatcttggaactgcctgcggcaagtactacagggtgtgctgtttgagcatccttgaccctggtgactcggacatcatcaccaccgttcctcagtgaagacaaccttacctatcctagtcttaagacgatgtagcgtggagagtcatgctggccgtctcttgttatcgagccagagctgccaatcgcagtttcagaccaaacatggctgtttttgtaaggcattcctatggttttgttttatgagatgtttattcctatgtggtccttttactgtgtgcgattggatgattagtg

SEQ ID NO: 139 - DNA, 1320 bp, Hordeum vulgare
ctagttcccgagtcgtacgtgatcccgccgaagcgtgagctcgagcaacagccacgcaggcaggaaccaggatggtgaccaaggtggtggacctccgctccgacacggtcaccaagccatcggaggccatgcgtgccgccatggccgccgcggaggtggacgacgacgtgctgggcgcggacccgaccgcgcagcgcttcgaggcggagatggccaggatcatgggcaaggaggcggccctgttcgtgccctcgggcaccatgggcaaccttgtctccgtcctcgcgcactgcgacaccaggggcagcgaggtcatcctcggggacaactcccacatccacatctacgagaacggcggcatctccaccctcggcggcgtccaccccaagaccgtgcccaacaaccccgacggcaccatggacgtccacaagatcgtcgctgccatcaggcaccgggacggggccatgtattatcccaccaccaggctcatctgcctcgagaacacgcatggaaattctggtgggaaatgtatatctgtagagtacaccgacaaggttggtgaagttgctaaaacccatggcttgaagcttcatatcgacggagctcggatttttaacgcctccgtggcacttggagttcctgttcatagacttgtgagagctgctgattcagtttcggtgtgcctatccaaaggtttaggtgctcctgttggatcagtaattgttggttccaaggccttcatatacaaggccaaaattcttaggaagacactaggtggtggaatgaggcaggtaggaattctctgtgctgctgcctatgttgcggttcgcgacaccgtaggcaagctcgccgatgaccataggaaggccaaagttttagcagatggactgaagaaaattaaacagtttacagttgatttagcttcagtggagaccaatatggtattctttgatatcgcggatccacgcataacacctgacaaactgtgtcaagtcctggaacagcgcaatgtgcttgcaatgccagcaagctccaagagcgtcagacttgtcactcactaccaaatttcagacagtgacgtccagtatactttgacatgtatcgagaaagccgtggaggaaatcctgtcaggcaatgctaaattcgagcacctgacaaacggcaccaccaccaactcgtatgggcactaggccacggcacctcctttagagcccacctatggctatgggctatggacggactgcggcatccgagcagcttgtttgtggccgtgggctttgtagtaccagtaacaactttgcagaataatgtgtggcgttt

SEQ ID NO: 140 - DNA, 1183 bp, Hordeum vulgare
attacttgccgtaccacaccagtgaacccccgccccactccacttccgcctcgctccccaacctttcatggccggcaacaccctcgccgccgcgagattctccgcggccgttacgctcctccgcacccgccgctccccggtggtcgccgtgccgctcgccccgtccggtctccgccaccaccgccgcagcgtcggcatggccgccggcgccgcgccctcacccattcccgcctccgatccgcttcccaagggttctgatctatttttgcggtcagttctctcaaacatgcaaaaagtctatttgagtaggaatccaactgcagaaaagattctggaccttgtccattcttatgatggggacaacatttgttttgatcactttgctttcagaacatttggggttgatggttatggtataaactcacttgcggaattttttactgattttggttacgagtctcgtgaagaactaaggtttccagcaaaaaaactgagagcactatggttttcccctcccaacaatgatggatactccagaactggtatatatggacctttgccaagaatattcatttctgaacttcttgtagatgagctgagtgctccgagccaggaaattatacggaaatacatcaaaacatcagctaatggaaataaatatgctgttcttgcaagtacatttggggagctgacatgggaaaagcctacttattctgatttccaggttctatctagggaaagtgaatatgctggatggactcttgttaatggctatgcactgaaccatgccacagtttccactcatcgcttagagtcagatatcagaagtattagtaagtttaacaaatttgtggagaacaacggattcaagttaagtaccgaaggaggaattttgaaagtgagccctgacggtctcctccagcaaagctcaactgtagctgattcatcattatttacttttgctgatggaatcactgaacctattccacgttcctatattgaatttgctgaacggctgccactcccacagttcagagatttgcaagatgaagaggtcaaggaacaccacaggcgcgatggtttcgaggtaggcaatgcagacaagatatttgagagcacttcaaaggatcagcttacccgaaggtctgcataggcggtgtactcttgatcgaacattctgcag

SEQ ID NO: 141 - DNA, 1652 bp, Hordeum vulgare
atcactctcccgtcccctcgcactcccacgcccgccgccgccgccgccgccgcagatccccctcctccggcgcgccgccatggactacgagcgcatcgagaagccgtcgttccccacgcagggcgggggcttctcgccgaagcggctgcgcgcgatgctgctgggcgtggagaggcgccgcaaggacgacggcgtggaggggcggcagcaggaggaggaggaggaggaggagtacggcgcggtgcccatggcctccgtcagatccgacgacgacgcgcgccgaggaggcagcgtctgcgaagaatacaaggacgtggacgtggtgagcacgatgtcggggtcttcgtcctcgctggacaccgggagcgggcaccggtcgcgggactcccactccatgggctcgaggttcagggtgcccgaggaggactcgtgcgattcagagagcgtggcgtccaacttcgagttccataaggagcgaggggcctccgctcggtcagcgcccacggcggtggtcgcaccgttctccaagcccccgccgtcgaagtgggatgatgcccagaaatggatcgccagcccggcgacgaaccgtcctggtagggctggtggagctttcccaaggaagatggagaaaactggctttggtggagggaggctgccgccgacgaaggttgtgctggaggccatggaggaaatagataccaagaggatcgattcgagccaagagaagagggagattgggtggcagaaagcggcgaactgggccacgccggagccctatccagaagtggagccttgtgcaaagtctgcacctggtgcagaaagtactataattgattcagctgttactttgagctgtgattcatctaccacacttcatagtgccactgcatgcatacctcccccaccaacaggccggtcagtatcgatgagggacatgggtactgaaatgaccccaattgcaagccaagaaccatcccggacaggaacacctgtgagagcaacaagcccggattgctctcggccaactactccacgaaggacattgggtatcaatgcagctggcggtgttatcaaccgcggtgaatgtagcaatgcagatttaagcgaagaggagttgcaaatgaagactaggagagagataatgcttcttggcacccaactaggtaaaaccagcatcgcggcatgggcaagtaagaaggaagaggaaaaggacgcatcactttctctcaagacagtgtcatcagaccaatctgcacaaaatgcaaccgaaatacgtgcagctgcttgggaggaggcagagaaggccaaatacttagcaaggttcaaacgagaagagatcaagatccacgcatgggaagatcaccagaaagccaaaatcgaagcagaaatgagaaaaattgaggtcgaggtggagaggatgcgagcccgtgcccaggacaagctgatgagcaagctcgcgtccacaaggcacactgcagacgagcagcgagctgccgcagagtcgaagagggaccagagcgccgcgaggactgcagagcaggcagagcacatcaggagaaccggccggatgccgccctcgcttggctgctggaactggtgctcgtagccccagaagaagaaaacagcatgtgttgttcctctcaactggtgaa

SEQ ID NO: 142 - DNA, 506 bp, Hordeum vulgare
catccgcaacggccatggccttcgccgccatccacgcccgcctcgccgtcttcccccctcgcctcagcgccgccgcgtcgtctctccgctccgcacctccccgcgcccgtctcccgcagctcaggacttcagccggataccgctgcctccgtagcccgcggtgccgccggccgtgtcgcgctcgcgccggctgcatctccatcacagcgtcgctcgacctcaccgaggacaacgtccggcaggccatcgtcgacgctaaagccgagctggcccagctgttcgacacgtcggtcggcataacaggacaagttgatctggcggagctggacgggccgttcgtgaagctccgactgaagggaaagttctggcacacccgcgccaccgtcgtcgcgcggataggcaactacctcaagaaccgtataccggagattttggaagtggagatcgaagatgaggaccagctcgacgacagccccgcggcttactgagattactgaagacctgaa

SEQ ID NO: 143 - DNA, 1248 bp, Hordeum vulgare
aaagtcgaccgaagccatgacgttatcccctcacacactctgcccaccccttctccccccgctcccgccaagttcaaaccgccgcccgccgccgcctcgctcccgcccctgcccccgcatactcctcccggcgctcgcgggccgccggagccgcgtactcctcgcgcggccgccgcgcgcgggtgcgggcgcaggggacggcatggcgtcgcaggacgcgcactaccccacgctgctcgagcacatgggccgggccggcgcgcccgccgacctcgccgtcctcgtcgcccacatccaggccgcctgcaagcgcatcgccgcgctcgtcgcgtcccccggcaacgccgacctctcgcgggccaagccggcggccgctgccggtggggcgtccgcggccgggcgcgacgcgcccaagccgctcgacgaattgtcgaatgagatcatcctgtcgtcgctccaaagctctggaaaagttgcagtggtggcgtccgaagaaaatgatcaccccgtttggatgtgcgatgacggcccctatgttgttgtcaccgacccgctcgatggttctcgcaacatcgaggtgtcgatccccactggaacgatattcgggatatacgataggctggtggaactcgaccatctccctgtggaagagaaagctcagctcaattcactgcagagcggttctcgcctggtcgctgctggatacgtcctatattcatctgccaccatcttctgcatcagtttcggtgagggaactcatggcttcacgttggatagatcgacaggagaatttgttctgacgtatcctttcatgcaaataccccctagaggacagatatattcagtgaatgatgcgcggtatttcgactggccagagggcctgaagaagtacatcgacacgatcagacaaggcaaggggcagaatcccaagaagtactcggctcggtacgtgtgctcattggtcgctgattttcaccggacggtcatatacggtggagtcgcaatgaacccgagggatcaccttcggttggtatacgaggcaaatcctctcagtttccttgccgagcaggcaggggggcgaggctcggatggcaaaaccagaatcctctccattcagcctgtgaagctgcaccagaggctgccattgttccttgggagcatggaggacatgcttgagctagaaagctatggggatgtccagcagaaagtcaatcctggatacgatgtttaatgttaagcggatcctaa

SEQ ID NO: 144 - DNA, 1144 bp, Brachypodium distachyon
cagcatcctgatgtccgtcgcgtccgctgccgccgtccggtccgcgtccggccgccgctgcggcgtcggctctggcctcaacggaggcaataagtttctgatgatgcagaggagagacatcgtgaccaaggggatcgcgctctccgtctgctcctcgctcctctcttcctccaacggcgacgctcaaggattggagaggttgccgttcaaggcggacgggtacaacttctggacatggcggggccgcaggatccactacgtggagcaaggggaagggcagcccatcgtgctcgtgcacggcttcggcgcgtccgcgttccattggaggtacaacatcccggagctggccaagaagtacaaggtgtacgccgtggacctgctgggtttcgggtggagcgagaaggcgctggtggagtacgacgccaccatctggatggagcaggtctccgacttcctcagggaggtcgtcaaatcgccctccgtcctcgtcggcaacagcttagggggattcacgacgctgttcacggcgacggagctgccggagctagtccggggcctcgtgctgctcaactccgccgggcagttcggggaccccaatgcgccgccgcccattgaagcagaggaggaagtgggcgtgttgagcaggctgctcgtcaggccgatcaaggaggccttccagcgggtcgtgctcgggttcctcttctggcaggccaagcagccggccagggtcgagaaagtcttgaaaagcgtgtacaaagaccccagcaacgtggacgactacctcatcagctccatcacggcgccgacggcggaccccaacgccggcgaggtgtactacagactgatgtcgcggttcatggcgaaccagagccggtacacgctggacaggctgctggggaagctgtcgtgcccgctgctgctgctgtggggggacctggacccgtgggtcgggccgtccaaggcggcgcggatcaaggaattctacaaaaactccaccgtcgtcaacctgcaggcgggccactgcccgcacgacgaggcgccggagcagttcaacgcggcgctgctccagtggctcgacacgctggaggagactggcaccggcggcaagtcggccgagcccagcctccaggccgtgtgattctga

SEQ ID NO: 145 - DNA, 1047 bp, Brachypodium distachyon
accaccgaagaagcctcagcctctccgaggggccaaacagaaatggcggcttcctgcacgctcgcggtctctcctgccttcgccgcctcatgctccccctccagttcatctcgccgctccaggcgatttggggtggtggccatggccagcgtggggcagaaggtgtacgccccgggcgtggcggtctccgagggcaacggcgggctaccgaagatcatcctcaaatccccgcatgggagtgaggctgaaatttatctatttggagcatgtgtcacgtcttggaaggtccccaatggaaaggacctgctctttgtcagaccagatgctgtgtttaacggtcagaaacccatcagtggtggaatcccacattgcttcccccagtttggccccggccccatgcagcagcatgggtttgcaaggaacgtgaattggtctgtcactgattcagaagttaatgaaggagatccagctgtaactttggaactcaaagatgactcttacagccgttcaatgtgggattttagtttccaagcatcatacaaggttgcattgcactctacaagcctgtcaacaaccctgaaaataacaaatacagatgataaacctttctcattcaactcagctctccacacgtacttcagtgcttccattgctggtgtttcagtgaaaggtctcaaaggtagcaagaccctcaataaggatcctgaccctaaaaatcctctggagggcaaagaagaaagggatgaagtgacttttccaggatttgtcgactgtgtttacctcggtgcgcccagcgagcttatcctggacaatggattgggtgacaaaattgccatctcaaatgaaaattggtcagatgcagtgttgtggaatcctcacttgcagatggaggcatgttacaaagattttgtctgtgtcgaaaatgccaagattgaaacagtgcaactgggtccgacacaatcttgggtggcagagcagaaaattgaactaatctgaagttcatcggtgcaatctgcaatgtgacacactgcggcagatatgttgtag

SEQ ID NO: 146 - DNA, 827 bp, Brachypodium distachyon
caacagcaacagctaagctacgctaagcgctcgcccaccaaacgtacatcccggccccgagagctagctagcagtcgacccatggctgcagaggaggctaagaaggtggaggtggaggtgacgccggagcccgaggctccgccggccgtgcccgccgcggagcccgaggcccccgccaaggacgtcaccgaggagaaggccgtcatccccgcgccggccgccgaggaggagaagccgcccgtcgatgactccaaggccctcgtcgtcgtcgagaaggttgcagatgagaaacccgcagatgagaaggccgcacatgggggctcaaatgacagagatattgctcttgcaagggtggaaactgagaagagaaactctttgattaaagcatgggaggagaatgagaagacaaaggctgagaacaaggctgctaagaaggtgtccgccattctctcgtgggagaacaccaagaaagcaaacatagaagctcaactgaggaagattgaggagcaattggaaaagaagaaggctgaatacgcagagaagattaagaacaaggctgcaatgatccacaaggaggccgaagagaagaaagcaatggtcgaggcgaagcgcggggaggaagtcctcaaggccgaggagatggcggccaagtaccgtgccactggcaactctcccaagaaaaccatggggtgctttggggcctaaagaaaaaaaaaacgttccttggtcacaaacgagcaagattgaagtgttcatccgaggttgctttcttccgttttctttcacccgtccaaagtgtgcagtgtgccctgtgtgtaaagtctgtt

SEQ ID NO: 147 - DNA, 1181 bp, Brachypodium distachyon
gattcgatgccttgcctcctcctctctccggccgcctccctacgagtttataaacccaccgcacagtgcccgcacggccgcacccttctgctccgggctacgcacacagggccggagcctgtggccgcgccgccccatttctggggagcgtctgaggattagattggattccgttttggggagcacgaagaaaggaaggaaggatggtgcggggcaagacggagttgaagcggatagagaacacgacgagccggcaggtgaccttctccaagcgccgcaacgggctgctcaagaaagccttcgagctctccgtgctgtgcgacgccgaggtcgcgctcgtcgtcttctccccgcgcggcaggctctacgagttcgccagctctgccagcctgcaaaagacgatcgaccgctataaggcatacacaaaggataatgttaataagaagacagcacaacaagatattcagcaaatcagagctgacactgtaggcttggcaaagaaacttgaggctcttgaagattcgaaacgaaaaatcttgggcgaaaacttaggagaatgtactactcaagaactgcatattctggaagctaaaattgagaagagcctccacatcatcagagcaaagaagtcccagctgctggaacggcagatagctaagctgaaagagaaggagacgatgctgctcaaagataatgaggaattacgcgaaaagcagcagcatctcgccgcactgatggtggttccctccctgaaccatgttgcgctttcgcctttgcagcccgagcccgagccggagcctagcagcgacgccattgacaccgtggagacggagctgtacatagggttgcccggcagggagcgcgcctccaaccggcagtcaggttgagccaagtagcacgcgtgcaccgtcagattaatcggcggcaggttcagctcacaggaataagctctcttcagtctgcacctgcatctgcacgcgtgaagtgcccagcccgtagcccactgttaatttctctatgtttagtttatctctactgaaatgattcacctgcacaaaaaagaaaagggtgtaaattagcagccgcgatggcgacaaaatcaacccgcagctgacctccgacatctgaaagaaaatgaaacacccaggagcacgtgcacggttccttcgtttggatgtcta

SEQ ID NO: 148 - DNA, 800 bp, Brachypodium distachyon
atacatgccaacctgttgcttcttaacagaaccaaaaagatttggccttggcctagaagtagctagcaagagagatcttcttgtgggagaaacaacagagagagagagagagagagataaacagagagaagggagacagagagagtgcctttaccttcttccgaagaattcaggaacagggatccttaccagaggtgaagctgatctttgtttgggttggtgagaaatggagaagaaacaaatgaagatggccatcatgaggcaagaacagacattcagacaccaggtaaacgaactgcatcgtgtataccaggttcagaagcaactgatgacggagatgcacgttgttaagatgaaccgggctcaggcaggagaagatactcaagctgaagcaatggtggagacaaatcatctgcaatggtacagtaactcaggcgagaagaagccccctcccgttgaagacttcaacctggagctgacactagcaactgggaatgataggaggaaacaagatatggcatccaactcagactccggcgcaacagtgtcgtcatcaacttctgctgaatcagagtcagggcagcgattccccaagtccaatgtaaacgtaaggtttcaaaataagagcgagaggcatgatgatcagcacatgcagtctccttggctctaccaatgtttaagtctgaagatggcttagctaggcttcagtgtttcagaattcagtccaaacagaatcacaggcattattatgtgtacatcagaaactaatttgttgcaactggaggaacgagctcaataga

SEQ ID NO: 149 - DNA, 4035 bp, Brachypodium distachyon
agatcagggacaagaggtggggggttttgccttcggcaatggagatggctctccgggcgcagagcccgctctgctcccggagccggccggtgctcgtcgtgcggccggccaacgccgccgctgccctcgcgcagcctattgtgaagtgcagcagatttacaagaagcaggcttgttcgatgcatggtagcaagttcagattatcctaagaggaatccaaggagatcatcaactcctaagcccaaaggcacagcctctagaggatatgctccaagacctgctgcggaatccagcacgaagaagattgaacagagcagcactgatgaaggtgatcttgccagaagcaatgtgatgctcggtagtgcaggaatagagcagacaggtactgcagaagaatcatctgaggtcgacctctcaggaaatgttcccagcagcgaggcactggagggagtgaatgagactgagaatgaggaagagattgaccaaaagctgccaccagcattgtcttccacatccatggatgctgagtcaattagtgaagcagcagatcagacaagtaccgttgaagaagcatctgaggtggacttctcaggaaatgtttctagcagcacggcactggagggagtgaatgaggctgaggctgaagaaaaggtcgaccagaagcagacttcagcattggcttccacctccatggatgttgagtcaattgacagagaacttgaggagtaccgtggcaaaataagtgcactggtggcttcaaaccctgggccatcatctcttgctagcaatcaaggacaggacaaaccaatttttggtgttcatgagcaagacaaatcggtaattaatttccatgagcaaggcatatcaattgttgatgtttccaaacaaagtcagttggctgttggtgtcactgaagaagatccaacgaaacaaaccaccataattggtgaacaggatatcgctgaagaagcagtggaggatatagacagcaaattttttgaggatgggcagcttgctttatcagaagatgatgctgggacaagtaaatatgcgcaagaagagccttcagttgctggtgatcaactgaggatatcggaagatggacatgatgaaccagagattcaagaactggtacagaaggatgttaatcttcaagtgctaaagcgaaggcttgaagagcttgctaatgaaaactactcgatcgggtataagtgttttgtttttcctgaaatagtgaaagctgattcagttattgatctttacttaaatcgtagcatcactgccttagccagtgagtccactattcttataaaaggggcattcaatggttggagatggaacctttttactgaaaaaatgcatagaagtgaactagccggggattggtggtgttgcaagctccacataccaaagcaggcatacagattagactttgtgttctttaatggtgacactgtctatgaaaataacaattataatgattttttcatagaaatagaaagtgacatggatgaacactcatttgaggacttcttggtccatgaaaagcaaagggaacttgaaagacttgctgcagaagaagctgaaagggaaagacaggctgaggaggagcgccggaaggaggaagaaagggccattatggaggcttatagggcacaagcaaaggctgaagttgagacgatgaagaatagattgcagcatgtgttgggttcagccagcagacacatggataatctatggtatatagaacctagcacatataaaggaggtgatagggtcagattatactacaaccgaaacttgagaccactaatgcatagcaatgagatttggctccatgggggttacaacaactggactgatgcactttctattgctgaaagactagtcaaatctcatgaaaaagacggtgattggtggtatgcaaatgtcactttacccaaaagtgcattggtgttggactgggtttttgctgatggaccacctgggaatgcaaggaattatgataacaatggaaagcgagatttccatgctgttgtttcaaagagcatatctgaggactttttttgggtggaagaagaacacaggatatttaaaagatttcaacgagaaagaaaagaaagggaggatgcggatcggagaaaggctgaaataactgcaaaaatgaaagctgagatgaaggagaagactatgagagagtttcttctctcacagaaacacatcgtgtatactgagccactcgaagtgcgtgcaggaaccaccgtggatgtcctatacaatccttctaacacagttctgaatggaagccccgaagtttggttcagatgttcctttaaccgttggactcatccaagtggtcctttgccaccgcaaaagatggtgaatgcagaaaatggttctcacttacaagctaccgtcagggttcctttggatgcatatatgatggactttgttttctccgagtcggaagaaggcggaacatatgacaaccgaaatggaatggactatcatattcctgtgtctgattccatggcaaaggaaccacctatgcatatcgtgcacattgcagtagaaatggctcctattgcaaaggttgggggtcttggtgatgttgttactagtctttcacgagctattcaagatttgggccacaaggttgaggttattattccgaagtatgactgtttaaacttaagcaatgtgaaggatttacactgttgtcaaagttttacttggagtggtacagaaataaaagtatggtttggaaaggttgaagacatctctgtttatttcctggaaccacagaatgggatgttttgggttggatgtgtctatggaaggaatgatgaaagcagatttggcttcttctgtcattctgccctggagtttctccttcagagtggttcttctccagatatcatacattgtcatgattggtcaagtgctccagttgcttggctgtacaagcaacagtatgttcataatgggttgccaaatggtcgggtggtatttaccatccacaatcttgaatttggagcaaatcaaattggcaaggcaatggcgcattgtgataaggctacaaccgtttcgtacacatattcaagggaagtgtctagacatggttctattgctcctcactatttcaaattccatggcattcgtaatggaattgattcagatatttgggatccctataatgacaactttatcccggtccattatacttctgacaatgttgttgaaggcaagagctccgcaaaaaaggcattgcaggagaagcttggattacaccaaactgatagccctgtagttggaattatcagtaggcttacagcccagaagggaattcatctcatcaaacatgcaatttatcgaactcttgaacggaatgggcaggtggttttgctaggctcagctccagatcatcgcatacaaagtgactttaccaacttagcccgtaaacttcatggtgaatttgatggccgggtgaagctttgtttgacttatgatgagccactgtcacatttgatatatgctggtgccgactttattctcgttccttccattttcgaaccttgtggtttaacgcaacttaccgccatgcgatatggatccatcccaattgttcggaaaactggaggcctttatgacactgtttttgacgtcgatgatgataaggagcgagcccgtgaacaaggcctagagccgaacgggttcagttttgaaggagctgatatcaatggcgtagattatgctcttgacagggcgatcaccacatggtacgatgctcgcgattggttccactccctctgcaagcgggtcatggagcaagattggtcctggaaccgccctgctctggactacatggaactgtaccattctgctcgcaaaaactgagactaactgacaggaagaagaaaaaatgaatctccagggaataggtttaccaggtttctgtaaaatgccaatgcttcgccgtatgccattttcggtggccattatttcatcaaatgggcaatgagagcaagtatggctt

SEQ ID NO: 150 - DNA, 497 bp, Brachypodium distachyon
cagccatggaagccctcgcctcctcctcgccccggctggctctcttctcccgcacagcaacggccgcaaactgggcctcgtcgtcgtcgttggtcaggcggagtcctgctgcccgtgtcaaggccgccgcagagccggccggcgaagcgaagccggccgccgccgccgccgcgacagccgatggcgcgccggcgcccaagaagatcctgaagaagaagcccgtctactccatgaagaaagggcagattgtgcgcgtggagaaagaaaagtacctaaacagcataaattacctgtcagtgggccatccccccttctacaaggggcttgactacatttacgaagaccgtggcgaggttctggacatcagagtctttgaaaccggagaatatgccctgatcgcgtgggtagggattccaacccctccggcttggctaccgacttacatgctcatcaagtcggacaagctcgactacgagagaatgtgattggtggattga

SEQ ID NO: 151 - DNA, 734 bp, Brachypodium distachyon
acctcatggccgattccgccgccctctcctcctccctgccccgctccctggcgtccaggaggcccctctcctcctcatcatcctcctcccctctccgcggctgcggcggcaggtcccgatccccgcgccgctgccgcttcgggtcgcgcctgcgggcccgcgcgaggaaggacgaccccgaggacccctacgggccctacccctgggagcagcccttggatctctcctctgggttcgatattgagtgggtgcaagaagataaaatcacattgttcacttctgatgggcttgttcaaatagggggttccctggtacctcgtcgattgtctgcttccgagaagaggaaacaaaaagcaaaagggacacataaattccgccggtttcaggagagttcttacatggatccaaatcaaagtctttgccttggatcactatttaacatagcagcgacaaatggcctagacatgggtagaagattatgcatctttggcttttgtcggtctattgaaatgctaagcgatgtggtggaagatacagtactggagcacggcggtgaggttgtcattgcagagaaggcgagcaacgatggccttcaggagaagctaactatgtctgtcgccgtaccactcttgtggggcgttcctccagcatctgagaccctccatgtcgctgtgcggagcggtggaggtatagtggacaagatctattggcaatgggacctgttctaaacgtaa

SEQ ID NO: 152 - DNA, 1254 bp, Brachypodium distachyon
cggaggatggagcatggcggcggaggggctgggagtggcggcgggggagccgcgccttcgagcagcaacagcggcggcggggggagcggcacgagcgggagccgtggcggcggcggcgaccaccacccgcatcacccgttctactacgcgggcccatcggtggcggcgcccaacaacaacagcaacaacgtgcagcagcagcagccgcagcagttcatggggtcgctcgccatcaccaccgccgccgtggccgccgaccaggccccggctaacaaggagaaggcggtggcggcgccggtgaccccgtcctcgtcgggcgcggtggcgaagcggccgtccaaggaccggcacaccaaggtggacggccgcggcaggaggatccggatgccggcgctgtgcgcggcaagggtgttccagctgacccgggagctgggccacaagtcggacggcgagaccatcgagtggctgctgcagcaggcggagccggccatcctcgccgccaccggcacgggcaccatcccggccaacttctcctcgctcaacatcacccgcgcctccggctcctccgcatccgtttccgccgccgcacgcgccgcaacgccgttcccggccctcgcgctccacccccacgcgcaccaccaccacgacatgtccaccatgctcggctaccaccaccaccacctcatcccgccgcagccgcagccgcagcagcaggagccgccccatgaccccaacagctctggcggcggcggattcatgaggaagcggtatcgggaggacctgttcaaggaggacgacgagcgtcaagatcccaaggcgcgcgagcagcagcagcccgcggcaatgtgggccgtggcgcccaacagcgcggcccccggcggcgccttctggatgctccccgtgtccgcgagccaggccgccggggcccggcccaccgagcagcccatgtggtccttcggcggcagcggcggcgggggcaccagcaccgtgcaggcgccgctgcagttcatgtccagggtcaactaccccaccgccgccgggatgggcggctcccccgccgacaccaacatcggcatgctcgccgcgctcaactacagccgcggcggcactgaggaccagcaggagcagcagcaccagcagccggagatggagcagcagcgcggcggcaacgagggcgaagaggaggaaggcggcgacgacagcggcggagaggaagaccacggcgccaacaacaacaacagctcacagtgatga

SEQ ID NO: 153 - DNA, 918 bp, Brachypodium distachyon
tccactcccttatcatcgtttccctccctctccttcccctcttccgttcgttctcaggcccccctctctctgcctgccatggcaaatgcttctctccaatccttccttcttcagcaccaccaatctttccacaacaacagcacccatgaaggcccctcttctgtaatcctcaagctcacctccagcaccagcatttccttcaagctcttctccagcacctcctcctcggtgagcacagcatcaaccgccaacacatcagcgccaactccagtcgctgctgccgccgcaacaacctcaccccctacgccctccctggagctcctaggccagcagcttgcggacggagattatcgccaagctgacgagaccacccgcgcactcctcatccacctcgcgggcgagcctgcacgtcgtcgagggtatgttttcttctcggaggtccaatttatctccgtggaggacctccgtgccattgatatgctctggctggagcatagcaaccgcaagtttggatacagcgtacagcgacggctttgggagaagtcgctgcgtgactacacccgcttctttatcaaggttggctggatgaagaagctggacactgaagtggagcagttcaactacagggccttccctgatgagttcatatgggagctgaatgatgacaccccagagggccatctgcctctcaccaatgccctcagaggaacacggctcctaggcaacatattcactcaccctgcctttgagtgtgaagaagaggaagcagcaggagaggagaatgagacaggtactaccactggtcagaataaggatgacatcaaagggagggggaggccaaagattataacagatttcaagcctgactactccttttaaggacagcaaacctcgtggaagtttgtgatgcagagatag

SEQ ID NO: 154 - DNA, 1183 bp, Brachypodium distachyon
ccgtctctcttctctgcttcctcgcctccgctctccccgcaggtgctctcgtcacgcggcggcggcggggagggagaatggcggcgccccgggcagtgccggcgttcgagagtctcgccgggatccgacccctcgcggaatccggccgcttcaaggcatggttcctggaccagtttggtgttcttcacgacgggaagaaaccctaccctggcgccattcttgcactggagaagcttgctgggtttggagccaagatggtgataatcagcaactcctcgaggcgggcgtcggtgaccatggagaagctggggagcctcgggtttgacacgtcttgtttcctcgcggcggtcactagcggggagctcacgcatcagtaccttcagaagagggaagacccatggtttgcagctcttggaaggaagtgtgtccatcttacgtggggcagtcgaggtgcaatttctctggagggtcttggtttgcaagttgtgagcaatgttgatgatgcagacttcatactagcccatggtactgaagccctgggtttaccttcaggtgatccacttcccaaaagtcttggggagcttgagcaggttctagtgcttggcatacagaagcgactaccaatggtggtagctaatccagattatgtcactgttgaagctcgagacctgtgtgtcatgcctggcactctggcagcaaaatatgagagtcttggtggtgaagtaaaatggatggggaagcctgataaggttatctatacatcagcaatgtccctagcaggtgttgaaacccatgaatgtatcactgtgggggattcgctgcaccacgacattaaaggcgcaaatggagtaggaatggcttctgcattcattactggagggatccatgcgtccgaacttgggctcagtgaattcggagaaactgctggagatgataccgtcagtacattgtgttgcaagcatagcgcatacccatcctatgttctgccttcatttacatggtagaaaaatggtttagattcaggtacatgctttacactggaaaacattttagaataatgataccctttggaattgtcaaaatgagcataaagactgtggaggtgtttctgtgcagtgctaaattgttatgtattttcggaaatacaatctctgctgatttgattgatagaaactgcatgcga

SEQ ID NO: 155 - DNA, 1913 bp, Brachypodium distachyon
attagtgcgagcgaggtcatccggagatgaaggtgatcgagaagatccaggaggcggcggcgaatggccggacggtgttctcgttcgagtacttcccgcccaggacggaggaaggggtggagaacctcttcgagcggatggaccgcatggtggcgcacggccccaacttctgcgacatcacctggggcgccgggggttccacagccgacgtcaccctcgacatcgccaaccgcatgcagaacatggtatgcgtggaaacaatgatgcacttgacatgcaccaacatgccagtagagaagattgatagtgctttggataccattaagtccaatgggattcaaaatgttctggcacttagaggagatcctccacatggtcaggacaaatttgttcaagttgccggtggattttcttgtgccctagatctggtgcaacacattaaagccaagtatggtgattactttggcataactgttgccggctatccagaggcacaccctgaggtaatcctaggtgaggaaggagctaccgaggaagcatatagcaacgatcttgcttatttgaagagaaaggttgatgctggtgctgaccttatagttacacagcttttctatgacaccgatatgttccttaagtttgtgaacgactgccgtcagattggtataacgtgccccattgttcctggcataatgccaataaataactacaaaggtttcatacgcatgactggattctgcaaaactaagattccagccgagattactgctgccttggatcctattaaagacaatgaggaggctgtcaaagcttatggaatccacctcggaactgagatgtgcaagaaaattttagctagtgggatcaacactttgcacctttacacgttaaatatggagaagactgctttagcgattttgatgaatcttggattgatcgaggagtccaagctttcaaggacattaccttggaggcctccaacaaatgtgttccgtgtcaaggaggatgtccggcctatattctgggctaatagaccgaagagctatatttcgaggaccctaggttgggatcaatatccacatgggcgatggggtgattcccggaacccatcatatggagcacttactgactaccagttcacacggccacgtggaagtggcaaaaagctccaagaggaatgggctgtaccactgaaatctgtgcaagacattaatgagcggttcatgaacttatgtcaagggaaactgacaagcagcccatggtctgagttagacggtcttcaaccagagacaaagataattgacgaccagctggtgaagattaactcgaagggtttcctcaccatcaacagccaacccgctgtaaatgcagagaaatctgattctcctagtgttggatggggcggtccaggaggctatgtgtaccagaaggcatatgctgaattcttctgtgctaaagacaaactggaccaactagtcgagaagagcaaggcattcccttcacttacatacattgccgtgaacaaggaaggggagacgttctcaaacgttcctgcaaacgccgtgaacgctgtcacctggggcgtgttccctggcaaggaggtgatccagcctaccgttgttgattcagcgagcttcatggtctggaaagatgaagcatttgaaatctggtcgaagggatgggcctgcctattccctgagggcgactcttccaaggaattgctagaacaggttcagaagagctactacttggtcagcctcgtggacaacgactacatccacggggacctcttcgctgcgttcaaggagatctaatgtatgagataatacccgtgctgtcttccagcctttttgcgtggctaaactcctcccgccttggggctcttgcttccacggctacatgggtcgatctcactc

SEQ ID NO: 156 - DNA, 890 bp, Brachypodium distachyon
gcccacgtcctatccactaccgatcgactcacaccgcgctcgatcgaagctctccccaccgctaaacctcgcgctcagccctatccatggccgcggcaaccatctccctctgcggctcacgctgcctcggcccgagcctgaggcctgaagcgcgcctcggctccccatcccctgcccaacttctcgtagagcggggaagtggccgcgggaggccgtcgcagcgaaggcctgtggccgtagccgcgacggaagggtccgccaagtcgtcgggcgaggcggacgagcaggtcccctcctgggcccggccgggctccgacgagccgccgccgtgggcgcgcgacgaaggcggcggcggggcggggggccgcgaccccgccgccgtccaggtcccgttctacgcgtaccttctcgcgtccgccatcacggccatcgccgctatcggatccatattcgagtacacgaacgggcggccggtgttcggcatcgtgggcgttgacagccccctctacgcgccgatactgggcttcttcgccgtcaccggggtcccgacctccgcgtttctgtggtacaaagctgtgcagacggcgaacaaagacgccgaggagcaagaccggaaagacggcttcctttgatctcccggccggaaagtgctacgctgtttttgtattctggcttagcttggtggcgtcttaatttccatgtgtttgaatgcctcatctgatacacgagcaacatctgaactctgcattttgaatgggggaggaaatgcatgcatgcgtgccagctccgttcagttttccttccctaggaggtcgtgcttcgatgtgattttgggcaagaaggttcgttgtgtatgtaatccacgcaacacaaagaaaccgtccttgttc

SEQ ID NO: 157 - DNA, 1950 bp, Brachypodium distachyon
ctgaatacaggagcaggagagccacaaaaccctcctctcttcttcgaccgtctttccctttctcttctcccgccgccacacgagcacggcacggccatggcacgcatcctatcgcgcgcccttccgttcgcctcgcactcgcacctccagttttcgccgcccatccgtggcgcggcgctgctcagctccgcgccgctcctcccgcacctccctgcggcgtccacggtctcactgctctcctggcgcgggttcactcccacccccgagccctcgcgctctgtgccgcctttcgcgggattcctcgctggcatacgtggcttccgaagggcgcggcgcggacaggcggcagcgaagcgagaacaggcgcaggaggaccctgcgcccccgcccccaccaaaggagagcgagatcgagctctacgctcgcatcggtgtcgacgaggacttgcccgatgatctcgaagtgctgaacattatagaaatcctgaaattaaatgttccgatggcgataaaaattgcactagatgggcttttggagtacaactacaacacacgagacacttcaataagtgatgttgggaagtatgaaaaggttgaggtttctgtgttgctaggcaacgacaacttcatccagaatcttaacaaagagtggagaggcgaggactgcgctactgatatgctctcgatgtcacagtacattcctgatcttgatgttcctattcttatgttgggtgacatagcaatctcagttgagacagctgcaaggcaagctgaggagagaggccatacacttcttgatgaactgcggacactagtggttcgtggcctattgcatcttcttggttttgatcgtcaggctagtaatgaggctgcagtggaaatggagaaagaggagctgctcattttaaaaagtctgaggtggaaagggaaaggttttgctaagagtgctcttgatttgagcaagcctcgcacagaaacatcggatggacgagcgacgaatggtctaaagaaagctggcagcctaagattttatagaccaaaattcaaatatatcttctgtgatttggacggtacgctgctcaacagcaaaagtcgagttacagcaagaaatgcagaggctcttaaggaagctaggtcaagaggagtaaacatagtaatcgccacgggaaagacacgcccagctgcaattgatgttcttaatatggtcggtttatctggaagaaatggctttgtttcagaatcctcgcctggtgtatttcttcagggactggtggtatatggtttggaagggcaagagatttataaaagaaatttagaccaagaagtatgtagagaggcattattgtattctttggagcacaaggtaccactagcagcatttagcaaggaccgaagtttctctctgtttgaggacccttcggttgattctctccattatgtataccatgaacctaaggctgaaatagtatcatctattgatcagctcttagggacagctgagatacagaaagtactgttccttggtactcctgaggggatttctaccacgttgaggccatactgggaaaaggcgataggtgaaagggctggcgttgttcagggacagcctgatatgcttgagcttgtaccacctgcaacttcgaaaggcaggggggtgaagatgttgttggaccatctttgcattagcccggatgaggtaatggcaataggagatggagaaaatgacatagaaatgctacaactagcatcactgggtgttgctatggcaaatggggctgagaagacgaaagcggtggcaaatgtaatcggcgcaaccaacgacgaagatggagtcgcgcaggctatttatgactatgctttctaacagctgctgacactaaggagtatcgtttctttggttccccacggtgttctgggttcaccacccagtttcacatgtctgcacatctag

SEQ ID NO: 158 - DNA, 1409 bp, Brachypodium distachyon
ccattactgtggaggatcaagccaggcatgctataatggagctctaccctggctatctcgaagaccatttcaacatccacaagctcagcggcgccggcacgtccccgccggagtacatgacctcggcgacggcgcagttcgcgccggcgcccctcaggatgggcatgtacgagcgtcccccgccgcagcagccgatgccgccgtcgccgcagccggtggtcggcatgtggaacaacagcgtcgacacctacaaggtcgacagcggccaggccaccagcgggtccaccatcatggaggccgacaccaagttcgacgacgccgagcttgaagagattccagggatggaggaactggagccagccagggatgtcgatcaggaagcgagcaagccgccggataaggtgttgagaagactcgcacagaacagagaagctgccaggaagagccgcctccggaaaaaggcttacatccagcagctagagacgagccggataaagctggcgcagctagagcaagagctgcagcgaacgagacagcagcagggcgtgtatcctccgggtcactcgggcatggcggggttcggcggcgtcggcggggtgcccatggattccggcgtggcggcgttcgagatcgagtacgggcactgggtggacgagcagaaccggcacacgcgggagctccgcggcgcgctgcagcccgggcagcagaccacggagctggagctccggatgctggtggagaccgggctcggcaactacgaccacctcttccggatcaagaacctcgccgcctccgccgacgtcttctgcgtcatgtacggcttgtggcgctcccccgccgagcgcttcttcctctggatcggcgggttccgcccctccgaggtcctcaaggttctgaggccgcagctggagccgctgacggaccagcagctggagcaggtgtaccacctgcagcagtcgtcgacgcaggcggaggacgcgctgtcgcagggcatggagaggctgcagcagacgctggcggacgcgctcacggccgccgcagaccccttcgcctcccccgacggctactccgggatgaacgacgccatcggcaagctcaaaggcctcgtctgcttccttcaccaggcggaccatctccggctggagacgttgcagcagatgcagaagatcttgacgacgcggcaggcggccaggggactcctcgcgctcggggactacttcgagcgcctccgcgcgctgagctcgctctgggctgctcgcccgcgcgagtcggcgataagctgaaccttctgctcgtggaaccaaaaaaaatggttacaggatcagttcctctcgtagtatgatcagttgtgtagttcccgggtcaagggccgccgccagtgaaggatgaagaaatccaatcacgctagc

SEQ ID NO: 159 - DNA, 1240 bp, Setaria italica
ctcgccgtctctttcctcgcgccgccgcttcgcccagcaaacgcgcgtgcgccctcctctcatctcgccaagaaaagcaccgatggagacgccgctgtccaccaggaggatcacccgctcgctcgccgccgcggccgccgcatcagcccagaagagcgccgccgcggggacggattccgcggcccagttctccctggccaagaacgccaccgcgggggagccccagccgcgcgccgcgctgcacgacatcaccaacgactcccccatcgtcggcctcgccgcgggcggcctccacggcaccgacaagacccccgcctccaccgcagccaagacccgccgcagggccccgcgccgcacgcccggctccggggaggcgctcctgcgcggccaggtcaaggcgctcctgcacaaggtcgaggaggagcagggatgcgccccagcggctctcgtcaggccagcacgcatccaggcgctgctcggggtctccaggtcgccggcccagctcctggcgcccacgccggccaacacgccgcagatcgggcccgtccccgcggccagggaaggcctcctgatgcctgatggcgtccccgtggtgccctgcgtcctcgaggaggaggaactgctgcttcctaagctgcagatcattgcagctcccctgccgccacctcagccagaggagaacctgggcgagtgtcagctgaaccgtgcgctggtgttcgacgactcccctgagaagtccagcgcgtccaatgggtcggccgtcttgttccaggagagcagtactggcagctgcaatggcaagtcgtcatcacctgaggacgacagctcctcggcctggtccattcaggtccatgccagctccgagaagggcgacgaagaagagcttggcgtggaggacctaggagagtacactgaagaagaggaggagtgggaagaagacagcgacgacgaagactgcttcgatgacctgtgcgaggagatgagcaggatgaccgtggtcgatgaagaggagaggaaggcagggctgccacagttcgaggggaggcacacccggttcatctacaacagcgacgacgagatcgagcgggaggaggtagcggatgcagctgaggcgagggcggagctcggcgcgctgatgctcagggacctgccggtgccggaaggcaggcacctgcgcttccaggaggacgaggaggatgaggagtgaagcgtgtcagttgtgttcggattcgggtattag

SEQ ID NO: 160 - DNA, 1234 bp, Setaria italica
gctagattccacaactaggcaggcagacgccacacgccagccgtcctggtgtgcgtcactgcgtctcgtgcagacagacgcggtccacagctcgccacggccatggacgtggaagcgcgcaaggacgcggcgcccgcgcgcggcaaggcgatgcgccgcctcctggtggcgctcaactgcgggatgctcgcgctgggtgccatcggcgggccgctcctcagccgcctctacttcagcaagggcggccaccgtcagtggctgtccgcgtggctcgagaccgccggctggccgctgctgctggtccccgtggtggcggcttacgtcgcccgccgcgcgcgcgaccgggccgccccggccctcctcaccccgccgcgcatcctgctggccgcggtgggcctcggcgtcgccacgggcgtggacgacttcatctacgcctacgggctctcgtacctccccgtgtccacctccgcgatcctcatctcgacgcagctcgcgttcacggtgctcttcgcgttcctcatcgtgcggcagcggctgaccgccgcgtccgtgaacgccgtggcgctcctcaccgtgggcgccgtcgtgctggggctgcacgtctcctccgaccggccccccggggtcaccaggggccagtactggctggggttcatcctcacgctcggcgccgccgcgctctacggcctggtcctgccgctggtcgagctcgcgtacaggcgcgccgccggcggcgggcgcgccgtgacgtacgcgctggtgatagagatgcagctggtgatggggttcttcgccaccgcgttctgcaccgtgggcatgatcgtgaacaaggatttccaggcgatcccaagggaggcgaagcacttcgagctaggggaggcccggtactacacggtgctggtgtggtcggccgtgctgtggcagtgcttcttcctgggcgccgtgggggtcatcttctgcgtgcacacgctgctcgcgggcatcctcatcgccgtgttcatcccggtcacggaggtggccgccgtgatcttcctgcacgagaagttcagcagcgagaagggcgtggcgctggtgctctcgctctggggcctcgcgtcctactcctacggcgagtggagcgactccagggccaagaagaaggctgaggccgccgcggaaggccaggcctcgtgattcttatactgcaactgtggacgatgatgagagatcgaggctctgatctcttcccgttgta

SEQ ID NO: 161 - DNA, 2548 bp, Setaria italica
gcgccaaaccctagatccgccgccgctcatcccgccgccgccatgttctggcgcatgaccggcctctccgcggcctcgcccgtggatacaattctggacaaagaaaattttacgttggaagaacttcttgatgaggatgaaattattcaggagtgcaaagcactgaattcacgactcataaacttcttacgtgacaaggcccaggtggaacagttgcttcgttatgttgtggaagaagttccagaggacaatgaaaaaaagcgctctttcaagttcccttttattgcttgtgaaatatttacttgtgaaattgatgtcgttttgaggaccctagtcgaggatgaagagctaatggacttgcttttctcatttgtgaaacctgatcatccacatagcacactattatctggttatttcagtaaggttgtaatatgcttgatgctgcggaagactgccccacttatgaattatgttcaggggcatccagagatagttgtccagcttgttgacctgattggcatcacatcaataatggaggtgctgatacgactgattggtgctgatgagaacatatactcaaactacggtgatacattgcagtggttagaaaatacagatgtccttgaaatgattgctgataagtttagctcatcggattctcctgaagtgcatgccaatgctgcagaaattctatgtgcagtgacacgatgtgcacctccatctcttgctgcaaagatatgcagtccaagttttgttggaaggttgttccatcatgcttttgaagaatcaagaccgaaatctgttctggttcattcgttgtctgtgtgcatatcattgctggatccaaaaagacttgcatcagcttcctatcaagcattcagaagcaacttaagtcatggggcattggtcactgccagtccagagacagttgatggcatgcttgagagcctaggcaacttgctgatgttattggacacttctgctgctgaaaatgtattgccaacaacttatggatgtttacgcccacctcttggcaaacatcgtctgaagattgtagagttcatctctgtgctgcttacaattggtagtgaaactgctgaaaaggagctaataaggcaatcagcaataaagcgctcaattgatttgttctttgagtacccatataataactttttgcaccaccatgttgaaaatataattgtttcttgcctggagggtaaaagaactgaacttgttgagcatgttcttaacgagtgtgacattgttggtaaaattcttgttgcggaaagactttcttctttgtcgacagagtctaacgggcctaccataccctcggaagagaaagcccctccaagaattgggaatgttggtcacatgacaaggatagccaataagcttattcagttgggaaatagtaacagcacaatccaggcacatttacaggaaaataccgagtgggttgaatggcaaacaaatgtgctggtcaaacgcaatgaagtggagaatgtttatcactgggcttgtgggcgcccaacatcattacatgatcgtggtagggatagtgatgatgacgacttccgagacagggattatgatgtggcagctcttgctaataacttgagtcaagcattccgttatgggatatacagcaacgatgacattgaagaggcacaaggatcacttgaacgcgatgatgaggatgtgtattttgacgatgaatcagctgaggtggtaatatcttctctgcgtctgggagatgaccaggacggcagctccctctttacaaattcaaactggttcacatttgatggagagagaggcatcaatgaccgtatatccgattctgttccctcatcgtcacccaattctgaggagatatccctagagaccgaggaagctgatgatggtaaagtcattggcactgaggatgaaatggaaaccgtttgccttggaaatgggagtacagaggaggcaaaggatgtagcagaatgtgtcgaacagctaaattgtagtacagcgaatgagccgttgcaaaatacagacagtctggaacggcattcagatgtttcaaatggcagtaccgaagtaggtacagccgcagcggcagaatcttcagccccatcagttgagattgcggcagaatcttcagccccatcagttgagatagcggcagagaaaacggcagatgaaccattaatggtagagagaacagtaggtgaaccagcagtctcatctgatctggacaattctatctctgaagctacaccgggtgctaatggaagtgagcctgctgaccctgaagtatcttctgaacaagttggcaatgacactgatgtacagcaaccagtaaaggaagttgctggtgaggatgttgatgaaacaaaaactgatgcagtcaaagcaagcgactgaagtagcaacatgtcgaattagagcaattacttgtgaactcggcggtctgcatgattttgcttcatgtctgctcagaagccacggaatagtccgaagcaaactgctgtacaataagcaagtgtattgttctgccatc

SEQ ID NO: 162 - DNA, 678 bp, Setaria italica
catcgcatgcaaccacccctgccgctgctgcgttgcttgacggcctcctcctcctccgccctcccgctctcggtgttggtgcgcaagcacaagctaggattattattctccacggccatggacgacggcgtttcttcgcaagacaagaagacgtctccgccgccggcggggggcgtcgcggagcgcatcatgccgcatctcctcaacatctacggatcgcgcgcgacggcccgggacttcgagatttacgcgcccaacgccacgtttgaggacccgctcatgcgagcccacggggtgcagcagatcaagtcctcgttttacacgcttccaaaggtgttcggggaatccaagatcgtggagtacactgtacatgagaatcccacgggccccggcaaagccgagattctgatcgacaacaagcagcactacaaggtacttgggaaggcggtggagctgaccacgctcatcaggctccaagtccaggacggcaaggtggtcacccacgaggactggtgggacaagaagcctctcaagaaccgggacacggtggggttcccgctgctgggccgcgtcgctgaggccacccgccggggagcaatgctgctcacccacgccctcatgggattcggcaaggaccctcctgctcacccaccgccggcatcctcctcctcttgatga

SEQ ID NO: 163 - DNA, 929 bp, Zea mays
cgttgtcggaagctcaagttagaagaagcaccagtgcctgatcgatggctgcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctgggcgcggtgggcgccatcgccccggagatcttcggcaagatgggcatcatcccgccggagaccgcgctgccgtggttcaagacgggcgtcatcccgcccgcgggcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcgggcccctcttcaacccgctcggcttcggcaagaccgagaaggagatgaatgagctcaagctcaaggagatcaagaacggcaggctcgccatgctcgccatcctcggttacttcatccaggggctcgtcaccggcgtcggcccgttccagaacctgctcgaccacctcgccgaccccgtcaacaacaacgtgctcaccagcctcaagttccactagaacgttggtgcatcagcatacctgctgccgccgcgccgccgccgccagttgtttgctgtggaaagctagatgcatgcgtgt

SEQ ID NO: 164 - DNA, 673 bp, Zea mays
gtaggataagccgcttgtggccgcctcgccttccccatcacgaccaccacccaatcaccacgccagcttatatgccccacccggcgccactcgacgtctcacggagaaaaagaaagaggagctcggacaaggcagagcgccatcgttcggtttccttgctgaattcccgatcgctcgctcgctcgaaaagaaagaagctagcttttatcatggcgtctctggcgttcggcagcaccgtagcggcggccgtggcggcgacatcggggaggacgcggccggcgcgccggtccgtgctggtcgtgccgcccgctgccagcaggggcggcccggcgccggccaaggaggagaagggcctcggcgagaccatcttcggcttcatcttcaagaaggaccagctggtggagacggacccgctcctcaacaaggtcggcgccgcgccggccgccgcctcccgcgccaagacgaccgccggcaagaaggctgccggcggcgacgacagcggcagcggcggggggttcaacctcggcggcctcggcgggctcttcgccaagaaaagcagctgaacgtggcgttgtttatggattgtcgaactcaaagctggatttggcttttgagggggaaatggttgcgcatatatatttgtggacgtgtggtggtgtgaccagtgatcttt

SEQ ID NO: 165 - DNA, 354 bp, Zea mays
cactccccccaacccgaccacgctgcgcctccgccttgatacccagccgagcggggcaagggagaaatggggaagggtacgggcagcttcggcaagcgccggaacaagacgcacacgctctgcatccgctgcggccgccgcagcttccacctccagaagagcacctgctcctcctgcggttaccccgccgcccgcatccgcaagtataactggagtgtgaaggccatcaggcgcaagacaaccggtaccggaaggatgaggtacatgcgccacgtgcctcgccgtttcaagagcaacttcagagaagggactgaggctgctcccaagaagagtgctgccgctgccaactaataa

SEQ ID NO: 166 - DNA, 1127 bp, Zea mays
ctttctccaagcctgagcactccatccactactttactcaaagtctagagctagcttttgctttgctcaccagacaaacagcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtaccttggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaggtgctggagaagtgggtgcgcgtggacttcaaggagcccgtgtggttcaaggccggcgcgcagatcttctcggagggcgggctggactacctgggcaaccccaacctggtgcacgcgcagagcatcctggccgtgctcggcttccaggtcatcctcatgggcctcgtcgagggcttccgcatcaacggcctcgacggcgtcggcgagggcaacaacctctaccccggcggccagtacttcgacccgctgggcctcgccgacgaccccgtcaccttcgccgagctcaaggtcaaggagatcaagaacggccgcctcgccatgttctccatgttcggcttcttcgtccaggccatcgtcaccggcaaggggcccctcgagaacctgctcgaccacctcgacgaccccgtcgccaacaacgcctgggtctacgccaccaagttcgcaccagggtcttaagctagctaccgggccgcggcgtgccaggacattgtgttgtacactactcgtttctgtcgtgatctgtaccatgaacgaatgcaaatattcttgtgctctcccagaaggaacgaactggactagttttgctcttccattccatgtatactctgcttcagcatatatgtagttgtgtctactggtttttgcagttgttaactgatttgcgtccatatatgagg

SEQ ID NO: 167 - DNA, 809 bp, Zea mays
ttcgtcagtacaacgcctccgccgctccttccattagctcagacatggttctcggcctctacaccttcgccgacatcgacgccgacggagcaccccgcctcgaggttgccgatggcgaggagttcgtccgtgtcgatcgcgttgtcgagcttgccctcggtccccgggtgctgaaggcccctggaaccctttacctcaccaccaggagggtgatttgggtcagcgatggcggcgagggctacgctgtggacttcgttgccatctcgctccacgccgtgtcgcgtgatcccgaggcgtatccatacccctgcatctacacacagatcgagacggaagctatttctgacgaggagtctgatgtgtcagattctgaaacaaatggagaactcgagctctcaaaagttatggaaatgcgcatcataccttcagatcctggtcaattggatgaactctttgaagcattctgcaattgcgctgagcttaaccctgatcctagtgctgagagtgatgaagaacatggctgggttcatggtgatgagggttatgaagatacggtagatggaagcgacactgagttttcagatgtcaacccaattggtcaaactggtgagcaggatattaaccatgctgtaatcgagctccagatcaatgaccaacgttttgaggacgcggtagatgaggagagtcacaggaacgggaactagggaccatgtgaattggtcgtcgtcgatgcagcatacttgtctgtaaagacttcacttttctcatgttgtcagatcatgtggaccaacttgaatggcaacaattag

SEQ ID NO: 168 - DNA, 1426 bp, Zea mays
gatcctaagttgctgaccttgctgctgcttgttggagatagatttgttggttctaagttccaagtaccatgagtccaccgagtgtgatggggcagtttggggacacaacctacaccaaggtttttgttgggggactcgcgtgggaaacccagaaggagacgatgaggaagtacttcgagcagtttggggagatcctggaggctgttgtcatcactgacaagaacactggcagatccaagggctacggatttgttaccttccgggatccggacgcggcgatgagagcttgcgttgatcccgcaccggtgattgatgggaggagggctaactgtaatcttgcttcccttggggttcaaagatctaggcctcctactccccagcatggaggagctagaaactttagagtaatgaaatccttcaaccagcaggcaggaatccaaggtggactcggcggcgcagcttttccttctcatgccaccttccctcattatgccatcccacaaggccttcccttccatgtctatgggtactctccatataccccagactatggttatccaacaaacttctacaatatatatggaggagctcagtacccgttttatggaggagcaacagctggcatggtgacaggaacaagtcccttttatccatatttccaatttgggcagtcaggaaacactactaccaactatacaagtggacaaggctacaacttgcaacaatacccacaaatgttccacttctcaactgtatcttctacagctgcagctgtgaccggctttgctcagcaatatggaggaccattgtcactagcagcaagccctcaagcccaagcaggcatgacaatggcactcacagctccaaccctgccaactccaacacaggctgctcatccttaccggttgattccctcgcactttgcagtttctgctgctccagagcaacccttggcctaaccatggtctcccttctcaccgttgttgtactgtctcgtttccgacgtgtttgagtccatgcatccatctctaacaccaaaaggcactattgtagatcacgcttatcagtcaaagtgctcacctccatatcccacatggtcatgtggtgaatggatattagctttagccccaggatgggcataaagcttcatgccccaaggatggggtattctaacagacaagtacaaaccccaaccattctaacaatagtccaaggaaggactttatctgggagagttaatttcagccgtaccaagacaatgctgtagctaaaagaaactaacagtcaagcatgacccagggatggttcatgctgatactagtcaaattggacaacaatgacagctaaataactgactagcatgccactcccacatgtcattagtagaatcccaactgtacctagcttaggcatggcatctcttgtt

SEQ ID NO: 169 - DNA, 438 bp, Zea mays
tcgtctcgtgtataaggcgttcggagctcgcaaatcctttcctctctcgcgttcgaggctaggtagccgtcaccatgagccgctcggggcagcctccggatctcaagaagtacatggacaagaagcttcagattaagatgaatgcaaaccgtgttgttatcggcacacttcgtgggttcgaccagttcatgaatctggttgtggacaacactgtggaggtcaatggaaatgacaaaacagatattggaatggtggttatcaggggaaacagtgttgtaatgatcgaggcactggagccagttgcgaggtcacagtgaatcattgttctttagcactagcagcgtgaaaactgatgtaaaagatatcagtggaccctgttgtatttgactaatgcttttgcacagcaacataacttcggaggtggaatgtctatccctt

SEQ ID NO: 170 - DNA, 1012 bp, Zea mays
ccataatcccatcccatttaactgccgccagctcgccgcatgtccttttggatcccatcaaccgtgcgacgccgaccgtgcccaggtttgcctggctataagaccggaggtggatccggactcgcctgcaggggtcgcgtcgcgtgggggaaacgccgccgaaaaccactgggtgcccgctctcgctcggcacgtcccgcgcgcgcccacgcccacgcccacgcccacgactggtcacaagcgctagccagcgttcttcacgcgcctcgcgcctgcctgcagccgcaggggaatcgatcgtggcaagggcttgcagtcgcagctactggtagcagagcgatggcggccgcggcgagggtgtcggaggtgaaggccgagggcctcctgcggggcgcgtgcgcggcgctggccgcggcggccgcgctgctggtggggctcagcacgcagacggagacggtgctgctcgtcaggaagaaggccaccgtcaaggacgtccaggccctctgggtgctggccatggcggccgcggcagcggcgggctaccacctgctgcagctgctcaagtgcctctacctcggccgcgtcggcggcgcgcgcccctgccgccggagcagcagggctctggcctggacatgcctcctgctcgacaaggcgtgcgcgtacacgacgttcgcgacgacggtggcggcggcgcaggcgtgcgtggtcgcgctggacggcgcgcacgcggtgcagtggaccaagctctgcaacatctacacgcgcttctgcgagcaggtcgccggcagcctcgtgctcgggatgctggccgccgtcggcaccgccgtcctctcggccgcctccgcgcgcaacgtcttccgccactactcgtcgttggagacctacgccgcgcactaggctcgcggcccaaggcgtcgtcagctgggccgggtgcgccactcctctaaaacactgggccgtaacgaatttcaggcccagatgaagggtgacctgggctattaaagctggagct

SEQ ID NO: 171 - DNA, 1282 bp, Zea mays
gagagagacgaatcttccgaatctctcggtggcgatggcgctctccgaccgctcccgcgagtcgctcctcccgagcttcctctacgcctcctcggcgcgctctttcgctgccacaggagccgccgcgcgcctccctgtctcctccccagcgcctgccacggctggagcaggaggcggcgtgccgttctcgatccaggcgcccaaggagaagatcgagatgtactcgccggccttctatgccgcctgcactgccggaggaatcgccagctgcgggctcacccacatggccgtcacgcctctcgacctcgtcaagtgcaatatgcagattgacccagcgaaatacaagagtatctcatctggatttggtatcctgttaaaggagcaaggggccaggggtttcttcaggggatgggtgcctactttgcttggttacagtgctcagggggcttgcaagtttggcttctatgagttctttaagaagtattactcggacattgcagggcctgagtatgcccaaaagtacaagactctaatctacctcgcaggatctgcatctgctgaggtaattgctgatgtggctctctgcccttttgaagctgtgaaggtacgtgtgcagacacaacctggatttgctcgtggattgagtgatgggctccccaaatttgtccgatctgagggtgttcttgggctctacaagggaattgttcctctctggggtcgtcagattccttataccatgatgaagtttgcttcctttgagaccatcgttgagcttatctacaagcatgctgtgcctgttccgaagtctgagtgcagcaagactacccagttgggtattagctttgctggtggttacattgccggtgtcttctgtgctattgtttctcacccggctgacaaccttgtgtctttcctgaacaatgccaagggagctacagtgggagatgctgttaagaagcttggtctctggggtctcttcactagaggacttcctcttcgtatcgtcatgattggtacccttactggtgctcagtggggaatttacgatgcattcaaagtgatggttggactcccaacaacgggaggtgttacacctgccccagcagcagaggctgaattgaaagccagtgcttgatttttttttttctgtgttccctgagatcatatttggtggagtggaattgtatcagccggtcgagagcttagttcccgaatcttttttaatcttaacggaaaatttgtccgtcatccttctgatgagaggaactcattaaacaggcga

SEQ ID NO: 172 - DNA, 3130 bp, Zea mays
cgaggtatggagctcgccttgggggccatgaccagcttggcccttaagctaggcgacctgctcatggaggagtatgtcgtgcagaagggcctcaagcccgacatcgagtctctctccagggagcttgtgatgatgaacgccgctctcatcgacgcgtcccgggttccacctgaccagctcaccgaggtggaaaagctttgggcacgcaaggtccgggacctgtcgtatgacatggaggacgccgtcgacgatttcatcctgcgtgtggctggtggtgacgactctgccgccgactcaaaattcttcaagaagacccttgccatggtcaaggacgtgatgtcgatgaagaagttcaaggatcggcgccagatctccgacaaggtcaaagacatcaagaaactctccaacgagttagctgaacttcgtgccaagtacacggtaaggggtgtgggcgctgatctcgccgcgagcaccggcatcgaccctcgtgtcatcaatctgtacaagaaagagacagatctcgttggcatcaagaagtcaaggaacaaagtcattaggatgctgtctatggagaccaaagatgatgatgcacttgagtcccatcaggctctaaagatagtgtctatagtcggggttggaggactaggtaagactactctagccaaaacagtgcatgacatgcttaagaagcaattcgactgttctgcttttatttctattggtagaactcctaatctgaataggacattcgagaagatgctattgaaacttgatcgtgagtataaacaagttgacatggccagatgggatctagaacaatttaaaaacgaactggatgaattcttgaaggacaagaggtacttgatcgttgttgatgacatatgggatgttgactcatgggaagcaatcagatatgccttgaaggacaataattgtggaagtagaataatcatgactactcgtaattttgggattgtcacgaaattagaagaggtttatagattaaaacctctttctaatgcaaactccaagaaattgttctacaaaagaatagagagtcaggaaggagaaagccttgatggtgaactctctagtaaaatcatacataaatgtggcggcataccattggctatcattgcaatagctagtttgttggttgaaagatcacgtgaggagtggtcagaagtgtacgacaagattggtcttgggaatgaagacaatacaacaaagataatgtcatacagctactatgatctgcctccttatctcaagccatgtctgctgcaactaagcatatatccagaagactgtatcattgatacaaactctaccatatggaagtggataggtgaaggtctagttcatcttgagaaagaagagggtagcctatttaaggttggagaaagatacttcaaggagcttgtgaatagaagcatgatccagccgacagaggacaaaaatgatcggtttgtagaagggttccgtattcacgacattgtgtttgatctcatctgtaagttgtccaaggatgaagacttcattaccattagcgggcaacattcatctcgggatagtttaagaagagagaagaaaacatgtgtgcctcgctcagactgcaagctacgtcggctggccgtccgaaatcaacgtgtgcagcgcttccctgaagaaaccatcgacatgccagaggtgttgagatcacttagcattatagattgtaatattgaggttatggccccaattgatagcttcagggtttgccgtgtgctgcatctggggaagagctacgtacccatcagcctaaagcatctggggaagctgttgcatctcaagttcctagagatagtatacacgcctattgatgagctccctaaggaaattgggcatctgaggtctcttcagacactgatattagaccgtactggactagacgagctgccaccggttgtttgctcgcttacacggttgatgtgcctgatagcccaggggttcgaaaggttgccagctgacaggatggggaacctaacgtccctggaggagctacgactacgtagggtagttggccggagtgccacccaagccctagtggcagagcttggcaagctgacgaggttgagggtggtcgacatcaccttttcagagcagctagaggagagcttgcaagaagcattggtgcaatctctgtccaatctgcggggactccaggaactaacgcttttgtttaaaatgacacggtggggaagcgatatgtggggagactgggagccaccaaggcagctccggcgcctgattattgaaggcatcatcgtcttctcacgacagcctcgatggatcaaccgctcctgtctgccacgcctctgctacttatctctgatggtgcacactcttgaagcacaggacctagataatctagcgaggttgccagagctccagtacctcacgctagatggtctcagctggcctccaaggtatactgttggcccagacgacttcaggaatctgaggttctgcaaagtgggcacaacgttcgagtttcgtaagggcgccatgccaaggctcgaagtgctgcaatttagagtttttgcagggtactattgttgggcatacaatggtgtgccgttcgagcagttcccaacgaaggatcttgacttggacctggataacgtccttttacttcagcaagtaatagtcaaagtcaactgcgtaggtgctactgtcacacaagtggaggaggtggaggccgtggtcatgcgtgccgtggaaaatcatgccaaccgtccaaccataaaaatgaatcgagcatatgaaatagctatcctatccgacgaagggcgggaggctctgcttcggcgacacattgaaaaggattgctgcgtgcgcacgatgaaggataaatctgatgctttcttcatcagccagctgcggaggtatcgacatcttcagaaagccattattttcatcgactgttcgggtgccagcatgtgtgaggtgcagaaagtggaagcagcttttagacatgcagccgaggttcatcctaaccatccaagtattgaacttatcagaacaaacaccgacggaatggcctcctcctcatctgaccatcccaacacagagcccaggaattgatgag

SEQ ID NO: 173 - DNA, 971 bp, Zea mays
gagagcctccagaaacccacgcgacgcgaccgaccaccatggccgcctccgcgctcctcctctcgccgcggctcgtgtctttcccgcctcacccgagcctcgccccactcttcaccaagagaccaccgccctaccccctcggcggcgccggcgcgaggctccgggccgtcggggacgggcccggcgcggggctgccacccgagcaggccacggtctacgacggcgcctacggtccctggaccctggaggactccgacgtgcgcgaggtcctgctgtaccggtcggggctggtgacggctgcggcgtccttcgtggcggcggcctccgcggcgttcctgccggaggggaaccccgccgcctccgccgtcaccggcgccgccgacctcctgtacgccgccggcgccgcggggctgggcctgtcgctggtcctcatccacatctacgtcaccccgataaagcgcttcctccaggcgctgtgggcggccggggcgctcggctccgtcgggacctacctcgtcgccgcccgcccgctggatgagggcctcgtgcagtacgtgctggaccaccccgccgcgctgtggttcgtcggccccacgttcgccgcgctcactggcctcgtcttcaaggaaggtctctgctatgggaaactggaagctggcatcttgacgtttcttatccctgggcttcttcttgggcatttgtctggtttaatggataacagcacaaaggcaggtcttttaggactgtggatgcttcttttcacaatcttcgccgctagaaaattccagcagcccatcaaggatgacgtcggagacaaatctgttttcatgttcaacgctctccctgaagaggaaaagaaggcgtggatccagaaactcgagaggcaaaagggacaagagttgtttgagtagaaaagagtagcttgtcttggtgcagccaatagttcgtccgtgaatgtttgtagctcatag

SEQ ID NO: 174 - DNA, 1946 bp, Zea mays
agcgtttaagttccactcctcgccgccccagatctccgccctcctcaccactgcccccccattccccggcgcccagcacccggcgccgcaaccgccgcagtccggagcaagatcggtgggtagacggacgggcgacaggcgggcgggcgcggctctgtctgtatctatctgttggtgggagaccggttgtgtcggttaggcggcggcgggtgggaaggaagaatggcggcgggcggcagatccatcgcgtgctttgccgccgtgctgctcgcggccgcgctgctcctctccgcaccgaccaccacagaggcttacgattcgctggatccaaatggcaatatcactataaaatgggatatcatgcagtggactcctgacggatatgtcgctgttgtcacaatgttcaattatcaacaatttcggcacatcggggcacctggatggcagcttgggtggacatgggcaaaaaaggaggttatatggtcaatggttggggctcagaccactgaacagggtgactgctcaaagttcaagggaaacaccccccattgctgcaagaaagatccaacaattgttgatttacttccaggcactccatacaacatgcaaattgccaattgctgcaaggcaggagttataaatacctttaaccaggacccagcaaatgctgcttcctctttccagatcagtgttggtcttgctggaactaccaataaaactgttaaggtgccgaagaacttcactcttaagactccaggccctgggtacacatgtgggcgtgctattgttggcaggccaacaaagtttttcactgcggatgggcgcagggtaacccaagctctaatgacatggaatgtgacctgcacatattcccaatttcttgctcagaagactccgtcctgctgtgtatctctctcatcattttataatgacacaattgtgaactgcccgacatgctcatgtggctgccagaacccaagtgggtcaaactgtgtgaacgaggattcacctaatctacaagccgcaattgatggtcctggtaaatggaccggccagcctcttgtacaatgcacttctcacatgtgcccaataagaatccactggcatgtgaagctcaactacaaggaatactggagagtgaaaatcactatcacgaacttcaacttccgcatgaattacacacagtggaacttagtcgctcagcatccaaattttgataatatcactcagttgttcagcttcaactacaaaccacttactccatatgggggtggcataaatgatacggcaatgttctggggtgtaaaattctacaatgatttgctgatgcaagccggcaaacttgggaatgtgcaatcagaactgcttctccgcaaggactcacggactttcaccttcgaaaagggatgggccttcccacgccgagtgtacttcaatggtgataattgtgtcatgccatctcctgaaaattatccatggctgccgaatgcaagccctctaacaaaacaaccattgacactcccactcttgatattctgggttgccttggctgctctgttggcttatgcatgatgagtgggatcaagatgtttagcaagcttcaagttgatgtcggattccatgaggtgcactgcaacgggatatttattcattcaattccatagcggcacaggagagatgaggcgaagccaagaaaaagtcgatgtgtgtgtgtgtgtgtgtgtttgtaagttaaagggccaaaatgtatttcttgtttggtatatagcatctctacaacactttggtgaacttagttactgcaaattaggtaattacagttgcaccttttgtattttatagcaaacccagacttctatttgattctatgactgcccctcttgtagtaaatgcaaggcttcactggtactcctgtttaaagattggtcaaatagaagagacgacgg

SEQ ID NO: 175 - DNA, 438 bp, Zea mays
agtacgtgcgaagcagcacgcacgctgctggtccgcgtacgcgagacgacggtcaggtcggccggtgcttttcagtttggaataatgacggcgacgacgacgacagccgccggcggcggcaaggtgcagccgcgcggcctgcccgcggcgctgtccctgctgctgctcctggtgttggcagcggggctgggcggtggcgccgaggcgcagcagacgtgcgcggggcagctgcgcgggctggccccctgcttgcgctacagcgtgccacccttgccggggcaggttccgccggcgcccgggccggagtgctgctccgcgctgggggccgtgtccagggactgcgcctgcggaacgttcagcatcatcaacagcctgccggccaagtgcggcctcccgccagtcagctgccagtaatgagctgatgatagccagtgcgat

SEQ ID NO: 176 - DNA, 579 bp, Zea mays
ctccgttcactccatctcttgccggccagtgctccgtcgatcgacccgtagccaaccaccgacaactagctagcaacaatggctgccgtcgtcaacgcgcgagccgcaactgctcgttgctcggccgccggcgggccaccacgcggtgctgcgtcttcgtttccgccgtcgacgataaggacgaggaagaggacgacggcggcggcgggcggccgcggccggcttgtcgcggtctcggcggtgggcgacgtcgcggcggagggcaacacgtacctcatcgccggcgcggtggccgtcgccctcgtcggcacggccttccccatactcttctcgcgcaaggacacgtgcccggagtgcgacggcgccgggttcatccgaaaggcgggcgcgacgctgcgggcgaacgccgcgaggaaggacgaggcccagatcgtctgccccaactgcaacggcctcggcaagctcggacagatcgacaagtagctaaataatcccatccaccatgcatgctacgtactaagctcatatacatgtgctgatgtgcatgcatggaccaaccaaactgctcctttgtattag

SEQ ID NO: 177 - DNA, 1745 bp, Zea mays
ggcgcccaattgtatagtagcccgcgcgctctagcgagaagctagcgcgccatcgccgccggcgtcgtgtcatggaaatggtagagtgctccctcgttgctacacttgctccgcgcccgctgcccggacaggttcggaaggccttgccccggccggcggcttttggggcgagagcgagactccgggtgcggtccgtgggccgagaggagcctctgcatccgcagcagacggcagtccgggcttccggaccggatcacggaggccgggcgctggggcaggctgcggtggggttcgccgccgctgccgttgtgtcactaaccgggttctccggggatgtgtccccgctgccgacgccgcctgcccgggccgagtcgctcaccgtcgcgttccccgtctccaaggcgcgcgaagtgaacagagtgcagaggacgctggtggagacgtgggggctgatccgtgagacctttgttgatcccaccttcaaccaccaagattgggatcagaaactacagcaaaccatggtagagatatttccactgaaatcagcggatgccgcctacagtaagattagtgggatgctgtccacactcggcgacccatttacaaggatcatcagccccaaggagtaccaaagttttaggataggaagtgatgggaatgtgcaaggggtcggggtgtttataaacaaggagccaagctctggacgattgcttgttatggactgcattcagggaggcccagcagatcgagcaggcatacatgaaggcgatgagctagtcgagatagacggcaaaagtgtttctggtttggatggagaggctgcagctcagaggcttagaggccgtgtaggaacaacagtgaaagtgaagttgttagatggaactgacgatgaaaggggtgggggtttaagacaaaaggaggtccagctgtctcgtgaaattatcaacctttcacctctgtcaactgcaattatctctcatagaacagacgatggccatgagtgcaagactggctatgttagattagcttccttttatcagactgcagcagctgaaatggaaaatgccgtaaaaaggatggaggatatcggtgtccagtcttatattctagatctgcggaataacccaggaggtttagtaaaagctggtcttgatgtggctcaaatttggttggatggagatgaaacccttgtcaacactattgatcgtgaagggaatgtgctaccaataaatatgatccaagggcattcattaacgcatgatccccttgttgtgcttgtcaatgaaggaagcgcaagtgcaagtgaaatcttggcaggggcattacatgacaatggacgagctattctggttggccatagaacctttggtaaaggaaaaattcagagtgtgactgagctggacgacggatctgctctgtttatcacagttgcaaagtatctatctccagcgctgcatgaaatcgatcaagtaggaatccaacctgacatacaatgcagccctgacatcctttctttgccaacagcgccttcgctaagagaaaacagcaacgccacaaatttggagatggattcgtgtatcatggtagcagaacaagcgttggaaattcagcaaagcaagggttccgcttcttagatgcactatgggctctgtacattatttgcattctacagtagattggatagcttaccttagagacttataaagttctgtagcggtatatagagagaggctgatcctcacatg

SEQ ID NO: 178 - DNA, 2305 bp, Zea mays
tctcctggtcctggccatggcccacgaacgggagccgctcctgcagcaacgacagaccggcgtcggcaatgcctgcggtgccaagggctcgtcctcggcgccggcgccgtcggctgccgcgctgccgtcgctggctaggaccgtgctcaagttcctgatgtgggcggtgttcctcacctgggccgcggggatcttcctctacccgaccaagcccgtgcaggccgtgttcaggaagtgggtcgggctcaccagggactccatgttcggcatcgtcgggggtattttcctgaccttcagcgcgccaattctgatcattgcgcttctcgcatatgtgtacatctccttcttcccgagtgagcatgtggtggagaaaaggaagctgcgctcactgagtttcaggctctggactttccctgttcttgtagacggcccctttggagttgtctctgcagttgagttcatcggaattgtcttgtttatagtttttgttgtctactcaatgacctattatgccgtggacgctgtgagccttgtctcgaaatttgacatcccatcaatgactgagagtgaattgatactggatgtcattggcctccgtttaggggcggttgggttgttctgcatgctcttcctcttcctgccagtcgcccgaggctcggttctcttacggcttatcgatattccatttgagcatgctacaagataccacgtctggttggggcatctcacgatggctctctttacattgcatggcttgttctatgtgatctcatggtccatgcaagggcgcctccgtgaagaactgagacaatggaaggaaattggagtagcaaacctgcctggtgtgatcagcttggcagccggcctacttatgtgggtgacatcacttcacccagtgaggaagaggttcttcgagctcttcttctacacccaccagctctacgtcgtcttcatcgtgttcttggcgtttcatgtcggtgacttcatcttcagtatttgtgctggagctgtgttcctcttcatgctcgaccgctttttgaggttctggcaatcaagggccaaagtcgacatcatttcagccgcttgccgcccgtgtgggacggtggagctagtattctcaaaaccagcaagcctccactacaatgctttgagtttcatcttcattcaagtgcgcgagctatcgttcttgcagtggcacccgttcagtgtatcttcaagtcccatggatgggagataccacatgtcggttctcataaaagtactcggcacgtggactgaaaaactgaggagcatcatcaccgatgtacaggagaagaacgggggtgactctgagctgcaatgcgggcgcatgacagcctgcgtggaaggcccatatgggcatgaatcaccctaccacttgatgtacgagaatctcgtcttggtcgcaggaggcattggaatatcgccattcttggcgatcttgagcgacataatccacaggatcgaggagggcaagcaatgcatgcccaagaacgtgctggtcctttggtcagttaagaagtccaaggagctttctctgctgtccgccgttgatgcccagaccatcagctcatctgtctcggacaggttgcaactggatatccaggccttcgtgactcaagaaccccatcctcctttggaggatggcatcgtcggggacgaccagaaagtccctggcatgttcgtcaagaacggtacggccatgtctgggctggtcggcaccggggacaacttctgggcggccatgtacttcctggcgtccacgctcggcttcctcctggcgtacgccctggtgcaggtgtactacgtgaagccgcacaacgtggtggcgtggtggtacctgggcctcctgttcatgctgtgcatggttgcgggcgtcgctctaccgggcgggctcgtggtcctcctgtggcatctgtcggagaagcagaggttggaggacgacaagtgggacgcctctcagtcaccgcgcgccgagcagacaggccccttggctgcggcgggtggtggtgacgacgacgctgctcccagcgtcagcctcgccgccctgcggacgacccggtacggctgccggccgaacttcgaagcggagttcgcggcgttcgcggagcgcgccggggacgcggcggacgtgggcgtgctggtgtgcggaccgcaggggctgcagacgagcgtggcgagggagtgcagggcgcggaacctccgccgcggcggcgtgggggcggccaagagcaggagcggcgcggtcttccatttcaacagccacagcttcgacctgtaaacttaa

SEQ ID NO: 179 - DNA, 680 bp, Zea mays
gtgcggagttcttctctccttccgctcgaagagaagagaaaaaagaacggtccgtgctcggctgccgtgaatctctctcacctccccgaagcaagcgagcggggcagcgcgctaggaaggatcggaggagacgccatcaatcagcacttgcacgcgcgcggtcggccgcaggtggaggaaggagatgggcctgtgctcgtgctgctgccggtgcctggagctgctgtgctcggtcctcctcccgcccctcggcgtctgcctccgccacggctgctgctccatggagttctggatcagtgtgctgctcaccatcctcggctacctccccggcgtcctctacgccgtctacgtcatctgctccgtcgacccccaccgccaccgcgacaacgacgactacgtctacgtcgcatgacaagatggaccggtccccgtggtgctctggtccgtgtctctgctgctagcctgctacctccgtccgctgtgctgtgtgcatctttttgtttggtttagtaaactaaatccatcttgtggccttctgtaaactgtaaattcgtatgtcgaatctgacaatctggacggattcattccataaactaagatctggtgttgcgggatctgtggagttagttagggttactttgctacctcgttcagttgtgcttgtgaaatgaaactgcaga

SEQ ID NO: 180 - DNA, 1643 bp, Zea mays
ctctcatggcgggctaccgcgggggctcctccgtctccgcctccaccggcggcgggggcagcgcggtggccgcagccttctccacccggctgctgctactcctcacgctgctgccgctcgcgctcgccgccttcgccttcgcgctccagtggcgcggcggtatgcgggacccggcaggtgcagcctggcccgccgacgcgcagcgcttcccgggcatggagaacagccccctctcctcctcccacggaggagcaggctcctacttcgccgtctcctcctcctcctcctccccgggagccgactgcgccgagatccttggccggagcgccgcgtcctccaatggaatctcgctctaccgcgggtggagcttcgactccgaatctgctataacccccaagatctgtatcacgggaagcacatctgctagcctacaccagattcttccatggttgtattatcacaaggtcattggtgtttcccatttctttctttttgttgaaggagaggctgcaaagccagctgtcacctctgttcttgaatctattcggggtgtaaaaattatttacagaactaaagaactgaaagagaaacaggagaaaagccgcatttggaatgagacgtggctagcaggtttcttttacaagccgtgtaattacgaactatttgtcaagcaatcactaaacatggaaatggctattattatggcaagggatgctggaatggattggatcattcacctcgatactgatgagttgattcatccagctggtgcccgagagtactccctgaggcgattgcttttagatgttcctgacaatgttgacatggttatcttccccaattatgagagcagcattgaacgtgatgacattaaggatccttttactgaggtttccatgtttaagaaaaattatgaccatcttccaaaggatacatactttggcctgtacaaagaagcaacacgtggtaatccaaactacttccttacttatggtaatgggaaatcagctgcaagggttcaggagcatttgcgaccgaacggtgctcatagatggcataattacatgaaatccccaaatgaaatcaaattggaggaggctgctattctgcattacacctacacaaagttctcagacctaacctcaaggagggatagatgcggctgcaaaccaactaaagaagatgtgaagcgatgttttatcttggaatttgaccgtttggcctttataattgcatcaacagctactgaggaggagatgaggaactggtacaaggaacatgttgtatggaccgatagagacaccaatttgaaacttttaaggaagagtgtcttgacacgcatatatgcgcccatggctattatccgtggcctcaaggaatctggcgtctttaccaatgcagtaacatcagcgaaagcacagtcaaaaacgaagtcatcaaacatgggtctcggaaacaaggatcctatccagccaaacggaactgctggtcagtccacactggaaggcagtcatggaaagttgcaggcaaccgtgagaaagatcctggaaatggttgacacacaggaagaagcagcgatgccaccaatgtcgcccccgggttttcttgagctgactgaaagtgtcactgccttttcatgatga

SEQ ID NO: 181 - DNA, 1073 bp, Zea mays
acgcactaaccctaaagcttccccgcgttgccggcgatgagcagccttcgagccatctcctccctcctccatatctactccacgtccgccgccgccagacgaggagccgggcggctgggcttcgcgccgtcgcccggcgggagattccgggtaccgtcgaattccggtccgcccgcgttcgtgttggacgaggtcgcgagggcggccggcggggttcggaggagggcgtccacgcgcgcggcgagttgggactcggagaaatcgccgtacgagacgcttgagctgggtagggatgcagacgaggagaccataaagactgcctacagaagattggccaagttctatcaccctgatgtttatgatggtaagggaacccttgaggaaggggaaaccgctgaagcgcgtttcattaagatccaagcagcgtatgagctgttgattgatggtgaaaggagaagagcatatgatagagagcatcatgtgaatccgatgaaggcttctcaagcatggatggagtgggtaatgaagaagcggaaagcttttgaccaacgtggtgacatggctgtggctgcttgggctgagcaacagcaacgcgaaatgacgctacgggcacggcgtctctcacgctcaaaggttgaccctgaggaagaaaggaagctatttgccaaggaaaagaaggcatctatggaattctacagcacaactctgaagagacatacccttgtgttacggaagagggatattatgcgcaagaaggcagaggaggagaaggataaggagatcagtagactcctagcggcggaagggcttgagttggatacagatgaagatgaaaacaagacttttctggggtaacgcttttgatacttaccctaatttattctcttcctccattccagcaatcgttcaagatgcagcgacaacgagtgcacaaggcgaaacagttgggctcgtcggaaacgctgtaatctggagatgtgcgccaacaaatattggatcgaaataataatctcccggggcgaagtttagcattttaccggagagcagaaaggaaaggcaaatgaaggatgtgt

SEQ ID NO: 182 - DNA, 568 bp, Zea mays
cattccatcttctgctgggtagcagctagcagtatacaagagcttgcttgctgtcctagtcctacctactgacgagctcgccatggcctccctctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaggtgccgagcggcgtcgacgccaccaagatctcgcaggaggagtacctcaacgcgccaggcgagacctactccgtcaccctcaccgtgccgggaacctacggcttctactgcgagccgcatcaaggagccggaatggtcggcaagatcaccgtcaactaattaagctagctatcgatc

SEQ ID NO: 183 - DNA, 591 bp, Zea mays
cactcgttgcagcatatctacctctacctactggagtagggagcacgccgcacgagccctttccgccgccgccaaaatggtgaacgttcctaagaccaagaagacctactgcaagaacaaggagtgcaagaagcacactctccacaaggttactcagtacaagaagggtaaggatagcctgtctgcccagggaaagcgccgttatgaccgcaagcagtcaggatatggtggccagaccaagcctgtcttccacaagaaggccaagaccaccaagaaaatcgtattgaagctgcagtgccagagctgcaagcactactcacagcacgcaattaagaggtgcaagcattttgagattggtggagacaagaagggcaagggaacatctctcttctaagtttctcatcgcccatctcgatgttggatcgaagctgtgggtctactactgttctaaaaactcgtcaaatttcaatgttactagtagttctgaaagcaggtcatgctgtgtatcaaattccaatgcctgacatttgcgctgagtgtgggttgtcttttggctaaatgaagttttgcaccctgaatcttcattgaatg

SEQ ID NO: 184 - DNA, 1143 bp, Zea mays
tgaacttcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccccaagacaatggagaactacaggctgctttatgacaccaagggccgcttccgtcttcacccaatcagggatgaggatgccaagttcaagctctgcaaggtgaggtctgttcagtttggccagaagggcatcccctacctgaacacctacgacggccgcaccatccgctaccccgacccgctcatcaaggccaacgacaccatcaagatcgatctggagaccaacaagatcatggacttcatcaagtttgacgtcggcaacgtggtcatggtgaccggcgggaggaacaccgggcgtgtaggtgtgatcaagaacagggagaagcacaagggcggcttcgataccatccacgtcgaggactccatgggccaccagttcgccacccgcatgggcaacgtgttcaccatcggcaagggcaacaagccgtgggtgagcctgcccaagggcaagggtatcaagctcagcatcatcgaggagcagaggaggcgcgactttgctgcccaggctgctgccaaggcataagttctctgaatgtgctgcttggagctttttgctatgtctagtttaatttttatctgcaaggatatagagctaccttcccaagactttatcatcatgttttgttgcttttggttcttgaacagcgtttgcagcttagctgtaatgctttaattcgactttctatatattgttgaaccgtgttgtcgacaccatgacagcttgttttgcttctatgtttttgcttgagctacggtggttgtttggaatct

SEQ ID NO: 185 - DNA, 645 bp, Oryza sativa
ctgccctcttcattcgctcgctcccctcctcgccgcgccgccatctagggtttcgtcttctcctccgccgccgaccgccatggctcgccgcagctcagcaaggtctcgccctgcaccacgtgctgctcccgtgaggaaccctccgcagccagcaaggcaggctcctcctccagctcctgcccagaacggaggtggctctatcctgggaggaattggttccactattgctcaaggcatggcttttggtactggtagtgccatggcacatagggctgttgatgctgtaatgggtccccgtaccattcagcatgagactgttgtctccgaggctgctgcctctgccaccccaatggccaacgccactccatctgactcatgcagcatccattccaaggccttccaagactgcatcaacaactatggaagtgacatcagcaagtgccaattctacctggatatgctgaacgagtgccgccgtggtggtgcatctgcttaggctggtggccttttggaacttttattaattgggcctcgcgttactctcatgattatacatgaataacttggcaaattcatgaacttggtgccactgcttatggctgtactctgataatcgttggtacgcttgggtttgtggtatgctac

SEQ ID NO: 186 - DNA, 1719 bp, Oryza sativa
gtcgaccgaattcccaaagtctcacgcccttcctccaactccccccaaagccgccaccaaaccttctcttctcctctcctctcgcgagtgtcgaactccgccaccgcgcgcgcgcgcgcgccggagacggcggccctcccatccgcggcgggcgccggcaatgcggatggggaagtacgagatggggcgggcgctgggagaggggcacttcggcaaggtgaagctggcgcgccacgccgacaccggcgccgccttcgccatcaagatcctcgaccgccaacgcatcctcgccatgaagatcgacgaacagataaagagggagatcgccacgttgaagctgctcaagcaccccaatgtcgtccgcctccacgaggtttcagctagcaaaaccaagatatacatggttcttgaatatgtaaatggaggagagctattcgacaaaattgcattaaagggtaagttgtcagagaaggaaggaagaaaactcttccagcagctgatggatgctgtaagctattgccatgagaagggagtttatcatagggaccttaagccggagaatgtcctagttgatgcaaaaggaaacataaaggtttcggattttggactaagtgcccttccacaaaatcaacggaaagatggattgttgcataccacatgtggcagccctaactacatcgcccctgaggtccttctcaacagaggttatgatggctctttgtccgacatatggtcttgtggggttatcctatatgtcatgcttacagggaatcttccatttgatgaccaaaatacggttgtcctttatcagaagattctgaagggggatgctcgtattcctaaatggctttccccaggtgcccaagatatactgcgaaaaatcttggatcctaacccaattacacgcttagatataactggaataagggcacatgagtggttcaggcaagattatactcctgctatgcctttcgatgatgatgacgacaacaatatcagtgatggcaacctacatatgactgagaatcaagatattgaaaccagcccagcaatcagccaaatcaatgcattccagctcattgggatgtcctcatgccttgatctatctggattttttgagaaagaagatgtttctgaaaggaaaatcagatttgtatcaaattattcccctacttctctatttgagaagattgagagcactgtcacagaaaagggtttccaggtacagaagaacagtggcaagctaaaagtgatccaagtttgtaaagaaccagcaaatccaagaggacatggaaatttattgatttctgctgaggtgtttgagatcaatgaatctctttatgttgttgagctaaaaaggtcatctggggattgttccctttacagacagctatgtgcgtcactttctgaagacttgggcatatgcaaaaggcaacagcttttgaagaaagattctatgagacaagacctttgtcgatataacagtagcttttgataaaagggtctctctagcttttagttgtgaaggctctagcatttttaacaagagcccccaatacaacgacgtatgacacagttttgtaaaattaaactgtaaatacaaaacaatccaattgtacaccgaaaagagtataccgatcatccaagtatttcctttaggagttcattagtttgtgttctttttgcctttactggtaaatcgctacctcctggaggggg

SEQ ID NO: 187 - DNA, 725 bp, Sorghum bicolor
cgcctgcccaactttatccccgcgcgcgcgcgcgcgcctcagagccccagccgcccgctgccgccgccgccgtgcccccacgcccaacgccttccgcaccgcgcagcgacgtcaccacccgggtgacaccgaccagtccacagttcgctgcaacacccacgcaccgccatggcccctgctgccacgggcgtggggagcctcgccgccgctcccgtcgccaagggctacaccacctacagaaaggccgccgcacgctccgtcgtcaggctggggctgcccgcgctgccgccgctgcccggcctcagactcgcggcgcagggccaggcatccttctgcaagcggctggcgaggaacgtggtggccatggccacgggggagcccaccgcggcgcctgtggctgacaacgaggagctcaccgagttcgtcaacgcgttgaaaaaggagtgggacaggatcgaggacaagtacgcggtgaccacgctcgccgtcgccgccacgctcgccatgtggagcgccggtggagtagtgtcggcaatcgataggcttcccttgattccaggtctgatggaggctgttggaatcggatacagtgggtggttcgcgtaccgaaacttgctattcaagtctgacagggatgctttctttgcaaaggtccgggaggtctacgaggatataatcagaagttaacagatggagcactaatgcaagctcatccaaatcaagtt

SEQ ID NO: 188 - DNA, 932 bp, Sorghum bicolor
ctagcttctagcagtccggaggccggcggcaaaagcaaagcaaagcaagcagcttggtagcgatggcgtccacctcctgcttcctccaccagtccaccgcccgcctcggcgcgtcgccgcgcgtcgcggccgcgccacgcagcgcccagctgttcgtctgcaaggcccagcagaagcagcagcaggacgccgccgccgtggatcagagcgacgtctctcgccgcgccgcgctcgcgctcttcgccggcgtcgccgccgtcggcgccaaggtcagccccgccgccgccgcctacggagaagcagccaacgtgttcggcaagcccaagacgaacacggagtacatcgcgtacaacggcgacgggttcaagctgctgatcccgtccaagtggaaccccagcaaggagcgggagttcccggggcaggtgctccgctacgaggacaacttcgacgccaacagcaacgtctccgtcatcatccagcccacctccaagaagaccatcaccgagtacggctcccccgaggagttcctctcccaggtcgacttcctcctcggcaagcaggccttcggcggcagcaccgactccgagggtggattcgagaccggcgcggtggccacggccaacgtgctggagagctccacgcccgtggtggacggcaagcagtactacagcgtctccgtgctgacaaggacggcggacggcgacgagggcggcaagcaccagctcatcacggccaccgtctccgacggcaagctctacatctgcaaggcgcaggccggcgacaagaggtggttcaagggcgccaggaagggcgtcgagaaggccgccgcctccttcagcgtcgcataataatgaaattgtgctgcatcggccgggattattatttctttgatggtttggcttcatcaggggatgcacaacgtagagagcatg

SEQ ID NO: 189 - DNA, 1189 bp, Sorghum bicolor
cacacatatacacacctccttgcgcttgcccacaccacctcgctcagccggaagacccgcacacgcacgccacttgtacaccatggcgccccgggtggcggacaagtcgccgttgccgccggccaccggcctcggactgggcgttggcggagtagtcggaggcgtgggcatgggcccacactacagaggcgtgagaaagcggccgtggggacgtttcgccgctgagatccgcgaccctgccaagaaaagccgcgtgtggctaggcacgtacgacacggccgaggaggccgccaaggcctacgacgccgccgcccgcgagttccgaggcgccaaggccaagacgaacttcccgttcccgtctcagtgcgccgtcgccgccggcggtgctggcagcccctgcagcaacagcaccgttgactcgagcggcggcgccagcggctgtgccgtccaggcgcctatgcaggccatgccgctgcctccggccctcgatctcgatctcttccatcgggcggccgccgtgaacgcggtcaccgcaggcggcatgcggtttccgttcaagggctaccccgtcgcgcgtccaaccccgcaccagtacttcttctacgaacaggccgccgcagccgctgccgcggcggccggctaccggatgcttaaggtggccccaccgccggtcaccgtggccgccgtcgcgcagagtgattcggactcctcgtctgtggttgatcacaccccttcgcctcccgcggtgacggcaaagaaggaggtgggcttcgagctggatctgaactggccgccgccggcagagaactaggcacaccggagtttttagctgacgaattagtagttacttttttttcctttttgccttcatcaggaatgttacttctggttgtttggtcctgtattcttgttctgtagactatgagattgggagccttgtaaatagtttttttttccgcgaagacggaaatgatctgagatctgttcgtctgtctggacggatcaagccggcgttggtacgggcttagaccatggagtattgattatattagtagtataattcctaagtttactgagaatataattgatgaggacaaaaaatgacccaaagaaatctgtatggaaaagcttcagacgtttcctttcgatctttccattcaagaaaagctgtctagcttggttgggaaac

SEQ ID NO: 190 - DNA, 765 bp, Sorghum bicolor
ctcaagagtcacacaagcaagagaccgagcgagaggatgatgtggtcgcatgagccggcggcggagcagaaggcggcggcggcggcggcgacacggcagcggagctccatggccaagctgacgacggcctcgtcctcgtccttggcgaacctcctctcggtcttcgtcggggcgaataacagcaactcctcggcggacccgacgccgccgccgaggcggagcttcgacgagggcggcggcgtcgggctgggcatcgtcgcggccatgagccacgcctgcctgaccggggctggggccggggtcggggccgagccgatcgccatcggcgccgcggctaggcggcggcgcgcgcgcgaggaggacgagagctacacgtgcgtcatcacgcacgtggccggcgctggcggcggcagcgttcggaagagggtctactttgggttcggcgacggcggtggctggctcgtggaagccgacgacgaggcgccggcgccggcgcccgatttcttgagccggtgctgcctctgtgacaagaggcttgatgggctcgatatctacatgtacagaggggagaaagccttctgcagctcagagtgccgatgccagcagatgctaatggacgaccgcgctgacaagtgtggatcggaagccctcatcaggtcaggcggcgactactcgtactcggtgtcgccgcactccaccccgatggccttctcgccaagcgtcgcagcagcctagtgtagtgcaaagactactcgatcgccctag

SEQ ID NO: 191 - DNA, 1436 bp, Sorghum bicolor
gctctcctgagtccctcactactagctaagctaagctaagctaagctagtagctcgaatggagaggatgctggcaaggctgatgcggcggcggagctcctcccccctgtccgacctcctccaccatggaggagcagcagcggcgggctcgctgcaggccgccgccggcgccactgcggcctccccctggctcttctcccaccaccagcagcagcagcagcagcacacggcggccgccgcgctgccgggtctcaagatcagggactccgcgtcccagctgattgggaggacaccgatggtgtacctgaacaaggtgacggagggatgcggcgcccggatcgctgccaagctcgagttcctgcagccttccttcagcgtcaaagacagaccagcaatttcaatgttggaagatgctgaaaagaggggattgatcactccaggaaagaccacactgatcgagcccacgtctgggaacatgggcattggcttggcgttcatggctgccctaaaagggtacgaactcattcttacgatgccatcatacaccagtcttgagaggagggtgaccatgagggcctttggtgcaaacctggttcttaccgacccaacgaaagggatgggtggaacagtgagaaaagcagcagagctttatgagaaacatcctagtgcatacatgcttcaacagtttcagaatcctgctaatgtcaaggtacattatgagacaacgggtccagaaatatgggaggacacacttggacaggttgacatttttgtcatgggcatcgggagtggcggtactgtcacgggagtcggcaagtacctcaaggagaagaaccctaatgcaaagatatatggagttgaacctgctgaagcaaatgttctgaatggtggaaagccaggacctcacctcatcactggaaatggagtagggtttaagccagacattttggatatggatgtaatggaaaaggttcttgaggtgaaaggtgaggatgctgttaagatggctcgagaattggcactcaaggagggtcttttggttgggatatcatcaggagcgaacactgttgctgctcttgaactagcaaagaagccggaaaacaaaggaaaactcattgtgactgttcttccaagccttggggagcgatacttgtcatctgcgctgtttgatgagttgagaaaggaggctgaagcaatggaaccagtgccggtggattaatttggccaatcaaaccgggcactggaatctggatctttggtgcacaataaacttgccggcagatgtgttacaactgccaattgtacttccattcccctcatccaatttctatcatctcatttatgaaccttgtgaaaaaaaaataatgtaaaattttgaaggagagcaactttagcctctagacatttgtgaaggtcatttcttggcttgtgggttac

SEQ ID NO: 192 - DNA, 2065 bp, Sorghum bicolor
aagaacctctgcctccgtgtcttgctcagcctccgcctccgtctccgcctcggcgttcaacgtgcaaccaccactcagcgagctggaccggtgaggaggccgtctccgcggacgcaacagccaggcctgcccccggcgaccaccgcgagccggcggcatggacaagctcggcacgaacccggccaactcctgcccgctcacgccgctgggcttcctggagcgcaccgccaccgtgttcggcgactgcccctccgtcgtctaccacgacaccgtctacacctggtcgcagacgcaccggcgctgcctccgcctcgcctccgcgctcgtctccctcggtgtctcccgcggcgacatcgtgtccgtgctgctgcccaacgtgccggccatgtacgagatgcacttcggggtgcccatgagcggcgccgtgctcaacaccatcaacacgcgcctggacgcgcgcacggtcgccgtcctgctccgccactccggctccaagctcgtcttcgccgacccggcgagcgtgccgctcgtccgggacgcgctgaggcagctcccgccggggcaccgggcgccgcgcgtcgtccccgtcgaggacccgcacgagaaggagttccccgcggcgccgcccgggacgctgacgtacgaggcgctcctcgacaggggcgacccggagttcgcttgggtgcggccgcgcagcgagtgggacccgatgatactgaactacacctccggcacgacgtcggcgcctaagggcgtggtgcactgccaccgcggcatcttcctggtcaccgtcgacacgctggtggaatgggcggtgccgaagcagccgacgtacctgtggacgctgcccatgttccacgccaacgggtggtgcttcccgtgggggatggcggcggtgggcggcaccaacgtgtgcctgcgccgcgtccacgccgccgaggtgtacgccaccatcgcgcggcgcggggtggaccacctctgcggcgcgcccgtcgtgctcaacatgctggccaacgccccggacgccgcgcggcggccgctcccggggaaggtgcgcatcctcaccgccggcgcaccgccgccggccgccgtgctccaccgcaccgagtccatcggcttcgaggtcacccacgggtacgggctgacggagacggcggggctggtggtgagctgcgcgtggaagggggagtggaacaagctgccggcgtcggagcgcgcgcggctcaaggcgaggcagggcgtgcgcacgcccgccatggccgaggtcgacatcgtcgacggcgagaccggccacagcgtgccccgcgacgggtccacgatgggcgatatcgtgcttcgtggcgggtgcgtcatgctcggctacctcaacgacgacacggccaccagggcggcgatacgggacaacgggtggttctacacgggggacgtcggcgtgatgcacccagacgggtacatggagatccgggatcggtccaaggacgtgatcatcagcggcggggagaacatcagcagcgtggaggtggagtccgtgctctacaaccacccggcggtgaacgaggcggcggtggtggctcggcccgacgagttctggggcgagacgccgtgcgcgttcgtgagcctcaaggaggagaggtcggggtcgccgggcgcggtcaccgcggcggatgtgatcgcgtggtgccgggaccgcatgccgcactacatggtgcccaagacggtggtgctccgcgccgagctgcccaagacctccaccgggaagatccagaagtacgtgctccggaaccttgccaaggatatgggacccacccgcaagggcgccagtagcagcagcaggatgtagtgccagtgctgtgccgtcgtcttgcttggcttggccagcatggaaatggacatggacatgtgctctgctgcagcttgccgttatagcatggggttcgcaggcaaggctcttcattttcttgagatcagcaagccctctcaccgatccttggaatggaaaggatttacgataatgccggtacaacagatatgtctccgtttcaggtggtcattgatacgatgttag

SEQ ID NO: 193 - DNA, 1438 bp, Sorghum bicolor
acacccatcgcctctctattctattcacccgcctcccctctctcgctcatcaccgcacgcgcgcacgaacgctcctaccccctcctcccgccgccgccgccaccgccaccgccgccaaaaccccagctcgagtcgagcccgactcggcgtcctcaacctcctcgtcctcggcgggcgcgggcgagccgggcggggagagatggcgtcggaggacgtggtggggaagagcaggggcgacacggccgtcaccaccatcgtcaacctggcggaggaggccaagctcgcgcgcgagggggtcaaggcgcccggacaccagatcctcaccatctgcaagtcgctcgtcgccggtggcgtcgcgggaggagtgtcacgtactgctgttgctccactcgaacgattgaaaatcttgcttcaggttcaaaatccacacagcattaagtacaacggtacagttcagggtctcaagtatatctggagaactgagggcctccgtggacttttcaagggcaatggcaccaattgtgcaaggatcgttccaaattctgccgtgaagttttttagctacgagcaggcggcaaagggaattctgtgggcttaccgtcaacagactggggaagaggatgctcagcttactccactcttgcgccttggagctggagcgtgtgctggtatcatagccatgtctgctacttacccaatggatatggttaggggtaggatcactgttcagacagacaagtctccctaccagtaccgtggtatgtttcatgcactgggtacagtctaccgtgaagaaggctttcgtgctttatacagagggtggcttccatctgtaatcggagttgttccatatgttggcctcaactttgctgtatatgagtccctcaaagactggctactccagacaaatccatttggccttgcaaatgacaacgagctgcatgtggttacaaggcttgggtgtggtgctgtggctgggactattggccagactgttgcatatcctcttgatgtcatcaggagaagaatgcagatggttggttggaaccatgctgactctatcattactgggaaaggcaaagaagcactccagtacaatggcatgatcgatgcattcaggaagactgttcgtcatgaaggcgctggtgctctgtacaagggtcttgttccgaattcagtcaaggtggtgccctcaattgccattgcatttgtcacttacgaggttgtgaaggatgtgctaggagtagagatgaggatatcagactgaagaagcgggggtagtgctggtcgttatcaactgctatttttgtaggttttggggagtttctgtttttgtaggcagggcgagtaggaggatatgactgcggctacatttcagcatcaggccctcccagcccatgttgatatatcctgctactggcttcaggtcctagaattg

SEQ ID NO: 194 - DNA, 1659 bp, Sorghum bicolor
tgcgggtcaaactagactcttcctccttctctggggtgagagtctgagtttgctgctgctgcctgcctgcctgcctgcctgccggagatgatggacgccggaggaggaggggtgcggtcgcagggggtcaacccggactgccccaacgccgctaaccccttccaccgctgcgccgaatactgtcccgtccccgccccggccgccaacaaagccgcctccgcctccgccgctgcggcgcgcggcaagccggccccgcctcgtccgaggacgacgacggtggcgcagaacgggacagccaagcacggagacggcgctgcgcgcgtcgttcccgccgccgacgcggaggaggaggagaacgacggcggcgagagggaggagtcgcgggcggtcgacccgggctactacccggccagtaagacgtctccgcctcgtcaggggccggcgccggtgctgggctacgcggcgcagaacgggaccgcgcgccgtgtcgtggaggaggagtgcgagattaccgtcgtcgatgacgcggaggagcaaggcgagagcgtcgagaactacggggcggaggaggagcagggcagtggcggcaggacgaggacgagcgcccggtcgccggccacggacggggagggcagcggcggcaggacgaggacgagcgcccggtcgccagccacggacggggaggccggcggcgagaggcagtggcaggcggtcaatccggactgccccaacgccgccaaccccttccaccgctgcgccgagtactgccccgttcccgtccccaaggtgccgctgccgccacgtggatacgaggggagcacgcacagcgaccctggcgcgccgcatcccaggccgcgccgccgcgacaagggcggctccggcggcctccccctctacgtcttcctgcgcgaaggttctgatggcgacgggaagaaggtggatccccgctgccccaacgcgcccaacccgttccatgtctgcaccgaccactgcctcgccaagatagccgacgccggccgctcgtcggagggcgccaagtcgcccatttccctcttctcgcgccactcccgccgttcctcatcgtcctccgaagagggtagcttgaagtccccggggagtaggaaggtggatccaaagtgtccgaatgctggcaatctgttccatgaatgtggtgagcattgtgccaccaagatgcagcagacagagcagcacaaggggttcaatatcaaatccccacgcagaaaagggggaaagaatgctacagtgattccaaattggaaggttgatccaaggtgccctaatgcgtccaatccattccatatgtgtgcccagtattgctttgatcatctcagtgaaacagcgcagacaagtgcaaccaagtcagacaagagtagaggcaaggatattcctaaagatgagcgaagaggagaaatcaactctgattgtgtcaatgcatccaacccctaccacaagtgtggtgaccactgcaagagaagagggtgataggtagacgaggaaggctggcgagacaagatctcttcagagggacgatcgacgacgacgacgatgaaaaattactaagtaaattccatcgacggaccataggctttgagctgcagcagaggctgttttgtagggtgttgcagctgtttgaatttg

SEQ ID NO: 195 - DNA, 1783 bp, Glycine max
tggatcttcttgtcttccaactctctctctctctctctcttgtgaaggctctcacttttgcaactcaaaagcttcaaacccaaagaagtagtacttggcttatagccagtgatgaacactaactgcattatgtaaagattgcatttttgctcccacaaggacaacccatttgtcaaatatggattacgagaggatccaaaagcctcagggtgttgggggattttcgcctggaaaattgaggagcatgctactgggtgtggagaagaagagaaaagaagaggaagagcttgattctactttgaccacgagatctcagaattcagacatggatgaatctggtggtagcagttctgatcattgtaaagacgtagatgttgtgagtgtccttcctgattattcaacttctgctatagttcgcactagtagcatagaggcagttggtggtgatcgttttgtgaaggccaatgcagcagtgaattcaaggaatagagtcttagaagacccttcttcagattatgatagtgggcacgataatatgagcatgtcctcatcaatgttcgaatttcaaaaggcggagcgtgccccacagagggtgcccgtggggccattctcaaaaccagcaccatctaaatgggatgatgcacagaagtggatagcaagtccaacttcaaacaggccaaagacagcgcagacccaggggcaaggtgggcatgcaggaccgcgtaaggctggtagtcttggttatggaagccggcaatcttcgatgaaggttgttgttgaagttccagatcaaaaagaaattgctttagatgaaccagataccaagaaaattgatacaaatcaaactaagatggatagtggaggacagaaatttgtgagttgggaggctgatccctatgcaattgcaagtttttgtgttagtctcagccagcacaatttatctcttgcaatccaaaatgaaacaacatttgttcctcccccttcaacagctcggtctgtgtcaatgagagatatgggtaccgaaatgacccctattgctagccaggagccatcaagaacaggtaccccagtgagggcaacaacaccaatgcgcagccctaattcttcccggccttctactccccccagagcctcccctgcatctactttaactgatctacatagtgacaatctgaatctcaacatgaatgagttgtccgaaaaggagctacaaatgaaaacaaggcgagaaataatggttctcgggacacaactaggtaaaatgaacattgctgcctgggctagcaaagaagaggaggataaggatgcatccacttccctgaaaacaaaagcagaattacctaagagtgtcgttgaagcacgtgcagcagcatgggaggaggctgagaaggccaagtacatggccaggtttaggcgtgaggagatgaaaattcaagcatgggaaaatcaccagaaagcaaaaacagaagccaagatgagaaaaattgaggtagaagttgaaaggatacaaggtaaggcacaagataagctaacgaataaattagcagctgcaaggcataaggccgaggaaaagcgtgcagcagcagaagccaatagaaatcatcaagctgcaaaaactgaagagcaagcagagtatatacgaagaactggtcatgtcccttcctcatatttatcattttcttgctgcaattggtgctcttaaaaaaagccaatctttgtcaatgtttattttttgtttctataggtatgaaatgccttttgctgcttacacccaagcatgtta

SEQ ID NO: 196 - DNA, 2686 bp, Glycine max
aattgaaaacccttcgtccaacaaaggcccgttattaatatatatttctttctcttttttagttttttcttctgagaatgacggggaagaagaatgtgaaggcgatgaccacggcggaagaggaagatgatcaggggaagcacacgacgtcgtcttcgttttcgtcttcttcttcgccgtcgtcgtcttcggacgagagagagtacgaggtgcaggacctgcgtgaccggttgaaatcgtcgcaagggagcatgttcaatctgatagagaaccagttgggactcaactcgacttggagcaagttcagtcgccaagctcttctccatggaatccgaggcttctccatggacttagttaaagacttcgttattcatcctgataacaggtggtatcgggcatggacaaatttcatattggtatgggcagtgtattcatccttcttcaccccaatggagtttgggtttttccgtggcttgcctgagaatctctttatactggacatcattggacaaatagcttttcttgtagatattgtcttgcaattctttgttgcttatagagacagtcagacctatcgtatggtctacaagagaacccctattgctctgcggtatctgaaatctaacttcatatttgatcttcttggatgtatgccctgggacatcatctacaaggcttgtggaagaaaagaggaagtgaggtaccttttgtggatcagattatatagggtgcggaaagtcgaagactttttccacaagttggagaaggacatacgtgtcaattacattattacccggattgtgaaactgatagtagttgaactctactgcacccatacagcagcctgcattttctactatttagctactacactacctgaatcccaagaagggtacacatggataggaagtttaaaactaggtgactttagttattcacatttcagagaaattgatctttggaagcgctatacaacatctctgtacttcgctattgttacaatggctacagttggctatggagatatgcatgcagtaaatatgagggagatgatattcataatggtatatgtttcatttgatatgattcttggtgcctatttgattggtaacatgacagctttgatagtcaagggatcaaagactgaaaagtttagggacaagatgacagaccttatgaaatatatgaacagaaataggctcggaagggatatccgtgaacaaataaaaggtcatgtgcggttacagtatgagagtagctacactgaggcttctgtcattcaggatatccctatttctattcgagctaagatatcccaaacattatatttgccgtacattgaaaaggtttctctttttaaaggatgctcttcagaattcatcaatcagattgttattaggctccatgaggagttctttcttccaggggaagttataatggaacaaggaaatgttgtagatcaactatattttgtatgtcatggagtactggaggaagtaggcatagctgaagatgggactgaagaaactgtttcacttctgcagcctaacagttcattcggagaaatatctattctttgcaacattcctcagccatatactgtccgtgtttgtgaactgggtagactcctgcgacttgataaacaatcatttacaaatatcctagacatatacttttatgatggaaggaaagtgttatacaaccttctagagggaaaagagtcttttcgagataagcagttggagtcagacatcacatttcatcttggaaagcaagaagctgagcttgctttgaaggtcaatagtgcagctttcaatggggatatgtatcagctaaaaggtttaattcgagcaggagctgatcccaacaaggcagattatgatggaaggtcacctttgcatcttgcagcatctagaggatatgaagatatcacaattttccttattcaagaacgtgtagatgtcaatattatagataacttcgggaacacacccttacttgaagcagttaagaatggacatgatcgggttgcttctttacttgttaaagaaggggcctctatgaagatcgaaaatgctggtagttttttgtgtactgcagttgcaaggggagattcagattatcttaaaagacttttatccaatggcatggatcctaacttaaaggattatgattaccgaagtcctcttcacgttgctgcagctgaaggtttatacttcatggcaaagttgctattagaagccggagctagtgtttttacacgagacagatggggaaataccccgcttgatgaagctcggatgtgtggaaataagaatctgatcaagctactggaagatgcaaaatcttctcaactgtcagaatttccatcccaagaatttacagataaaatgcatccaaagaagtgcacagtgttccctttccacccgtgggatccgaaagataatagaagacatggaattgtattatggattccacactctatcgaagagctaatcaaatcagcagcagaacaaatagaaatttctggcggttcttgtattttatcagaagatgctggtaaaattactgatgtggacatgatcaaggatggtcagaagctgtatttagtccatgaaacacattaggcctccatattatggctctttacaaccatataattaagtgccttgtaatgtgttgtgct

SEQ ID NO: 197 - DNA, 965 bp, Glycine max
atcttcggcatcagacaatagacaaaaacatgcattccttaacatgcacaccactttcttcttcttattcttctcatcacaccactctaaagccaaacctcaaccctctgctgggtgctgatgcaacttttaggccatgttctctacccttgaaaagaagaacatgctttactaccagagccattctctcatccaccagagaagatgtcttgaagcatttcagcgagcgaagagctctcaagattatctcaggcctgcagaatttcaataaagacaatgttgcctcggttgtcactgctgctgacaagggtggagcaactcacgtggatatagcatgtgaccctgagttggtaaagctggccattggcttaacttcttgtccggtttgtgtttcttctgtagatcctgcaacatttccagctgcagttgaagcaggagcactaatggttgagattggaaactatgattcattctacgagaagggaatatttttcactccagagaagattctaggtctaacaaaggagacaaggaggatacttccatctgtagtcttgtctgttactgttccacacacactaagcctccctgatcaggtcaagcttgcagagtcactggagcaagtaggtgtagatattattcaaactgagggaggaaaatgttctaatcctacacaatctggtgttatgggtttgattgagaaggcaacaccaactttagcagcagcatattctatatcacatgctgttaagatccccgtcatgtgctcatcagggttaagcgctgtcacagcacctatggctataactgctggggctgctggcgtgggtgtaggctctgcagttaatagacttaatgatgtggttgctatgattgctgaggtcagaagcattgctaattcattgcaggcaccatttcggatatccactacacatgcagtagaaactcaaaggcagtagttttag

SEQ ID NO: 198 - DNA, 1226 bp, Glycine max
ggaggcacttagcagcagtagcagaaatggccaccacttctgcttcattcgcgagcttctccgtcatcttgcgaccttcttcgtccaatccccaattcttcctcttcaacgtcgctccacgaaccggaacctctcattcccgaacccgttcggctcggttcaggtgctcggccggtcagaccgggttcttcacgaaactagggcggttgataaaggagaaggcgaagagcgacgtggagaagcttttctcgggattctccaagacccgcagcaacctcgccgtcatcgacgagcttctcctctattggaacctcgccgacaccgatcgggtcctcgacgaactcgaagaggctcttttagtgtctgattttggtccaagaatcactattaaaatagtggagaatttgcgcgaggatatattttcagggaagcttaaatcagggaatgagataaaggaagcactgaagaggaatgttttggaattattaacctccaaggggagtaaaactgaacttcaacttggatacaggaagccagctgtaataatgatagttggtgttaacggtggagggaagactacatctttgggaaagctggcctatagattgaagaatgaaggggctaagatattgatggctgctggtgatacatttagagcagctgctagtgatcagttggaaatatgggccggacggactgggtgtgagattgttgtggctgaatcagagaaagcaaaagcatcatcagtgctttcacaggctgtaaaaaagggaaaagagctaggttttgatattgtattatgtgatacatctgggcgtttacacactaattacagcttaatggaagagttgatttcctgtaaaaaatctgttgctaaggtcattcctggcgcacctaatgagatcctactggttctggatgggactaccggtttgaatatgttgccacaagcaagagaattcaatgatgttgtgggtgttactggtttaattttgaccaaactggatggttctgctagaggtggctgtgtggtcagtgtggttgatgagcttggaatccctgtaaaatttgtgggtgttggtgaaggtgttgaagaccttcaaccctttgatgcggaggcctttgtgaatgccatttttatttaaaccaatattgtgggtttgcaaaaacagcttgacatgaacattcagagcaacacctggtcaacaggaaagatggcactttag

SEQ ID NO: 199 - DNA, 1535 bp, Triticum aestivum
agattctggactgttccacacgatccatgacgtccacggtgaccacgcccacgcccagccgcccgctcccggcggggccccagcggcgccggtacaggcccacggtgctcgccatcgccggcggtagcaagccgccgcgccgccgggcgcccgccgccgccaccagctgcgtggcgctcgcggcgcccgagaagcagagcacggcgccctccaagctccctgctccgtcgccggcgcccgagggcacggactacgacgaggtggccgccacgctggagacgctatacaagctgagccccgtcatcgtggaggaggacgggaagagcagcaagaagcaggcggccaccaagaagaagaggaagcaggggagggcgaaatcggcagcgacgacggcgacggcggcgacgccgaggaggacagtggtggtgaggagccagcggcggcgccggatggacctggggaagagggtggagatgcgggatcaggccgccgggaaggaggacgaacaccgggacggggagcgcgcgttcgaggaggcgctgctgcgggagcacgccgtgtcgacggacatgggcagcctcgactggaggcggatgaagatcccgccggtgctctccgccgtgcagagcgcccgcctcttcaagatcatgcagcccatgaaggccattttggaggtgcaagagaacctgcggaacgagctgcagagcgagccgacggacgcggaggtcgccgaggccatgaacatgccggtgcagcggctacggcggctccgcgacgtcggccgggcggccaggaacaagctcatcaagcacaacctacggctggtcctgtacgcgatcaacaagtactacccggacatgaccgtcgacgagaggttcgccgacctgtgccaggccagcgccaacgggctcatcacggccatcgaccgcttcgagcccaagcgcggcttccgcatctccacctacgcgctcttctggatccgccactccgtcgtccgcgccatgacgctctccagcttcacccgcttctcgttcgccatggaatcggagagacaagagatcaacagggcgagggaggagctgtcgttcgagctcgggagggcgccgacggacgaggagacgatgaagaaagtggggctgtcgccggcgaggtaccgcgacgtggtgcggatgacgaggccgacctactcgctccactcgcggaaccgtgtcacgcaggaggagctcatcaaggaggtcaccgacgtggacgccatcggggtcgacacccacaagcacaaccgcctcctccgcctcgccattgacgacctcctggactcgctgaagcccaaggagagcgtggtgatcaggcagaggttcgggctggacggcagggggcggcgcacgctgagcgagatcgccggcaacctgaggatctcgagggagatggtgcgcaagtacgagctcaaggcgctcatgaagctcaagcaccccacccgggtcgactacctgcgaagatacatgtgaaattatctgtatatatctcggtcgcgctag

SEQ ID NO: 200 - DNA, 2392 bp, Triticum aestivum
accacagtcacaggtctcacgcacacgctcggcaaccatgggcacgtcgggctccaagggtctggacggcgtcgggggcctcggcgcggcggcgctcggcggcggcagcgggggcggaatgggcggggacgagggcgacggcgccgtgacggggtcgtggcacggcggcgcgcagctctacgtttcgctcaagatggagaaggcgcggatcatcggcgacctcgtgccgcacgtctacggctccgagcccatcatcggctcatgggagcccgcccgcgccctcgcgatggagagggagctggcgtccatgtgggagctcagcttcgtcgtgccgccggaccatgaaacactcgacttcaaattcttgctcaagcccaaggacgcggagaccccgtgcatcattgaggaagggccgacgcggcttcttaccgggggcatgctcgagggtgatgttaggcttgcaaacttcaggcttaatggagacgatgagttgcttgagtttagggttttcaacaaggccgacatcgtgtctccgcttgatcttgccgcgagctggagggtatacaaagaaaatttccagccttccaaggtccgaggaattcctgatatcagtataaatgaagcacccactcatgcgaccgaggatggatctggttctagtttggaacttgacttagagcattatgttgttccaacgccaactgcaccaccaactgaatatgcagcaaaccttgctgcaaccccagcatccttagatcagcctgaaacaccgtggacaaatgatatgcttcttagtgatggcattcagagtccaagaagtgctgctgcagattttaaagatgatagttaccataataaggatactgaggcttcaatagcagattcttctaattctaagaagttacaagtttctggaatggtagagtcaaaatcagttggtaccttaatacaactgcaaaagaaggacatgccacaagggctatacgttgacaggggtgttgtctctcctaagcttggaaaatcatttagtgcatgttccctggcatctggccttaattttggatcaacaaaggccatgccagaagcagccggagctgttgcagctgcagctgtagctgataggttgcacggatcaaaggaggaccggaaactggctattgttctggttggcctaccagctcgtgggaaaaccttcaccgcagttaagcttacaaggtaccttcgttggctaggtcatgaaacaaaacatttcaacgttggaaagtaccgccgtctgaagcatggagcgaatcagtctgcagattttttccgccctgataaccaagaggggatcgaggcacgtaatgaggtggctgctttagcaatggaagacatgatagactggatgcacggaggaggtcaggttggtatatttgatgcaacaaacagcacaaggaaaagaagatatatgctaatgaagatggctgaagggaactgcaagataatatttctggagacaatatgtaatgatcgaaacataatcgaaaggaatgtacgcctgaaaattcagcaaagccctgattatgctgaccagccggattatgaagctggattgcaggacttccttgaacgtttgacaaattatgaaaaggtctatgagccagtgcaggaaggctcatatatcaaaatgattgatatggtaaaaggggagggtggccagttgcaggtgaacaatatcagtggctatctccctgggcgcattgtctttttcttggtgaattctcatcttgcgcctcggcctattttgcttaccaggcatggtgagagtttacacaatgttagaggaagagttggcggtgacacggtgctaagtgaagacggagagctttactcaaagaaactagccaactttattgaaaagcgcctcaaaaatgagaaaactgcaactatttggactagcactctacagagaacaattttgacagcaactccaattgttggattcccaaagatacaatggcgtgctcttgatgagatcaattctggtgtatgtgatgggatgacgtatgaagagataaagaaaattatgcctgaggaatatgagtcacgcaagaaggacaagctgcgttatcggtacccacgtggggagtcttaccttgatgtgattcagaggttggagcctgttatcatcgagctcgaacgccagcgagcaccagtggtcgttatatcccaccaggccgtgttgcgagcattgtactcgtatttcgccgacaggcctttgagggaagttccagacatggagatgccactccataccataatcgagatacaaatgggcgtcaccggtgtcgaggagaagaggtacaagctcatggattgagaatctgagatacaggtaggctcagcacaatag

SEQ ID NO: 201 - DNA, 1246 bp, Triticum aestivum
cggaagcaagtgagctgagcgcaggcgggtggaggcggacggacgcgacgatgagggcggtggcgatcgcgagccccggcgggccggaggcgctgcaggtgcgcgaggtggacgacctcccggcgccgggggagggcgaggtgctcgtcgcggtggccgccgccggcgtcaaccgcgccgacacggtccagcggcagggccggtacccgccgccgcccggcgcctccccctacccggggctcgagtgctccggcaccatcctcgcgctcggggccaacgtgcccccgcgctgggccgtcggcgaccaggtgtgcgcgctgcttaccggtggcgggtatgcggagagggtggtggtgccggcggggcagctgctcccggtgccggagggggtgtccctgaccgacgccgccggcttgcccgaggtggcctgcaccgtctggtccaccgtcttcatgaccagccacctctcccccggcgaatccttccttatccatggcggatcgagtggaatcggtacattcgctatacagattgcgaagcaccttggtgttaaggtttttgttactgcaggaagcgaagaaaaactagctgcctgcaaaggtttgggagcggatgtatgcataaactacaaaactgaagattttgtagcgcgcgtaaaagaagaaaccgatggaaagggtgttgatgtcattctggacaatatcggcgcatcttatctccagcgcaatctgaacagcttagctgttgatggtagactcttcatcatcggtttcatgggaggcactacaactgaagtgaacctgcaggcgatgcttgcccgaagattgaccatacaagctgctggattgcggaacagaagcctcgctaacaaagcccagatcgtcagcgaggtggagaagaacgtgtggcctgccgtcgtgtcgggcaaggtgaagccggtgatttacaagacattccctctgtctgaagcagctgaatctcacaagttgatggagacgagctcccacattggcaagatactgctgattccatgattggatatggtgtatcatgtattcatgtgtacactagccgctgtgggcactgtttactgtggtgaactatgcatggacatgcccttttatattgtaataagctggatctctaagtgctggtgaaattggatatgtatctcgaggataaatagtcacaataaaatgttggaacttggaagtcttgtcctttcatcttatgggaggattattga

SEQ ID NO: 202 - DNA, 703 bp, Triticum aestivum
gtgcgtgtgggagttgaaggagatcgagatggccacagcatatgctcctccgatggcgagccaggtgatgaagagcggcttggtgtgctccaagccgcggggcatgtccggcgcttcgctcaccaggaggccccgcctcgtcgtcaaggccgtcaagtctgacaagccgacttaccaggtggtccagcccatcaacggcgacccattcatcggcagcctggagacgcccgtcacctccagccccctcgtcgcctggtacctctcaaacctccccgcctaccgcaccgccgtcagcccgctcctccgcggcatcgaggtcggcctcgcccacggctacctcctggtcggccccttcgcgctcaccggcccgctccgcaacacgccaattcacggccaggcaggcactctcggcgccatcggcctcgtctccatccttagcgtctgcctcaccatgtacggtgtcgcgtccttcaacgagggcgcaccgtcaaccgcgcccgcactcacgctcacaggccgcaagaaggaggccgacaagctgcagaccgctgaagggtggtcgcagttcaccggaggcttcttcttcggtggtgtctccggtgccacctgggcctacttcctcctctacgtgctcgacctcccatacttcttcaagtagattaattattggcatgcatgtacgatgggtgcagatcatgtgtag

SEQ ID NO: 203 - DNA, 1247 bp, Triticum aestivum
tcggtttatcacctatcgagctcccgcgagagacgatgggaagcgcaggagcgctgctctcccaccccccaccgcaactcggcagcatcctcctccgtcgccaccacatctctcttccccatctctcctcatgcatgcccgagcccctccactgccgccgccggcaccttcgctgttccgccgttgaggggagcagcagacaggacacgaatttgccagcgtctcaaagagaagagtctccatcgagcagcctcggcgccaccctccaagatccacttccaggacgtgtcgaaaatggttcttttgaaggtgtcacacaggaagaagatcagagtagtctatataattttctttatccaagcaaagagctacttccagatgataaggaaatgagtatatttgatcatctagaggaacttcgtgcgaggatatttatatcagtattggctgttggagcttcaataattggttgttttgctttctccaaagatataattaagattcttgaagcgcctgttagtgttcagggtgtcagatttttgcagctctcccctggagaatttttctttacaacattgaaggtctctggttattgtggcctcctaatcggaagtcctataattttgtacgagatcatagcatttgttctccctggtttaaccaaggatgagcggaaattcctagggcccattgttttgggttcttcagttctgttctaccttggcattttattctcctacactgttcttgctccagcagcattgaacttcttcgtgaattatgccgaaggagcggttgaatcgatatggtcaatagaccagtactttgagttcgtacttgtgcttctgttcagcacaggattatcctttcaggttcctgtgatccagctgttgctggggcaagttggactggtttccagcgaacaaatgctttcaatctggaggtatgttgttgttggtgcggtggttgctgcggctgtgcttacgccctcgactgatcccttgactcagatgcttttggcgggtccactgcttggtctgtacttgggtggtgcgtggatggtcaggctaactgggcgctaactgcaacaagcgttgtagtgattgggtattgtgtgttagtgtactagaaatcatagccgtgttgattggtccgagtggtcaccgtcccccactgtaacatagtcttgtataaaattaactcggctgcttctcatctacgagcacattatttggccctctttctca

SEQ ID NO: 204 - DNA, 1620 bp, Triticum aestivum
agagccaaacgccaagacgcaaagcgaccgggagcttcccgatcctcctgtcctgtagccgcgcgtgggaaaggggggctgcaacttttcctcggtgcggcggtcagtccatccatatatatagcaaatggagaggagctggttcgggtggaggaaggcgaagcagggcggaggtggcggtgccggcggcggcggcggggagaaggaggaggatcaggccaaggtggtggtggacgggtccgggatacgggagctggtggaggacagggaggcgttcggcatgttcgcggagagcaagttccggcagctcgacgccgacggggacggcaggctgtccgtgcgggagctgcagcccgccgtggccgacatcggcgcgtcgctcggcctgcccgcgcagggctcctcgcccaacgccgaccacatctactccgaggctatgagtgagttcactcatggtcacgggaaccaagagggtgtaagcagggcagagttccaggaggtactgtccgacattctcctcggcatggcggccgggctcaagaaggacccgatcgtgatactgcgcatcgacggcgaggacctcagggacttcgtgtccagcccaaggtatgagccggcagtcgctgccatcttctcacaggttgtgtctggagacctctctctccggcaatgcctgctagctgctgtccagcagctcggcgtcgaccacggcatgcccccggctgctgacccttgggtggtagagaacgtggtagagccggcattgcagcagctctccgccgatgagctcgagcaaccgtcgtcccgggacgtcttctttgagcagctgaagaagctcctgggcagcgtggcggatcagcttcaggagcggcacgtgatcgttgcgcacaccgagaacaccttcgacgggagcggcgtcaggaggctgctgggaaacaagttcgagctggacaagctgctggattctgtgtggagggacgtgccggcagagcacaggaagaaggcgcccaagggcaaggagcacctgcgagtcgcactcgataagatggccgatgcagcaagcttaccacctcatggcgctgttgctcaggtggacgccgtggtggacgaggcgctcaaggtggcggacgccggcgacgggaaggcggttgaagaagccgagttcaagaagctgctgacggaggtccttggagctgtgatgctgcggctgagcggccaaccaatcttcttctccaccagcaccgtcgtccacgagccgctatccacttcggccaccctgttgccctcgccggcggcggcatcgccgccgagtgagtagcaatacgagcacacgaaaggtaaatagcatgggatgggcataaggcctcctccgtaagctgtgcctgtggttgtgctttttatctgatcacgagcattcatgctttgctatggttggttggaacctgacggaatgcagcgttgcagttcgtcaaatactccagcagtatgtatattgaccctgcttgatgtataagtttggaataaggcttccaagccagaaagacacattgtcaatgggaaatgttactgcgtgcgaatgcattggtttgacaagatgctatattactacgtgcgagagca

SEQ ID NO: 205 - DNA, 1396 bp, Triticum aestivum
gaacggggaaagggatctcgccgcaacgcaccatggagctcgccgcaaccagcgctgctgccctccggcgatcgttggcgtcggggtatccggtggtcccgagggagaggaggagtgggatgccggctagggtgtcctgcgtcggccgcggaggcagaggcgtaggcgggggattcgccgacgaggcgcacctcaggtactacgaggcgccgcggaaggcggtggaggcggcggcgagggatcttaccaagctccgggccatgggccttgtcgccggcgacccagccaaggagaagatcctctcggaagccactgagctgctgctacaggagttgaatcagatgaaggatgcagaggacgagctgaagaagaagcagaaagaggagaaggctgcgatgaaagcactgaagaagcagcagaaggaagccaagaaggctgcgatgaactgtggagatggctcctctgaatcgagcgagagtgagtgcgaggaagggcaatccatgaaaatgaggtgtgttgccaccacatcggtgcctgcagttgagcaaggaatggtgatgtcaatgtcggtgccccaaattgctgcatccaacatcgcaacagctccggcaatggattttgacaaggctgcgatgaaggccatgaagaagagggagaaggaacaaaagaaagctgcaaagaaggccatgaagatgaaaaaggaggaagagaagaggatggccacactgaattcctgcaaggatgaagacagctcatgctcatcggagtccagcaacagtgagtgtgaaggggaagtcgtcagaatgagctgctgtgccaccatttctgcgcctcgaacaccacctgcaagcacagttttccccatcatagtgcctcaaatcccagactccgttgcactggatgctcagatcttttccgggtctgcaaatgcaatgcagtgcactgccaccagcattgcggttgtcgaaaaaccagtgctgaacagaatcgaggtctgcatgggcggcaaatgcaagaaggcgggctcgctcgctgtcctgcaggagttcgagacggaggtcggcacgggcggcatggtggtcggttgcaaatgtttggggaaatgcaggctaggcccaaatgtgcggcttcggagtgagggctctgtacagaagaacagtcccatctgcattggtgtaggcttggatgatgttggcaccatcgtggcaggcttcatcggagatggtgacgtgggcatgaactgatacgatggttacctggacctggttcaggttggtatttacagacctgtactcctacaacttgttttgtctggcaaatgtactactacaactttgctgcacaataatacattgtagataatcacgcccctgacgagctgatgtatgttctgagc

SEQ ID NO: 206 - DNA, 692 bp, Zea mays
gagaaggacaatcgcgtcccaccgccgctgcacaagacgaggaagaggttcccggtcccggcgccgccactatgtcgtcgatgatgaacgcgctgtcaaactggctggtgaacccgcgccgcaacccgctcgcgcgcctccacatgcacaccgtctcctcgcgcctcaggaaatacgggctgaggtacgatgacctgtacgacccctacttcgacctggacatcaaggaggcgctcgggaggctgcctagggaggtggtcgacgcccgcatccagcgcctcaagcgcgccatggacctctccatgaagcatcagtacctccccgaggacctccaggcacagcaggtcccattcagaggatatttgagtgacatgttggctctggtgaaaaaggaaaacgctgagcgtgaagcactgggagcccttccactctaccagagaacgcttccctaaatcgctggctaaacatggttgcaagtcttctctttacggcaaatcagaatgcatgcaataaaatgcagtgggtgttttttttggttccaaccaaagttacattttacttgtccacgcagtggtgcattgaccatgcgctctacctgttttttttttcttccgattaatgggagcaaattattgtaacactataattaacttgtgaatcttcagctgcgggtggctgacgtagtgttcttt

SEQ ID NO: 207 - DNA, 1457 bp, Brachypodium distachyon
ctcgaggcaaattcctcaccaaaccacccaaaaggactaaaccctcctctccacgatgtccgccgccgccaccgccgccacctccggccccaactccatcctcctccaccggcccacctcggccgggcccgccgtcgcctcctccatccgcctccccgcacgcgcatccaaggtctcctgcgccgccgtcgcggcgccctcctccccccatgccctcacgggcgccggcgagcgcggggtgtacaacttcgcggcggggccggccacgctcccgctctccgtgctccagaaggcgcaggcggagctcgtcgactaccgcggctccgggatgagcatcatggagatgagccaccgcgggaaggagttcgacgccgccatcaagaaggccgaggccgacctccgcgcgctgctcgccgtgccggacacccacgaggtgctcttcctccagggcggcgccaccacccagttcgccgccgtgccgctcaacctctgcgccggcgcctccgacccggtcgacttcgtcgtctccggatcctggagcgacaaggccttcaaggaggccaagaagtactccgccgcctccgtcgcctggtctggcaaggacggcaagtacaccgccctcccgcaattcgacgccatcaagcagaacccggaggcgaggttcctccacatctgctccaacgagaccatccacggcgtcgagttcaaggactacccggagcccaagaacaagtccggcatcctcgtcgcggacatgtcctccaacttctgctccaagcccgtcgacgtgtccaggttcggcatcatctacgccggcgcacagaagaacgtcggcccctccggcgtcaccatcgccatcgtgcgcaaggacctcgtcggcaacgcgcagcccatcacgccggtgatgctggactacaagacgcacgccgacaacgcctcgctctacaacaccccgccctgcttcgccatctacatctgcgggctcgtcttcgaggacctgctcgcgcagggcggcctcgcagaggtggagaagaagaacgagcacaaggctggcatcctgtatgacaccattgacgccagcggcgggtacttcatctgcccggtagagaagtctgtccggtcactgatgaacgtgccgttcacgctggccaagggagcagacttcgagaagcaattcatcgccgaggcagccaaggagggcatgttgcagctcaagggacacaggtcggtcggcggagtgcgtgcttccatctacaatgccatgccgctctctggcgttgagaagctcgtcacattcatgaaggatttccaagcccggaactcttgatttacccgcggccatgatactctggtatcgcttcagtaggatggtttgctgttcttcataacataagcatgctctctgcaagagctgcatcgtctcgcatatgtgatttgcattcataggccttggtacc

SEQ ID NO: 208 - DNA, 950 bp, Brachypodium distachyon
ttcacctctccgatctctgttccttcgcccaactctagcagagccagggcgcgaccgcgcgaaggaagcaaccaaaacccaaagaaattccaaaagctcccaagggagagagccaggtctcggaggcagaggcggggagcggcgccaaggatccatggatcggccccaggtcgtcagtgagaattatgccaatcctataacatgcctcttccacgtgctcttcaaggcggcggcgctggcgttctacatcctgttctcgctctttgtgaagagcttcgtcatcatctttgttatcaccgtgctccttgcggcgcttgacttctgggtcgtgaagaatgtgagcggcaggatactggtcgggctgcggtggtggaatgagattgacgatgatggaaatagcgtgtggaagttcgagtgcctagatgcggagtctcttgctcggatgaacaaaaaggactcgtggctgttctggtggactctttatttgacagctgctgcgtggatcgtcctcgggatattttcactcattagacttgaagctgattaccttctcgttgttggagtttgcttgactctaagccttgcaaacattgtggggttcaccaaatgcaacaaagatgccaagaagaacatccgggcttttgctgaaaatgccgctcaaaacgccatcacctcccgcatcacctcatctctgcaatcagcattctcagttatctgaagtccatattatgtagaggctcaaatattacatataccagtgtacaacctgtcaaaaggaccagcacctgatatccgcatgagtttttgacatgtacaccaaactggttacttttgattggaacgacactatgacagacaacaacatactggataattccacacttgtctcctacactaatggcatgctttctgcatttcttgtaccctggtgtggcctagaggtctttgac

SEQ ID NO: 209 - DNA, 2918 bp, Brachypodium distachyon
aagaagattattgctgtggttgggcagcctcggaacagtttcggctgataaaatggagtcgcatgatggcgtggctgatgacttgccaccaccaccacctctgccgccaagcatagagcctcttaaacctgaggaagctgatgacttgccacctccaccaccactaccaccaaatgttgagcctattaaagttgaggatgcaaagaagcctaggaggacgctgatctcacgtcctgggtttggcaagaatgggaagccgatacagcttgtgacaaaccattttaaagtttccttgaaaacaactgatgagttctttcaccattattatgtaaatctgaagtatgaggatgacaggccagttgatggaaaaggagtgggtagaaaagtcattgataagctacaacaaacttatgcatctgagcttgcgcataaagattttgcttatgatggggaaaagagtctttttaccataggtgctctaccacaagttaacaatgagttcgttgtggtgcttgaagatgtttctagtggaaagactgctgcaaatggcagccctggaaatgacaactctccaggaagtgataggaaaagagtcagaaggccatatcagactaaaacttttaaagtggagctcaactttgcttctaggattccaatgagttctatcgcgatggctctgcaaggtcaggaatcagagcacacgcaggaagcaattcgggttattgatatcatattgagacaacacgccgccaagcagggttgccttttagtccgccaatcctttttccataacaatccatcacaatttgtggatctgggaggcggtgtaatgggctgcaggggatttcactcaagcttccgagccacaaagagcgggctttctcttaatattgatgtatctacaacaatgattgtgaaacctggtgctgtcgttgattttctaattgccaaccagaaggtagatcaccccaataaaattgattgggcaaaggctaagcgtgcactgaagaatctaaggataaaaacaagtccagcaaacacagaatttaagattgttggactgagtgaaaggaactgttatgaacaaatgttttcactgaagcaaaggaataatgggaatggtgactctgaagccatagaaatatctgtttatgattactttgtgaagaatcggggcatagagctaagatattctggtgatttcccctgtatcaatgtggggaaaccaaagcgcccaacatattttcctattgagctctgctcgcttgtgcctttgcaaagatataccaagtctttaagtactctccaaaggtcctctcttgtcgagaagtcgaggcagaagcctcaagaaaggatgtctgttttgtctgatgtacttaaacgcagcagctatgacacagatcccatgctaaaggcatgtggaatttcgatagctcaaggttttacgcaagtgcctggtagggtactgcagccccccaagctcaaagctggaaatggtgaagatatttttacaaggaatggccgatggaatttcaataacaagaggcttgttagagctagctgtgtggaaagatgggcagtggttaacttttcggcacggtgtaactgcaatgatcttgttcgagacctcatcaagtgtggaggcatgaagggcattaaagtagatcagccttttgacgtgtttgaagagaattcttcaatgagaagagcacctgctccaaaaagggtggaggctatgtttgaaacagtgaagacaaagcttcctggagcacctaagtttttgttgtgtatcctcgctgagaggaagaattcagatgtttatgggccatggaagcgaaaatgtctagctgaatttgggattgtcacacaatgtgtggccccaactagggtcaatgaccaatatctgacaaatgtcctgctaaaaataaatgcaaagcttggtgggatgaattctttgctgcaaattgaactgtcccctgcaatccctcttgtatcaaaggtcccaactatgattttgggcatggatgtgtcccatgggtcccctggacaggctgatacaccatctattgctgcagtcgttagttctcgtgaatggcctcttgtctcaaagtacagggcctcagtgcgttctcagtcaccaaaatcagaaatgattgattcactgtttaagccacaaggaactgaagacgatggccttattagggagtgcctaatagacttctataccagttctggaaaaagaaaacctgatcagattataatcttcagggatggtgttagtgagagccaatttactcaggtgctaaacaaggagttagatcaaataaatgaggcatgcaaattcttggatgaaagttggtcccccaaattcacactaattgttgcgcagaaaaaccaccacacaaagtttttcatccctggatcaccggataatgtccctcccggcactgttattgataacgtagtttgccatccaaagaactatgatttctacatgtgcgcacatgcaggaatgataggaacaacaaggccaacacattaccatatcctgcatgatgatatacactttaccgcagatgatctgcaggatctcgtgcactcgctctcttatgtgtaccaaagaagcacaacggccatatcagtagtctctccaatctgctatgcccatcttgctgctgcccaagtgtcacagttcgtcaagtttgatgagatgtctgagacgtcttcaagtcagggaggcggaggccacacctctgcaggcagcaccccagtgcaagagcttcctcgcctgcacgagaaagtcaggagctccatgttcttctgttgaagcagctgcctgtctctgggcttcttctggtggatggttggtctttgatgttaaatctgtagcggtcgtcgtaacctgtaacacctggtcc

SEQ ID NO: 210 - DNA, 2092 bp, Setaria italica
cctagaacccaaactcgaagcccccgatccagatccaaggccaggcgatggcacgcctcggcgcgctcctcctcgtcgccgtcgcggcggcggcggcgctgctctgcgcgctgccgggcgcccggggattctacctcccggggagctacccgcacaagtacaaccccggtgagccgctcagcgtcaaggtgaactccctcacctccatcgacaccgagatgcccttcagctactacagcctccccttctgcgtcccgccggagggcgtcaaggacagcgccgagaacctcggcgagctcctcatgggcgaccgcatcgagaactcgccctaccgcttcaagatgtacaccaacgagtccgacgtcttcctctgccgctccgccccgctcgcccccgacgccttcgccctgctcaagaagcgcatcgacgagatgtaccaggtcaacctcatcctcgacaacctccccgccatccgctacaccaagaaggacgactacttcctgcgctggaccgggtaccccgtcgggatccgcgtcggcgtcgactactacgtcttcaaccacctccagttcaccgtcctcgttcacaagtacgaggacgccaatgtcgcgcgcgtcatgggcgccgccgacgccacagacgccatccccgccgggggcaaggacgggggctcctcctctggctggatggtggtcggcttcgaggtcgtgccgtgcagcatcaagcacaacccggaggacgtcaagtcgaccaagatgtacgaccgctaccccagcaagatcaagtgcgacccgaccaccgtgtccatgagcatcaaggagaacgagcccattgtctacacttatgaggtgtccttcgtcgagagcgacatcaagtggccgtcgaggtgggatgcctacctcaagatggagggggccaaggtgcactggttctccattctcaactccctgatggtgattgccttccttgctggtattgtgtttgtcatactgttgaggactgtgaggcgtgatctgaccaagtatgaggagctcgatagcgaggcgcaggcacagatgaatgaggagctgtctgggtggaagcttgtggtcagtgatgtattccgtgcaccaagcaacccaatgctgctctgtgtcatggttggggatggcgttcagatccttgggatggcggtcgtgaccattctgtttgctgcacttggtttcatgtcccctgcctcgcgtggtaccctgatcacaggcatgcttttcttctatctggtcctcggaatcctggctggatatgctggtgttcgtgtatggaagacgatcaagtgcggggatcactctgggtgggtgggtgtttcgtggcgggtggcctgcttcttccccggcattgccttcctgatcttgaccacactcaacttcctgctgtggggaagccaaagcaccggtgccatccccttctcattgttcgttgtgctgcttctgctctggttctgcatctctgtgccgctcacgcttgttggtggattccttggtgcgaaggcaccacacatcgagtaccctgtccgcacgaaccagatcccccgtgagatccctcctcagaggtacccatcctggttgttggttcttggtgctggcacactgcccttcggcaccctattcattgagctcttcttcatcatgtcgagcatatggatggggcgtgtgtactatgttttcggattcctcttcatcgtcttgctgctcctggttattgtctgcgccgaggtttcactggttcttacttacatgcacctgtgcgttgaggattggaagtggtggtggaaatctttcttctcatctggatcggtggcaatatacattttcttgtactcgatcaactatctcgtttttgacctcaaaagcctgagtggaccagtgtctgcgaccctctacattgggtactcactcttcatggtgattgctattatgctggcaactggaacggttgggtttatttcttcattctgctttgtccactatcttttctcatcggtgaaagcagactgagtttattcctactgaggagtcaatcactcaattgagaggtgagcataatggacattgaa

SEQ ID NO: 211 - DNA, 1021 bp, Zea mays
actctcacatcaaaggcggaggtgagctccttcggctctgcgcctttgcagttgcggataacggggaggaggcggagcgaccaacggcacaggcaccatggcgatgcgagcagctacagcggcggcgacaggcttcttctctccatccaccgtccctccgaggcgcttctcgtccgttacaccgccggcgtcactctgcaccgcgcgctgcatccagcgtcaccgtctccgcgccttcccaagcttggaaatacctctagaggaactcaacccatccgtcgatctacttaggagaactgcggaggccgttggcgatttcaggaaaacgccaatctatattgttggtacggattgcacagccaagcgcaacatcgccaagctgcttgcgaattccataatataccgctacctcagcagtgaggaactgcttgaggatgttcttggtggcaaggacgccctcagagccttcaaggaatctgatgagaagggttatcttgaagtcgagaccgaagggttaaagcagctcacgtccatgggtagccttgtactgtgctgtggagatggcgccgttatgaactcaaccaatctagggctgctgaggcatggtgtctccatttggattgatgttcctcttgaaatggcagcaaatgacatgttgaagagcacgggaacacaagctactacagatccagactctttttctcaggcgatgagcaagctccgtcagcggtatgatgaactgaaagagcgctatggggtttctgatattactgtttcagtacaaaatgtggcttctcagcgggggtacagtagcattgacttggtgacgcttgaggacatggtccttgaaatcgtgaggcaaatcgagaagctgatccgtgcaaaggagatgatggaagctgcagggaagccattctaaacaagatacacatacacaatagttctgctccggcatacctattttctggccagttaccagacctccgatgcttcgctgttcaagaaaccgattgcagtttag

SEQ ID NO: 212 - DNA, 1218 bp, Zea mays
agaaaggacagaaccctgagccggaacaaaatggcggcgctcataaaccctatataccgccgactcgccgccttcgcctgccgccggatctctgcaccggcggtagagaagcccgtgctgcccctcgtgtatcaccggaacttgcagcaaagacacaattccagtttggtggatgcgagtggaggattcagcgagatgcttgcctctacacggaggtgctatgtatttggaggcaaaggtggtgtggggaaaacaagcatggcggcgtcgcttgctgtgaagtttgccaaccatggtgaaccaacagctattgtttcgacggaaccatctccgtcactcggtgatttatttgaacaagacatgggtgttggcggcaaaactgtacgcatcactggatttgactctctttttgcagttgaggctggtcagttcaagataaagggagaacctgaagatcttggatcttttatcaacaatttacttggaaagatggggcttggaacacattctgatattatgtctatgattagagagatgctggatggaatgccccctggacttgaagaagcgcttgtactatcaaaggtgataaaatctattgacgtgcaagaggccgatatacttcggcgtttagtgctggatgctccatccactggacatacacttaagcttctgtcagcttctgattggattgaaatgttccttactttgagcattaagggcataaaagtggcttcgtccatgccatcgtttaatatgtatcttgaggacgtgcaattcatctctgccaggctagaggaactaaggcagcaggttcgcagagtgcgtgagattttgtttgatccacaatcaacagaattcatcgtcgtgacaattccaacgatgatggcagttactgagtcatcaaggtttcacgagtcattaaagaaggatggtgcacacacaagaaggctcgtcataaatcaggtgttgccaccgtctgcgtcggactgcagattctgtgctgcaaaacggagggaagaagcacgtgccttccgtgcgatactggaggaccgagaactcggcggcctgaagctgatccaggctccgctccttgatatggaggtgaaaggcgtccctgcactccgattcctcagcgattcagtgtggaagtagcgagaaacactaggtcaaataaaagattaatctctatcggtctgttcggattctttcatttgg

SEQ ID NO: 213 - DNA, 1129 bp, Zea mays
ctaccgttccattccaattccatccccggaaagcgcaagccgcgggagagcggccggcgtacgtaccacgaggaccgccagcccagggccatggccgccggtctgtccggcgccgcgatgaccggcttcgtcgccaagaacccgctgctggcggccgcggcgcgccgcagggcgctgcctcccctcgccgggcgcgccctgccgttctcgccgctcaccaccgccagggccccgcgccgccgcgggctcggtaccgtcacgtgcttcgtgccgcaggacacagagcacccggcggcggcaccggccccggtcgctcccgtgccggagacggcgctggacgaggaggccagggccgcggcggcgcggcgcgtcgcggagaggaaggcgcggaagcggtccgagcggcgcacctacctggtggccgccgtgatgtccagcctcggggtcacgtccatggccgtcgccgccgtgtactatcgcttcagctggcaaatggagggcggcgcggtgccggtgagcgagatgttcggcacgtttgcgctctccgtcggcgcggcggtcgggatggagttttgggcgcggtgggcgcaccgggcgctgtggcacgcctccctgtggcacatgcacgagtcgcaccaccggccgcgcgagggcccattcgagctcaacgacgtgttcgccatcgtcaacgccgtgccggccatctccctcctcgcctacggcttcttccaccgcggcctcgtgcccggcctatgcttcggcgcgggcctcgggattacgctgttcggcatggcctacatgttcgtccacgacggcctggtccaccgccgctttccggtcggccccatcgccaacgtgccctacttccgccgagtggctgccgctcacaagatacaccacatggacaagtttgagggcgtcccgtatgggctcttcctgggaccaaaggagctggaggaggtcggtggcctggacgagctggaaaaggagctcgcgcgaatcggccggaccatctgatggattcgtccggattccggcgcggcgatctccgctccgctccgtgattccggcgcagcctcattgtcggtggggagcccacgaccagaacctccagaatagggtactttgg

SEQ ID NO: 214 - DNA, 1756 bp, Zea mays
tatcgtctcgtctcctcggaccacccagtgggcacggcacgccagttgccgacgcgcctcctgccacgggcgctcccgcgggatttcagttaccggccgcttcgtccccggagccagccagccagccaggcggcggcaatgctgctgggctcgcccgtgaagcgcctgctgcggcgggcggccaagcggcggctggagaaggccgagctggcgtggctggccgccgcggcgctgctgctgctgctgctcctcctcctcggcgccgcctcgctccgctgctcggccgccgcgctggtggccgcgcacgggaggctgtgggccggcggggtctccatcgcggcatcggcggacgcggacgcggaccaccggcccgtctccgcgcctcgtgctgcggcggcggggagtggtggcggcggtgaggccgccgccgccgccgacgacgaggaggaggaggagtgcgacctgttcgacggggagtgggtctgggccggcgccggcgccggcggcgggtacccgctctaccactccagcgactgcccgttcctcgacgtcggcttccgctgcgccgagaacggccgacccgacgcgtcctacaccaagtggcgctggcagccgtcgcgctgccatctcccccgatttgatgccaaaggcatgctggagaagctacggaacaaaagagtggtttttgtcggtgattcaattggaaggaaccaatgggagtctctactttgcatgctctctagcgctgttcataacaagagctctatctatgaagttaatgggagtcccatcacaaagcacatgggtttcttgattttcaactttagtgactacaattgcacggtggaatactacagatccccttttatagtccttcaaggccgtgcgccagcaggagcccctgagattgttaggtacagtattcgagtggatgcaatggattggatgtctgaccgcggcaagtggaaggatgctgatgtattgatcttcaacactgggcattggtggaacaatgagaaaacaatcagagggggtgcctactttcaagtaggagatgaggtcaaaatgggcatgaatgttgcagatgcttacagaagatcgatacagacattgtccgattggcttcgcaaagaagttaacccaagcaagactcatgtcatctaccgcacatatgctcctgtgcatttcagaggtggtgactggaagaccggtgggagctgccacttagaaactcttccagatgtgatgccagtgaagtccctggacgaatgggccgacttgcttcagcccgtggacgatttcctagggagcaacctcagatccaagctggctggattagacctgcttaacgtgacgagaatgacggcgcagagaaaagacggccacctctcagtatacctgagcccctcaggacctgtgccccgctacaaacaggattgcagccactggtgcctgcccggagtccctgatgcctggaacgagcttctctacgcccttgtcatgaggaggcataagaagatgggtcagaatgcttcccttgctggcgctaggacacccaacactgaagagggagatggagatgtcttcagccgaccatcatgacaaaacgagcttcatagccatcctgggcgatgggttgggacacaccagttagtataggatgccagagtggcgaaacacaattttggaccatgggtgttgtttgcaggaagctgcgtaccgccctgttgtgtgctgtgtttgcatatggtgaggt

SEQ ID NO: 215 - DNA, 2021 bp, Zea mays
cgcacctccatctgttctatatcgccccattgctcgctcgctcgccaagagttcttcttgttaggcaaggcaaaagcagaagcaaaaaaagaaaggaaaaagaaaggtcttgttgccgatggggagctcagggttctcgtggacgcttccggaccaccccaagctccccaaggggaaaccggtggctgtcgtcgtgctggacggatggggcgaggccaaccccgaccagtacaactgcatccatgtcgctcagactcctgtcatggactcgctaaagaatggcgctcctgagaaatggagactagtgaaggctcatggaacagctgtgggcctcccatctgatgatgacatgggcaacagtgaagttggtcacaatgcacttggtgctggtcgaattttcgcccaaggtgctaagcttgtcgatcaagctcttgcctccggaaagatttatgatggagatgggttcaactacatcaaagaatcttttgaaagtggtactcttcaccttattgggttgttgagtgatggtggtgtccactcccgtcttgatcaactgcagttacttctgaaaggtgtcagtgagagaggggcgaaaaaaatccgtgtgcacatccttactgatggacgtgatgttttggatggaagcagtattggtttcgtggagaccctagagaatgatcttttggagcttagagcgaagggtgttgatgcacaaattgcatctggtggtggaaggatgtatgttacgatggaccgttatgagaatgactgggatgtggttaaacgtggttgggatgcccaagtgcttggagaagcaccctacaaattcaaaagtgcacttgaggctgtgaaaacactgagagcacagcccaaagccaatgatcagtacttgcccccatttgtgatagttgatgacagtggcaatgctgttgggcctgtattagatggtgatgcagttgtcactatcaacttccgagctgatcgcatggttatgcttgcgaaagcactagagtatgcagattttgacaactttgaccgtgttcgtgtccccaaaatccgatatgctgggatgcttcagtatgatggtgagttgaagcttccaagccgttaccttgtttccccaccagagatagatagaacatctggggagtacttggtgaagaatggcatccgcacctttgcttgcagtgagacagttaaatttggccatgtcacatttttctggaacggtaaccgttcgggatactttgatgcaactaaggaggagtatgtagaagtacctagtgacagtggtattacattcaatgttgcacccaatatgaaggcgcttgaaattgctgagaaagccagggatgctctcctaagtggaaagtttgaccaggtacgtgtcaacctgccaaatggtgacatggttggtcacactggtgatattgaggccaccgtagttgcttgcaaggcagctgatgaagctgttaagattattttggatgctgtcgagcaagttggtggtatttaccttgttaccgccgatcatggcaatgctgaggatatggtgaaaaggaacaagtctggcaagccgttgctcgacaagaatgaccgtatccagattcttacctcgcatacccttcagccggtcccggttgccattggaggccctggccttcaccctggagtgaaattccggaacgacatccaaacccctgggctcgccaacgtagccgcaaccgtgatgaacctccacggatttgaggctcctgctgactacgagcaaaccctcattgaagtggctgacaactaaacactggccacctgtgtccaattttggttatatgtagttctgagaatggacattcaataatttatgtttgcaagcacgttgctcaaactcaccaaaacatcgagggatgccttttgactttggcatttacagcattggctttaatccttatcggtttctattgcttctgtttcatttctatgtatcatagctgcagtagttcgaacaactgtctttgcacaac

SEQ ID NO: 216 - DNA, 862 bp, Oryza sativa
caagagtacgcagaggctgagctgagccaggacgacgtacgacgacgacgactatggcggcggcggcgttgctgttggcgccagtggcggcgccatggtcgcgtgtaccgtctgcagggaggagggttcggtgcgcggcgactgcgccggcgccgatgggggagaagacggagtaccgggacgggccggtggagcgcgccttcatggggctgttcgcgcgcaagatggagaagtacgccgtcgtctccagctccggcgggaaggggaaggagaagaagaaggagaagagctcgaggtcggtgtgggagtgggactacgagagcttcgtggacgtgtcgcggcgggtgatggtggggcggacgcgggcgcagcagcaggaggccgtccgcgaggtgctcctctccatgctcccccccggcgcccccgagcagttcaagaagctcttcccgccgacgaggtgggcctgcgagttcaacgctgccctcaccgtccccttcttccactggctcgtcggcccatcagaggttgtggaggttgaggtcaatggggtgaagcagaagagtggagtgctgataaagaaatgcaggtacctggagaacagcggctgcgtcggaatgtgcgtcaacatgtgcaaaattccgacgcaaaacttcttcaccaacgagttcggactccctctcaccatgaatccaaattttgaagatatgagctgtgaaatgatttacggccaagtgcccccacccttggaagaagacccagcatcaaaacagccctgctatgccaatctatgttccatctcaacaccctcagcgccaatttgtcccaaacttcagacttagagcacatcacatcaatgctgaat

SEQ ID NO: 217 - DNA, 1181 bp, Glycine max
aaggaatggagagggcagaacaaattggaggaggcaaagctgtggccacagtcctagccattggcacagcaaatccacccaatttcatccttcaggaggattatcctgacttctactttcgggtcaccaatagcgaccatttgcaccgcttgaagcaaaagttcaagcgcatttgcgagaattcaaagatagaaaagcgacacatagtccacacggaagaatacctaaagcagaactcagacagcggcacgtacgatggccttcccttggagacacgacagaatgtccccacggaacaggtaataaaattaggtatggaagcagcatcaaaggccattaaggaatggggcgaacccttatcagaaatcacacacctcatcttctacaccacttcttgcttcggctccgttcccggtcctgaccactacctctccaaacaacttggactccgctcaacggtcaaccgcctcatgctcttcagccacggttgccacgctggcggcaccattctccgcgttgccaaagatatcgcggagaacaaccctggctcacgtgttcttgccgtctgttccgagaccatgtttgcctcgtttcgcgctcctagcgaatccaacgttgaggttctcgtaggacaggctctgttcggagacggtgccgccgccgtcatcattggcgcggatcctaagcactccatcgagcatccactcttcgaactcgtgttggcttctcaaaccactgtgcctgacaccgagaatgcgatcaaaggaagtcaacaagagaataggttggtttattatttggataaggacattcccaatattgtaactaacaatgtgaagaagtgtttggttgatgagttgggtgaagttggtttcgtcgacgaaattgattggaacaagtttttctatgcaattcatccgggtggggctgttattgtgagtggggttgaagagaagctagggttagagaaagagaagctgagtgcgacatggcacgtgctgagccaacacgggaacatgtggagtccaactgtgatttttatcttggatgagatgaggaacaggtccaagactgaggggaagagcacaaccggtgaagggttagagtgggggattttattagggtttggtcctggtgtggcaatggaaactgtgcttttacgtagttatccatgttgatga

SEQ ID NO: 218 - DNA, 1539 bp, Triticum aestivum
cttagatcagcacagagcgagggtcgattagcagctgatcggcagatcatgggcgtggagggctgctgcaacaagaaggtgatggaggaggaggccctggtgaagaagatcaccggcctcgccgcggccatcggcgagctgccctcgctgagcccctcgccggcggtgaacgcgctcttcaccgagctggtgacgtcctgcatcccggcgagcaccgtcgacgtcgacgcgctgggcccggaggcgcaggagatgcgcgcccgcctcatccgcctctgcgccgacgccgagggccacctggaggcgcactactccgacctcctcgccgcgcacgacaacccgctcgcccacctcaccctcttcccctacttcaacaactacatcaagctcagccagctggagcacggcctcctcgcccgccacgtcccgggcccggccccggcccgcgtcgccttcctcggctccggcccgctgccgctcagctccctcgtgctcgccgcgcgccacctccccgacgcctccttcgacaactacgacatctccggcgaggccaacgagcgcgccagccggctggtccgcaacgacgccgacgccggcgcgcgcatggcgttccgcacggcagacgtggccgacgtgacgaccgagctggcgggctacgacgtggtgttcctggcggcgctggtgggcatggcggccgaggagaaggcgcgcctggtggagcacctcgggaggcacatggcccccggcgcggcgctcgtggtgcggagcgcgcacggcgcgcgcgggttcctgtacccggtggtggaccccgaggagatccggcgaggcgggttcgaggtgctcaccgtgcaccacccggaggacgaggtgatcaactccgtcatcatcgcgcgcaaggcggcggcgccagcagccgtcgccgccgacggcgacgtgccggtgaacaacggcggcatgccggcccagtgcgcggtggcggtgagcagaccgtgcctgggctgcgcctgcgagctggggacgagggcgcaccagaagatgaaggagatggccatggaggagatggaggcgtaggccggccggcactccggcagacaccgtcaccgtcatcgcccagagcacggtgatgcatgaactcacccaccgattaatatttgcccgattaatcaccgaccgatacatatatgcatggtaataattggtttgtcctcatgcatggatggatggacgtggctacttatttaccataattattaatccttgcctgcgtatggctggctggattatttattttctaccgtaatcgtgccgtgtttgttttagcaatcgtctgacagctgctgcatgcctccgggtttaacatagaggaggaggatgatatgtgtcgtgttgtggtgtggtgagatcgagtcgagtcgagttgcctgcctgctagctgttgttgtaataagtgtttttgacactctatatgactcaagtgatccatcatcaccaagaagcagtgtaacaccgtaccgatgctttcctaattgattcccttgt

SEQ ID NO: 219 - DNA, 767 bp, Triticum aestivum
ttgacatggattaccaccagcagcagcagttcctgatgcccccgcccgcgtcgctgccggcgcagcagcagcagctgtgcgcgccgatgatgggcatggacatggagatggagatggaggagcagctgtgcttcgtggggaggggcggcgggggtcgtggggcggagaggaagcggcggttcacggaggagcagatacggtcgctggagtccatgttccacgcgcaccacgccaagctggagccccgggagaaggcggagctggcgcgcgagctgggcctgcagccgcgccaggtggccatctggttccagaacaagcgcgcgcggtggcgctccaagcagctggagcacgacttcgccgccctccgcgccgactacgacgccctccactcccgcgtcgagtcgctcaagcaagagaagctcgccctcgccgcacagttgcaggagctgagcgagaggctgagggagagggacggcggcggcggtggcgcggcgaccgccaccgccagcagcagcagctgcaacggaggcggccgggagctggacgacgacaagaggaacgtcgtcgacgtcgagccccccgagagctgcgtgctcggcgggacggcgtgcggcacgccggcggacgtctcggcgtcggtggagtccgagtgcgacgaccacctccactacgacggggcggtcttcccggagtccttctgcgccacgccggagctgtgggagccgtggccgtggccgcccgtcgagtggaacgcggtggcttgatga

SEQ ID NO: 220 - protein, 544 aa, Zea mays
MACNLAQCATAAAATVAPRTPRPAASASVSFSARKPAGGSLRLQRQACCEPSVAPSRAVFACRAAASGSAADLASGGRRSSGVPVFVMMPLDTVKECGTALHRRKAVQASLSALKSAGVEGVMVDVWWGIAERDGPGRYNFAGYAELMEMARKAGLKVQAVMSFHQCGGNVGDSVSIPLPRWAAEEMERDQDLCYTDQWGRRNYEYVSLGCDAMPVLKGRTPVECYTDFMRAFRDHFADYLGNTIVEIQVGMGPAGELRYPSYPESNGTWKFPGIGAFQCNDRYMRSRLKAAAEAAGKPEWGHGGPTDAGGYNNWPEDTVFFRGDNGGWSTEYGDFFLSWYSQMLLEHGDRILSGATSVFGAAPVEVSVKVAGIHWHYGSRSHAPELTAGYYNTRRHDGYLTIARLLARHGAVLNFTCVEMRDHEQPQEARCMPEALVRQVGAAARAAGVGLAGENALPRYDGTAHDQVVTTAAERAAEDRMVAFTYLRMGPDLFHPDNWRRFAAFVRRMNGAGSCREAAEREAHGVAQATGSLVHEAAVALRS

SEQ ID NO: 221 - protein, 135 aa, Unknown
  Sequence found in Organisms: Zea mays, Saccharum officinarum
MPFKRFVEIGRVALVNYGKEYGRLVVIVDVVDQNRALVDAPDMVRCQMNFKRLSLTDIKIDIKRVPKKTTLIKAMEEADVKSKWENSSWGKKLIVQKRRASLNDFDRFKVMLAKIKRGGAIRQELAKLKKVAAAA

SEQ ID NO: 222 - protein, 177 aa, Sorghum bicolor
MSAPNSDSNMQQLVPIAPPGKASGADSGKELVVADPGGKSSGGVKLREDEEDLEVKLRRIMENVPVRVSNTSGSSAGSGSGDFHQYRQMRRREQDRLARMDADYQKRKEMAEFELRREERIKAAEERTAKKRLKRQKKKQRKKEKRAKTGNNGGEDPNRVDSSDDDEGSDDDDKSKQ

SEQ ID NO: 223 - protein, 209 aa, Zea mays
MASSLARLGAALPRARPRAATRTLPPPRWDAAALGASRRAAPNVCRCLVHSDVKVAPTSDFKDSSKSETWRIKMLYDGDCPLCMREVNMLRERNKSYGAIKFVDISSKDYSPDDNQGLDYETSMGRIHAVLSDGTVVTDVEAFRKLYEEVGLGWVYAVTKYEPVASMANAVYGLWAKYRMQITGRPPLEEIMASRRAAGECKDDKVCKM

SEQ ID NO: 224 - protein, 170 aa, Hordeum vulgare
MLASPALAGATHSFLAFVSGSRSIHLPSASAPSHSPSRRAALVVLAKAKVSTPNADRIARHDRLRKKVSGTTERPRLSVFRSNKHLYAQVIDDTKSCTLASASTMHKSLSKELEYSAGPTTEVAQKIGEVIAKSCLEKGITKVVFDRGGFLYHGRIKALADAARENGLEF

SEQ ID NO: 225 - protein, 103 aa, Hordeum vulgare
MSTVTRAYLDQRLAAAKRCSREAAMAGAKAAAVATVAAAVPTLASVRMLPWAKAHLNPAGQALIISTVAGMAYFIVADKTIVSMARKHSFDNAPPHLKNTSFH

SEQ ID NO: 226 - protein, 565 aa, Hordeum vulgare
MSKAFTKSLLLYNKILVRRLKSLIPRAPPAPTSATERLPPSHRRESSTAPLGALPAPGTTDDGNNIGGGAGGGTIVCEVEGGLLMSSSTFPYFMLVALEAGGLLRGLLLLLLYPLLRLLPDELAMKAMAMVTFAGLRKDAFGRLGMAVMPKLFLQDVSAEVFHAATSAPTAAAGGARRRRRCVCVSGMPRAMVEPFLKEYLAIDAVVAPELRELGGYYLGLLEDEGEAVRRMDVEEVIGAKGGAVVGIGGLRCSFQHIFQKYCKEVYVPTESTRRRRGALHPRRYPKPLVFHDGRTAFRPTPAATLAMFAWLPLGAPLALLRAAVFLLLPFSLSVPLLAALGMHNRMIASSPPKYAGVDKSKSKSNLFACNHRSLLDPLCVSAAAGRRDLAAATYSISRLSEMLAPIPTFRLTRDRAADRAAMQAQLARRGGRGGLVVCPEGTTCREPFLLRFSPLFAELAAGGVDVVPVALHLAVDMFHGTTAGGRKMLDPLYLLMNPVPSYLVQFLDPVECGGQEARAVANEVQRRVAEALGYERTGLTRRDKYLILAGNEGVVGAHDGGMKN

SEQ ID NO: 227 - protein, 417 aa, Hordeum vulgare
MQMTAAKTDVPAAAAPHPHPHAHGPQVPHGHGHPHPHHHMPQPRWVVLPYPPPPPMVAAPPPPTPQYVKHFAPQASVTPPPPPAGSGGNGGDENRTIWVGDLQYWMDENYLHSCFGPSGEVVTIKVIRNRHSGVSEGYGFVEFYSHASAEKALQNFAGHVMPNTDRAFKLNWASYSVGEKRSELASDHSIFVGDLAVDVTDDMLMELFANKYRSVKGAKVIIDANTGRSRGYGFVRFGDDIDRTHAMTEMNGMYCSTRPIRIGPATPRRTSGDSGTSPTTQSDGDSTNRTVYVGGLDPNVSEDELRKTFAKYGDVASVKIPVGKQCGFVQFINRADAEEALQGLSGSTIGKQAVRLSWGRSPASKQSRGDSGHRRNGMYYGMPFYGGYGYASPVPHPNVYAAAYGAYPFYGNQQLVS

SEQ ID NO: 228 - protein, 661 aa, Hordeum vulgare
MPPRRSKGGAGGQPDSEASDAEPVETAVDATSEDEADDGNSNEDSAESGADDTDGEASKEEAADTKAEEMDAEHEEEAGATKAEEMVAEPEANGADAGTKVEAAEATVEEEAAQSDSERKAGAREADPEAEAEETDGENEEQAARTDGGSGEEAAGTVGEDEEEAAGTDGDNAAEVGGENVDADSEAEGEGTDAEPDALEESPPPSPPARSRRRKRVVKPDPPTEDDEEEETPLPSRRRRRRKAGERGDSPPPLPDNLRCRRSDGKKWRCSARALPTVSFCEYHYAKASKGKKPPADGEVLAVALQRQKKNKRKGRKRLNLAPESPKATRDLPNGLMTISPGSSGPLGSPVTTKVGVDIPAPLRRCYRSKNAEPVPVGPVKVVPHAMSKAKAAQMSCHRCGLKKVARVVKCKNCENKYFCNSCINKWYSGMSRNDIKIQCPVCRGCCDCKKCTLGQTKGGMRKESPGGQGKLIRIKICNHQFYKLLPLKLDQEQLDELEIEAKIQGTKLSNVRVQVAEDDQSGSLYCNNCKLSVHQALRSCPRCPFKLCLSCCQKIREGSMSGSTPEDKFTQRLLQQESAHEDGSISCPSIELGGCGDSLLNLIYTSPSDDQSGELSSGDELDAPGNDSGVKDAQDHSSPLAESNGSLARLSGGQQESMST

SEQ ID NO: 229 - protein, 339 aa, Hordeum vulgare
MAASVATSPACSRLIPSRPLSASASAAAPSLVRLAGSSRRLRRALRVSAAAEPADALPGPGAGDLDGVVPAGLLEDLPEGLAFQGDVGGGFAPGGGGDDGNKMLDRGINAAIVLGASTYALTKLLTVDQDYWHGWTIFEILRYMPEHNWSAYEEALKANPVLAKMMISGVVYSLGDWIAQCYEGKPIFEFDRTRMFRSGLVGFTLHGSLSHYYYHFCESLFPFKDWWAVPVKVAFDQTAWSALWNSIYFVALGFLRWESPFTIFSELKATFFPMLTAGWKLWPFAHLITYGVVPIEQRLLWVDCVELIWVTILSTYSNEKSEARILDDSSTTDTQDNSR

SEQ ID NO: 230 - protein, 171 aa, Hordeum vulgare
MDAIRLSLLMVAVMAVLSTASAAIYNVGEPGGAWDLSTNYDTWASSRKFQPGDQIVFKYSPQAHDVLEVSKADYDSCSTANPIATLNTGNDIVTLTATGTRYFICGFPGHCTGGMKVKIDVVPASSSSSPAPASGPSASNAPPPTPVSTANSVEATGFGLAVLLAFAGIMA

SEQ ID NO: 231 - protein, 336 aa, Hordeum vulgare
MAAASEESVKQFSALMEQLEEPLKTTFQNVHQGYPRGTLLRFLKAREWNVPKAYKMLMDCLNWRLQNEIDSVLAKPILPADLYRSIRDTLLVGLTGYSKQGQPVYAFGVGLSTFDRASVNYYLQSHIQMNEYRDRVVLPGASERSGRQINTCLKVMDMTGLKLSALNQIKMLSTITAVDDLNYPEKTETYYIVNAPYVFSACWKVVKPLLQERTKKKIKVLYGPGRDELLKVMDYASLPHFCKREGSGSGSSSDEVDCYSYDHPFHQQLYNYVKQQAARNQEDGAGPVKQGSMHVRVPTPDLEEAKIMETIQSELHSLKGGDGISRSFNRITIEGP

SEQ ID NO: 232 - protein, 735 aa, Hordeum vulgare
MDYSTSLLRLTFLALGAALILLVTRSAFRLPLAIDAPAASFLHGSGGCTRFSPWACRPPRTGKSPPRRSSHESDVPRHPLDPLTVTEISRARELLRAHPPFASAPSALVVHALALDEPDKPAVRRWRKGAHALPPRRAVAVVRFRGESHVLALDLATGSVTPLPTPASGYPTMTMDEMTALCAAPFSDPAFNATILRRGVRLADVACLPISPGWYGPAEDDGGRRFIKSQCYSTEGTANFYMRPIEGLTVLIDMDTGKVVHISDRGAGIPIPAAKNTEYRHAANDDADDKFGYQTVRAPSMEPAPEGPGFEVSDGHTVRWAGWEFHLKADARAGLIVSRATVQDPATGARREVMYKGMASELFVPYMDPTEAWYFKTYMDAGEYGFGLQAMPLVPLNDCPRHARYMDGVFVAADGRPYVREKMICVFERYAGDIAWRHSESPITGMDIRESRAKVTLVARMAASVANYDYIVDWEFQTDGLIRIKVGLSGILMVKGSPYSHMNQVRKNEEMHGTLLSENIIGVIHDHYVTFRLDMDVDGADNSFVRVDMARQDTAPGESPRRSYLKATRHVASTEKDAKVRLKLYEPAEFHVINPTKKTRVGNPVGYKVVPAGTAASLLDPEDPPQKRGAFTNNQIWVTPYNKSEEWAGGLFVYQSKGEDTLATWSERDRPIENKDLVLWYTLGFHHIPCQEDFPIMPTVSSSFDLKPVNFFESNPILKQRPTMEKDLPVCVATA

SEQ ID NO: 233 - protein, 110 aa, Hordeum vulgare
MAPTKKSKKSTENINNKLQLVMKSGKYTLGYKTVLKTLRSSKGKLIILANNCPPLRKSEIEYYAMLAKISVHHFHGNNVDLGTACGKYYRVCCLSILDPGDSDIITTVPQ

SEQ ID NO: 234 - protein, 372 aa, Hordeum vulgare
MVTKVVDLRSDTVTKPSEAMRAAMAAAEVDDDVLGADPTAQRFEAEMARIMGKEAALFVPSGTMGNLVSVLAHCDTRGSEVILGDNSHIHIYENGGISTLGGVHPKTVPNNPDGTMDVHKIVAAIRHRDGAMYYPTTRLICLENTHGNSGGKCISVEYTDKVGEVAKTHGLKLHIDGARIFNASVALGVPVHRLVRAADSVSVCLSKGLGAPVGSVIVGSKAFIYKAKILRKTLGGGMRQVGILCAAAYVAVRDTVGKLADDHRKAKVLADGLKKIKQFTVDLASVETNMVFFDIADPRITPDKLCQVLEQRNVLAMPASSKSVRLVTHYQISDSDVQYTLTCIEKAVEEILSGNAKFEHLTNGTTTNSYGH

SEQ ID NO: 235 - protein, 361 aa, Hordeum vulgare
MAGNTLAAARFSAAVTLLRTRRSPVVAVPLAPSGLRHHRRSVGMAAGAAPSPIPASDPLPKGSDLFLRSVLSNMQKVYLSRNPTAEKILDLVHSYDGDNICFDHFAFRTFGVDGYGINSLAEFFTDFGYESREELRFPAKKLRALWFSPPNNDGYSRTGIYGPLPRIFISELLVDELSAPSQEIIRKYIKTSANGNKYAVLASTFGELTWEKPTYSDFQVLSRESEYAGWTLVNGYALNHATVSTHRLESDIRSISKFNKFVENNGFKLSTEGGILKVSPDGLLQQSSTVADSSLFTFADGITEPIPRSYIEFAERLPLPQFRDLQDEEVKEHHRRDGFEVGNADKIFESTSKDQLTRRSA

SEQ ID NO: 236 - protein, 508 aa, Hordeum vulgare
MDYERIEKPSFPTQGGGFSPKRLRAMLLGVERRRKDDGVEGRQQEEEEEEEYGAVPMASVRSDDDARRGGSVCEEYKDVDVVSTMSGSSSSLDTGSGHRSRDSHSMGSRFRVPEEDSCDSESVASNFEFHKERGASARSAPTAVVAPFSKPPPSKWDDAQKWIASPATNRPGRAGGAFPRKMEKTGFGGGRLPPTKVVLEAMEEIDTKRIDPSQEKREIGWQKAANWATPEPYPEVEPCAKSAPGAESTIIDSAVTLSCDSSTTLHSATACIPPPPTGRSVSMRDMGTEMTPIASQEPSRTGTPVRATSPDCSRPTTPRRTLGINAAGGVINRGECSNADLSEEELQMKTRREIMLLGTQLGKTSIAAWASKKEEEKDASLSLKTVSSDQSAQNATEIRAAAWEEAEKAKYLARFKREEIKIHAWEDHQKAKIEAEMRKIEVEVERMRARAQDKLMSKLASTRHTADEQRAAAESKRDQSAARTAEQAEHIRRTGRMPPSLGCWNWCS

SEQ ID NO: 237 - protein, 157 aa, Unknown
  Sequence found in Organisms: Hordeum vulgare, Triticum aestivum
MAFAAIHARLAVFPPRLSAAASSLRSAPPRARLPQLRTSAGYRCLRSPRCRRPCRARASCISITASLDLAEDNVRQAIVDAKAELAQLFDTSVGITGQVDLAELDGPFVKLRLKGKFWHTRATVAARIGNYLKNRIPEILEVEIEDEDQLDDSPAAY

SEQ ID NO: 238 - protein, 453 aa, Hordeum vulgare
MMSNDHNKFEHPNRLHLSPSNFTNHPCEGFAVPPILFDKKRTGPRPCPVCYVSVDQAFALMPLQASPSPVLENLKYALEDSVTANFSNPGSAFGGHLSLEQRNKSFDITDSMTVHCGFVRGKKPGQGTGFDISDDDLLEMEQCRELVVASAIFGNYDMIQHPRNVSELSKANACFYMFVDEETMAYVKNSSSLYKDNKVGLWRLVVVRNLPYEDPRRTGKIPKLLLHRLFPNVRFSVWIDAKLQLVVDPYLLLERFLWRKDSSFAISRHYRRFGVYEEAEANKAAGKYDNASIDEQIDFYRNEGLTHYSPAKLPITSDVPEGCVIIREHVPISNLFTCLWFNEVDRFTARDQISFSTVRDKIRSKVGWMPQMFLDCERRNFVVQAYHRELLEQMIASGRNTPPTAVEPSRKIRPGGSRRAPPSKKPVVKRKKEKKSSSRRRVPKPVTWAMDAV

SEQ ID NO: 239 - protein, 404 aa, Hordeum vulgare
MTLSPHTLCPPLLPPLPPSSNRRPPPPRSRPCPRILLPALAGRQSRVHLARPPRAGAGAGDGMASQDAHYPTLLEHMGRAGAPADLAVLVAHIQAACKRIAALVASPGNADLSRAKPAAAAGGASAAGRDAPKPLDELSNEIILSSLQSSGKVAVVASEENDHPVWMCDDGPYVVVTDPLDGSRNIEVSIPTGTIFGIYDRLVELDHLPVEEKAQLNSLQSGSRLVAAGYVLYSSATIFCISFGEGTHGFTLDRSTGEFVLTYPFMQIPPRGQIYSVNDARYFDWPEGLKKYIDTIRQGKGQNPKKYSTRYVCLLVADFHRTVIYGGVAMNPRDHLRLVYEANPLSFLAEQAGGRGSDGKTRILSIQPVKLHQRLPLFLGSMEDMLELESYGDVQQKVNPGYDV

SEQ ID NO: 240 - protein, 375 aa, Brachypodium distachyon
MSVASAAAVRSASGRRCGVGSGLNGGNKFLMMQRRDIVTKGIALSVCSSLLSSSNGDAQGLERLPFKADGYNFWTWRGRRIHYVEQGEGQPIVLVHGFGASAFHWRYNIPELAKKYKVYAVDLLGFGWSEKALVEYDATIWMEQVSDFLREVVKSPSVLVGNSLGGFTTLFTATELPELVRGLVLLNSAGQFGDPNAPPPIEAEEEVGVLSRLLVRPIKEAFQRVVLGFLFWQAKQPARVEKVLKSVYKDPSNVDDYLISSITAPTADPNAGEVYYRLMSRFMANQSRYTLDRLLGKLSCPLLLLWGDLDPWVGPSKAARIKEFYKNSTVVNLQAGHCPHDEAPEQFNAALLQWLDTLEETGTGGKSAEPSLQAV

SEQ ID NO: 241 - protein, 317 aa, Brachypodium distachyon
MAASCTLAVSPAFAASCSPSSSSRRSRRFGVVAMASVGQKVYAPGVAVSEGNGGLPKIILKSPHGSEAEIYLFGACVTSWKVPNGKDLLFVRPDAVFNGQKPISGGIPHCFPQFGPGPMQQHGFARNVNWSVTDSEVNEGDPAVTLELKDDSYSRSMWDFSFQASYKVALHSTSLSTTLKITNTDDKPFSFNSALHTYFSASIAGVSVKGLKGSKTLNKDPDPKNPLEGKEERDEVTFPGFVDCVYLGAPSELILDNGLGDKIAISNENWSDAVLWNPHLQMEACYKDFVCVENAKIETVQLGPTQSWVAEQKIELI

SEQ ID NO: 242 - protein, 207 aa, Brachypodium distachyon
MAAEEAKKVEVEVTPEPEAPPAVPAAEPEAPAKDVTEEKAVIPAPAAEEEKPPVDDSKALVVVEKVADEKPADEKAAHGGSNDRDIALARVETEKRNSLIKAWEENEKTKAENKAAKKVSAILSWENTKKANIEAQLRKIEEQLEKKKAEYAEKMKNKAAMIHKEAEEKKAMVEAKRGEEVLKAEEMAAKYRATGNSPKKTMGCFGA

SEQ ID NO: 243 - protein, 227 aa, Brachypodium distachyon
MVRGKTELKRIENTTSRQVTFSKRRNGLLKKAFELSVLCDAEVALVVFSPRGRLYEFASSASLQKTIDRYKAYTKDNVNKKTAQQDIQQIRADTVGLAKKLEALEDSKRKILGENLGECTTQELHILEAKIEKSLHIIRAKKSQLLERQIAKLKEKETMLLKDNEELREKQQHLAALMVVPSLNHVALSPLQPEPEPEPSSDAIDTVETELYIGLPGRERSSNRQSG

SEQ ID NO: 244 - protein, 156 aa, Brachypodium distachyon
MEKKQMKMAIMRQEQTFRHQVNELHRVYQVQKQLMTEMHVVKMNRAQAGEDTQAEAMVETNHLQWYSNSGEKKPPPVEDFNLELTLATGNDRRKQDMASNSDSGATVSSSTSAESESGQRFPKSNVNVRFQNKSERHDDQHMQSPWLYQCLSLKMA

SEQ ID NO: 245 - protein, 1285 aa, Brachypodium distachyon
MEMALRAQSPLCSRSRPVLVVRPANAAAALAQPIVKCSRFTRSRLVRCMVASSDYPKRNPRRSSTPKPKGTASRGYAPRPAAESSTKKIEQSSTDEGDLARSNVMLGSAGIEQTGTAEESSEVDLSGNVPSSEALEGVNETENEEEIDQKLPPALSSTSMDAESISEAADQTSTVEEASEVDFSGNVSSSTALEGVNEAEAEEKVDQKQTSALASTSMDVESIDRELEEYRGKISALVASNPGPSSLASNQGQDKPIFGVHEQDKSVINFHEQGISIVDVSKQSQLAVGVTEEDPTKQTTIIGEQDIAEEAVEDIDSKFFEDGQLALSEDDAGTSKYAQEEPSVAGDQLRISEDGHDEPEIQELVQKDVNLQVLKRRLEELANENYSIGYKCFVFPEIVKADSVIDLYLNRSITALASESTILIKGAFNGWRWNLFTEKMHRSELAGDWWCCKLHIPKQAYRLDFVFFNGDTVYENNNYNDFFIEIESDMDEHSFEDFLVHEKQRELERLAAEEAERERQAEEERRKEEERAIMEAYRAQAKAEVETMKNRLQHVLGSASRHMDNLWYIEPSTYKGGDRVRLYYNRNLRPLMHSNEIWLHGGYNNWTDALSIAERLVKSHEKDGDWWYANVTLPKSALVLDWVFADGPPGNARNYDNNGKRDFHAVVSKSISEDFFWVEEEHRIFKRFQRERKEREDADRRKAEITAKMKAEMKEKTMREFLLSQKHIVYTEPLEVRAGTTVDVLYNPSNTVLNGSPEVWFRCSFNRWTHPSGPLPPQKMVNAENGSHLQATVRVPLDAYMMDFVFSESEEGGTYDNRNGMDYHIPVSDSMAKEPPMHIVHIAVEMAPIAKVGGLGDVVTSLSRAIQDLGHKVEVIIPKYDCLNLSNVKDLHCCQSFTWSGTEIKVWFGKVEDISVYFLEPQNGMFWVGCVYGRNDESRFGFFCHSALEFLLQSGSSPDIIHCHDWSSAPVAWLYKQQYVHNGLPNGRVVFTIHNLEFGANQIGKAMAHCDKATTVSYTYSREVSRHGSIAPHYFKFHGIRNGIDSDIWDPYNDNFIPVHYTSDNVVEGKSSAKKALQEKLGLHQTDSPVVGIISRLTAQKGIHLIKHAIYRTLERNGQVVLLGSAPDHRIQSDFTNLARKLHGEFDGRVKLCLTYDEPLSHLIYAGADFILVPSIFEPCGLTQLTAMRYGSIPIVRKTGGLYDTVFDVDDDKERAREQGLEPNGFSFEGADINGVDYALDRAITTWYDARDWFHSLCKRVMEQDWSWNRPALDYMELYHSARKN

SEQ ID NO: 246 - protein, 159 aa, Brachypodium distachyon
MEALASSSPRLALFSRTATAANWASSSSLVRRSPAARVKAAAEPAGEAKPAAAAAATADGAPAPKKILKKKPVYSMKKGQIVRVEKEKYLNSINYLSVGHPPFYKGLDYIYEDRGEVLDIRVFETGEYALIAWVGIPTPPAWLPTYMLIKSDKLDYERM

SEQ ID NO: 247 - protein, 240 aa, Brachypodium distachyon
MADSAALSSSLPRSLASRRPLSSSSSSSPLRGCGGRSRSPRRCRFGSRLRARARKDDPEDPYGPYPWEQPLDLSSGFDIEWVQEDKITLFTSDGLVQIGGSLVPRRLSASEKRKQKAKGTHKFRRFQESSYMDPNQSLCLGSLFNIAATNGLDMGRRLCIFGFCRSIEMLSDVVEDTVLEHGGEVVIAEKASNDGLQEKLTMSVAVPLLWGVPPASETLHVAVRSGGGIVDKIYWQWDLF

SEQ ID NO: 248 - protein, 414 aa, Brachypodium distachyon
MEHGGGGAGSGGGGAAPSSSNSGGGGSGTSGSRGGGGDHHPHHPFYYAGPSVAAPNNNSNNVQQQQPQQFMGSLAITTAAVAADQAPANKEKAVAAPVTPSSSGAVAKRPSKDRHTKVDGRGRRIRMPALCAARVFQLTRELGHKSDGETIEWLLQQAEPAILAATGTGTIPANFSSLNITRASGSSASVSAAARAATPFPALALHPHAHHHHDMSTMLGYHHHHLIPPQPQPQQQEPPHDPNSSGGGGFMRKRYREDLFKEDDERQDPKAREQQQPAAMWAVAPNSAAPGGAFWMLPVSASQAAGARPTEQPMWSFGGSGGGGTSTVQAPLQFMSRVNYPTAAGMGGSPADTNIGMLAALNYSRGGTEDQQEQQHQQPEMEQQRGGNEGEEEEGGDDSGGEEDHGANNNNSSQ

SEQ ID NO: 249 - protein, 266 aa, Brachypodium distachyon
MANASLQSFLLQHHQSFHNNSTHEGPSSVILKLTSSTSISFKLFSSTSSSVSTASTANTSAPTPVAAAAATTSPPTPSLELLGQQLADGDYRQADETTRALLIHLAGEPARRRGYVFFSEVQFISVEDLRAIDMLWLEHSNRKFGYSVQRRLWEKSLRDYTRFFIKVGWMKKLDTEVEQFNYRAFPDEFIWELNDDTPEGHLPLTNALRGTRLLGNIFTHPAFECEEEEAAGEENETGTTTGQNKDDIKGRGRPKIITDFKPDYSF

SEQ ID NO: 250 - protein, 308 aa, Brachypodium distachyon
MAAPRAVPAFESLAGIRPLAESGRFKAWFLDQFGVLHDGKKPYPGAILALEKLAGFGAKMVIISNSSRRASVTMEKLGSLGFDTSCFLAAVTSGELTHQYLQKREDPWFAALGRKCVHLTWGSRGAISLEGLGLQVVSNVDDADFILAHGTEALGLPSGDPLPKSLGELEQVLVLGIQKRLPMVVANPDYVTVEARDLCVMPGTLAAKYESLGGEVKWMGKPDKVIYTSAMSLAGVETHECITVGDSLHHDIKGANGVGMASAFITGGIHASELGLGEFGETAGDDTVSTLCCKHSAYPSYVLPSFTW

SEQ ID NO: 251 - protein, 594 aa, Brachypodium distachyon
MKVIEKIQEAAANGRTVFSFEYFPPRTEEGVENLFERMDRMVAHGPNFCDITWGAGGSTADVTLDIANRMQNMVCVETMMHLTCTNMPVEKIDSALDTIKSNGIQNVLALRGDPPHGQDKFVQVAGGFSCALDLVQHIKAKYGDYFGITVAGYPEAHPEVILGEEGATEEAYSNDLAYLKRKVDAGADLIVTQLFYDTDMFLKFVNDCRQIGITCPIVPGIMPINNYKGFIRMTGFCKTKIPAEITAALDPIKDNEEAVKAYGIHLGTEMCKKILASGINTLHLYTLNMEKTALAILMNLGLIEESKLSRTLPWRPPTNVFRVKEDVRPIFWANRPKSYISRTLGWDQYPHGRWGDSRNPSYGALTDYQFTRPRGSGKKLQEEWAVPLKSVQDINERFMNLCQGKLTSSPWSELDGLQPETKIIDDQLVKINSKGFLTINSQPAVNAEKSDSPSVGWGGPGGYVYQKAYAEFFCAKDKLDQLVEKSKAFPSLTYIAVNKEGETFSNVPANAVNAVTWGVFPGKEVIQPTVVDSASFMVWKDEAFEIWSKGWACLFPEGDSSKELLEQVQKSYYLVSLVDNDYIHGDLFAAFKEI

SEQ ID NO: 252 - protein, 181 aa, Brachypodium distachyon
MAAATISLCGSRCLGPSLRPEARLGSPSPAQLLVERGSGRGRPSQRRPVAVAATEGSAKSSGEADEQVPSWARPGSDEPPPWARDEGGGGAGGRDPAAVQVPFYAYLLASAITAIAAIGSIFEYTNGRPVFGIVGVDSPLYAPILGFFAVTGVPTSAFLWYKAVQTANKDAEEQDRKDGFL

SEQ ID NO: 253 - protein, 588 aa, Brachypodium distachyon
MARILSRALPFASHSHLQFSPPIRGAALLSSAPLLPHLPAASTVSLLSWRGFTPTPEPSRSVPPFAGFLAGIRGFRRARRGQAAAKREQAQEDPAPPPPPKESEIELYARIGVDEDLPDDLEVLNIIEILKLNVPMAMKIALDGLLEYNYNTRDTSISDVGKYEKVEVSVLLGNDNFIQNLNKEWRGEDCATDMLSMSQYIPDLDVPILMLGDIAISVETAARQAEERGHTLLDELRTLVVRGLLHLLGFDRQASNEAAVEMEKEELLILKSLRWKGKGFAKSALDLSKPRTETSDGRATNGLKKAGSLRFYRPKFKYIFCDLDGTLLNSKSRVTARNAEALKEARSRGVNIVIATGKTRPAAIDVLNMVGLSGRNGFVSESSPGVFLQGLVVYGLEGQEIYKRNLDQEVCREALLYSLEHKVPLAAFSKDRSFSLFEDPSVDSLHYVYHEPKAEIVSSIDQLLGTAEIQKVLFLGTPEGISTTLRPYWEKAIGERAGVVQGQPDMLELVPPATSKGRGVKMLLDHLCISPDEVMAIGDGENDIEMLQLASLGVAMANGAEKTKAVANVIGATNDEDGVAQAIYDYAF

SEQ ID NO: 254 - protein, 415 aa, Brachypodium distachyon
MELYPGYLEDHFNIHKLSGAGTSPPEYMTSASAQFAPAPLRMGMYERPPPQQPMPPSPQPVVGMWNNSVDTYKVDSGQATSGSTIMEADTKFDDAELEEVPGMEELEPTRDVDQEASKPPDKVLRRLAQNREAARKSRLRKKAYIQQLETSRIKLAQLEQELQRTRQQQGLYPPGHSGMAGFGGVGGVPMDSGVAAFEIEYGHWVDEQNRHTRELRGALQPGQQTTELELRMLVETGLGNYDHLFRIKNLAASADVFCVMYGLWRSPAERFFLWIGGFRPSEVLKVLRPQLEPLTDQQLEQVYHLQQSSTQAEDALSQGMERLQQTLADALTAAADPFASPDGYSGMNDAIGKLKGLVCFLHQADHLRLETLQQMQKILTTRQAARGLLALGDYFERLRALSSLWAARPRESAIS

SEQ ID NO: 255 - protein, 374 aa, Setaria italica
METPLSTRRITRSLAAAAAASAQKSAAAGTDSAAQFSLAKNATAGEPQPRAALHDITNDSPIVGLAAGGLHGTDKTPASTAAKTRRRAPRRTPGSGEALLRGQVKALLHKVEEEQGCAPAALVRPARIQALLGVSRSPAQLLAPTPANTPQIGPVPAAREGLLMPDGVPVVPCVLEEEELLLPKLQIIAAPLPPPQPEENLGECQLNRALVFDDSPEKSSASNGSAVLFQESSTGSCNGKSSSPEDDSSSAWSIQVHASSEKGDEEELGVEDLGEYTEEEEEWEEDSDDEDCFDDLCEEMSRMTVVDEEERKAGLPQFEGRHTRFIYNSDDEIEREEVADAAEARAELGALMLRDLPVPEGRHLRFQEDEEDEE

SEQ ID NO: 256 - protein, 356 aa, Setaria italica
MDVEARKDAAPARGKAMRRLLVALNCGMLALGAIGGPLLSRLYFSKGGHRQWLSAWLETAGWPLLLVPVVAAYVARRARDRAAPALLTPPRILLAAVGLGVATGVDDFIYAYGLSYLPVSTSAILISTQLAFTVLFAFLIVRQRLTAASVNAVALLTVGAVVLGLHVSSDRPPGVTRGQYWLGFILTLGAAALYGLVLPLVELAYRRAAGGGRAVTYALVIEMQLVMGFFATAFCTVGMIVNKDFQAIPREAKHFELGEARYYTVLVWSAVLWQCFFLGAVGVIFCVHTLLAGILIAVFIPVTEVAAVIFLHEKFSSEKGVALVLSLWGLASYSYGEWSDSRAKKKAEAAAEGQAS

SEQ ID NO: 257 - protein, 789 aa, Setaria italica
MFWRMTGLSAASPVDTILDKENFTLEELLDEDEIIQECKALNSRLINFLRDKAQVEQLLRYVVEEVPEDNEKKRSFKFPFIACEIFTCEIDVVLRTLVEDEELMDLLFSFVKPDHPHSTLLSGYFSKVVICLMLRKTAPLMNYVQGHPEIVVQLVDLIGITSIMEVLIRLIGADENIYSNYGDTLQWLENTDVLEMIADKFSSSDSPEVHANAAEILCAVTRCAPPSLAAKICSPSFVGRLFHHAFEESRPKSVLVHSLSVCISLLDPKRLASASYQAFRSNLSHGALVTASPETVDGMLESLGNLLMLLDTSAAENVLPTTYGCLRPPLGKHRLKIVEFISVLLTIGSETAEKELIRQSAIKRSIDLFFEYPYNNFLHHHVENIIVSCLEGKRTELVEHVLNECDIVGKILVAERLSSLSTESNGPTIPSEEKAPPRIGNVGHMTRIANKLIQLGNSNSTIQAHLQENTEWVEWQTNVLVKRNEVENVYHWACGRPTSLHDRGRDSDDDDFRDRDYDVAALANNLSQAFRYGIYSNDDIEEAQGSLERDDEDVYFDDESAEVVISSLRLGDDQDGSSLFTNSNWFTFDGERGINDRISDSVPSSSPNSEEISLETEEADDGKVIGTEDEMETVCLGNGSTEEAKDVAECVEQLNCSTANEPLQNTDSLERHSDVSNGSTEVGTAAAAESSAPSVEIAAESSAPSVEIAAEKTADEPLMVERTVGEPAVSSDLDNSISEATPGANGSEPADPEVSSEQVGNDTDVQQPVKEVAGEDVDETKTDAVKASD

SEQ ID NO: 258 - protein, 222 aa, Setaria italica
MQPPLPLLRCLTASSSSALPLSVLVRKHKLGLLFSTAMDDGVSSQDKKTSPPPAGGVAERIMPHLLNIYGSRATARDFEIYAPNATFEDPLMRAHGVQQIKSSFYTLPKVFAESKIVEYTVHENPTGPGKAEILIDNKQHYKVLGKAVELTTLIRLQLQDGKVVTHEDWWDKKPLKNRDTVGFPLLGRVAEATRRGAMLLTHALMGFGKDPPAHPPPASSSS

SEQ ID NO: 259 - protein, 507 aa, Setaria italica
MNGRGSGGGGGGGEEEMEEDGGGGAGCAQGAGAGAENKERVVLMWGYLPGVSPQRSPLLGPVPVRLPPAAAAPGGDGWRDVCGGGCGFAMAISESGKLLTWGSADDMGQSYVTAGKHEETPEVFPLPSGVAMVRADAGWAHCVAITDEGDVYTWGWKECVPTGRVVGDQSSVGTMEKDERQIAMATDQVSPRSQVSRTSSGAASGPSESRGTDDSTKRRRLSSAKHGPESSTSSDESLSAPPCVVTFNTGVKIVAVAAGGRHTLALSDLGQVWGWGYGGEGQLGLGSRIRTVSSPHPVPCIESALYSKDRPSAMKGNKTAEGHISKVMGNCVKAIACGGRHSAVVTDSGALLTFGWGLYGQCGQGNTEDVLSPTCVSSILGIKMQDVAAGLWHTVCTSVDGDVYSFGGNQFGQLGTGSDQAETVPKLVDATSLENKNARSVSCGARHSAIITDEGEVFCWGWNKYGQLGLGDSMDRNVPCSVPVDTYHPLNVSCGWWHTLVLAESPT

SEQ ID NO: 260 - protein, 267 aa, Zea mays
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRYAMLGAVGAIAPEIFGKMGIIPPETALPWFKTGVIPPAGTYNYWADSYTLFVFNMALMGFAEHRRLQDWYNPGSMGKQYFLGLEKFLAGSGDPSYPGGPLFNPLGFGKTEKEMNELKLKEIKNGRLAMLAILGYFIQGLVTGVGPFQNLLDHLADPVNNNVLTSLKFH

SEQ ID NO: 261 - protein, 163 aa, Zea mays
MPHPAPLDVSRRKRKRSSDKAERHRSVSLLNSRSLARSKRKKLAFSMASLAFGSTVAAAVAATSGRTRPARRSVLVVPPAASRGGPAPAKEEKGLGETIFGFIFKKDQLVETDPLLNKVGAAPAAASRAKTTAGKKAAGGDDSGSGGGFNLGGLGGLFAKKSS

SEQ ID NO: 262 - protein, 94 aa, Unknown
  Sequence found in Organisms: Zea mays, Sorghum bicolor, Triticum aestivum
MGKGTGSFGKRRNKTHTLCIRCGRRSFHLQKSTCSSCGYPAARIRKYNWSVKAIRRKTTGTGRMRYMRHVPRRFKSNFREGTEAAPKKSAAAAN

SEQ ID NO: 263 - protein, 272 aa, Zea mays
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVILMGLVEGFRINGLDGVGEGNNLYPGGQYFDPLGLADDPVTFAELKVKEIKNGRLAMFSMFGFFVQAIVTGKGPLENLLDHLDDPVANNAWVYATKFAPGS

SEQ ID NO: 264 - protein, 219 aa, Zea mays
MVLGLYTFADIDADGAPRLEVADGEEFVRVDRVVELALGPRVLKAPGTLYLTTRRVIWVSDGGEGYAVDFVAISLHAVSRDPEAYPYPCIYTQIETEAISDEESDVSDSETNGELELSKVMEMRIIPSDPGQLDELFEAFCNCAELNPDPSAESDEEHGWVHGDEGYEDTVDGSDTEFSDVNPIGQTGEQDINHAVIELQINDQRFEDAVDEESHRNGN

SEQ ID NO: 265 - protein, 295 aa, Zea mays
MSPPSVMGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGARNFRVMKSFNQQAGIQGGLGAAFPSHATFPHYAIPQGLPFHVYGYSPYTPDYGYPTNFYNIYGGAQYPFYGGATAGMVTGTSPFYPYFQFGQSGNTTTNYTSGQGYNLQQYPQMFHFSTVSSTAAAVTGFAQQYGGPLSLAASPQAQAGMTMALTAPTLPTPTQAAHPYRLIPSHFAVSAAPEQPLA

SEQ ID NO: 266 - protein, 80 aa, Zea mays
MSRSGQPPDLKKYMDKKLQIKMNANRVVIGTLRGFDQFMNLVVDNTVEVNGNDKTDIGMVVIRGNSVVMIEALEPVARSQ

SEQ ID NO: 267 - protein, 285 aa, Zea mays
MSFWIPSTVRRRPCPGLPGYKTGGGSGLACRGRVAWGKRRRKPLGARSRSARPARAHAHAHAHDWSQALASVLHAPRACLQPQGNRSWQGLAVAATGSRAMAAAARVSEVKAEGLLRGACAALAAAAALLVGLSTQTETVLLVRKKATVKDVQALWVLAMAAAAAAGYHLLQLLKCLYLGRVGGARPCRRSSRALAWTCLLLDKACAYTTFATTVAAAQACVVALDGAHAVQWTKLCNIYTRFCEQVAGSLVLGMLAAVGTAVLSAASARNVFRHYSSLETYAAH

SEQ ID NO: 268 - protein, 366 aa, Zea mays
MALSDRSRESLLPSFLYASSARSFAATGAAARLPVSSPAPATAGAGGGVPFSIQAPKEKIEMYSPAFYAACTAGGIASCGLTHMAVTPLDLVKCNMQIDPAKYKSISSGFGILLKEQGARGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGVLGLYKGIVPLWGRQIPYTMMKFASFETIVELIYKHAVPVPKSECSKTTQLGISFAGGYIAGVFCAIVSHPADNLVSFLNNAKGATVGDAVKKLGLWGLFTRGLPLRIVMIGTLTGAQWGIYDAFKVMVGLPTTGGVTPAPAAEAELKASA

SEQ ID NO: 269 - protein, 1039 aa, Zea mays
MELALGAMTSLALKLGDLLMEEYVVQKGLKPDIESLSRELVMMNAALIDASRVPPDQLTEVEKLWARKVRDLSYDMEDAVDDFILRVAGGDDSAADSKFFKKTLAMVKDVMSMKKFKDRRQISDKVKDIKKLSNELAELRAKYTVRGVGADLAASTGIDPRVINLYKKETDLVGIKKSRNKVIRMLSMETKDDDALESHQALKIVSIVGVGGLGKTTLAKTVHDMLKKQFDCSAFISIGRTPNLNRTFEKMLLKLDREYKQVDMARWDLEQFKNELDEFLKDKRYLIVVDDIWDVDSWEAIRYALKDNNCGSRIIMTTRNFGIVTKLEEVYRLKPLSNANSKKLFYKRIESQEGESLDGELSSKIIHKCGGIPLAIIAIASLLVERSREEWSEVYDKIGLGNEDNTTKIMSYSYYDLPPYLKPCLLQLSIYPEDCIIDTNSTIWKWIGEGLVHLEKEEGSLFKVGERYFKELVNRSMIQPTEDKNDRFVEGFRIHDIVFDLICKLSKDEDFITISGQHSSRDSLRREKKTCVPRSDCKLRRLAVRNQRVQRFPEETIDMPEVLRSLSIIDCNIEVMAPIDSFRVCRVLHLGKSYVPISLKHLGKLLHLKFLEIVYTPIDELPKEIGHLRSLQTLILDRTGLDELPPVVCSLTRLMCLIAQGFERLPADRMGNLTSLEELRLRRVVGRSATQALVAELGKLTRLRVVDITFSEQLEESLQEALVQSLSNLRGLQELTLLFKMTRWGSDMWGDWEPPRQLRRLIIEGIIVFSRQPRWINRSCLPRLCYLSLMVHTLEAQDLDNLARLPELQYLTLDGLSWPPRYTVGPDDFRNLRFCKVGTTFEFRKGAMPRLEVLQFRVFAGYYCWAYNGVPFEQFPTKDLDLDLDNVLLLQQVIVKVNCVGATVTQVEEVEAVVMRAVENHANRPTIKMNRAYEIAILSDEGREALLRRHIEKDCCVRTMKDKSDAFFISQLRRYRHLQKAIIFIDCSGASMCEVQKVEAAFRHAAEVHPNHPSIELIRTNTDGMASSSSDHPNTEPRN

SEQ ID NO: 270 - protein, 290 aa, Zea mays
MAASALLLSPRLVSFPPHPSLAPLFTKRPPPYPLGGAGARLRAVGDGPGAGLPPEQATVYDGAYGPWTLEDSDVREVLLYRSGLVTAAASFVAASSAAFLPEGNPAASAVTGAADLLYAAGAAGLGLSLVLIHIYVTPIKRFLQALWAAGALGSVGTYLVAARPLDEGLVQYVLDHPAALWFVGPTFAALTGLVFKEGLCYGKLEAGILTFLIPGLLLGHLSGLMDNSTKAGLLGLWMLLFTIFAARKFQQPIKDDVGDKSVFMFNALPEEEKKAWIQKLERQKGQELFE

SEQ ID NO: 271 - protein, 449 aa, Zea mays
MAAGGRSIACFAAVLLAAALLLSAPTTTEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFFSADGRRVTQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKEYWRVKITITNFNFRMNYTQWNLVAQHPNFDNITQLFSFNYKPLTPYGGGINDTAMFWGVKFYNDLLMQAGKLGNVQSELLLRKDSRTFTFEKGWAFPRRVYFNGDNCVMPSPENYPWLPNASPLTKQALTLPLLIFWVALAVLLAYA

SEQ ID NO: 272 - protein, 109 aa, Zea mays
MTATTTTAAGGGKVQPRGLPAALSLLLLLVLAAGLGGGAEAQQTCAGQLRGLAPCLRYSVPPLPGQVPPAPGPECCSALGAVSRDCACGTFSIINSLPAKCGLPPVSCQ

SEQ ID NO: 273 - protein, 134 aa, Zea mays
MAAVVNARAATARCSAAGGPPRGAASSFPPSTIRTRKRTTAAAGGRGRLVAVSAVGDVAAEGNTYLIAGAVAVALVGTAFPILFSRKDTCPECDGAGFIRKAGATLRANAARKDEAQIVCPNCNGLGKLGQIDK

SEQ ID NO: 274 - protein, 520 aa, Zea mays
MEMVECSLVATLAPRPLPGQVRKALPRPAAFGARARLRVRSVGREEPLHPQQTAVRASGPDHGGRALGQAAVGFAAAAVVSLTGFSGDVSPLPTPPARAESLTVAFPVSKAREVNRVQRTLVETWGLIRETFVDPTFNHQDWDQKLQQTMVEIFPLKSADAAYSKISGMLSTLGDPFTRIISPKEYQSFRIGSDGNVQGVGVFINKEPSSGRLLVMDCIQGGPADRAGIHEGDELVEIDGKSVSGLDGEAAAQRLRGRVGTTVKVKLLDGTDDERGGGLRQKEVQLSREIINLSPLSTAIISHRTDDGHECKTGYVRLASFYQTAAAEMENAVKRMEDIGVQSYILDLRNNPGGLVKAGLDVAQIWLDGDETLVNTIDREGNVLPINMIQGHSLTHDPLVVLVNEGSASASEILAGALHDNGRAILVGHRTFGKGKIQSVTELDDGSALFITVAKYLSPALHEIDQVGIQPDIQCSPDILSLPRAPSLRENSNATNLEMDSCIMVAEQALEIQQSKGSAS

SEQ ID NO: 275 - protein, 760 aa, Zea mays
MAHEREPLLQQRQTGVGNACGAKDSSSAPAPSAAALPSLARTVLKFLMWAVFLTWAAGIFLYPTKPVQAVFRKWVGLTRDSMFGIAGGIFLTFSAPILIIALLAYVYISFFPSEHVVEKRKLRSLSFRLWTFPVLVDGPFGVVSAVEFIGIVLFIVFVVYSMTYYAVEAVSLVSKFDIPSMTESELILDVIGLRLGAVGLFCMLFLFLPVARGSVLLRLIDIPFEHATRYHVWLGHLTMALFTLHGLFYVISWSMQGRLREELRQWKEIGVANLPGVISLAAGLLMWVTSLHPVRKRFFELFFYTHQLYVVFVVFLAFHVGDFIFSICAGAVFLFMLDRFLRFWQSRAKVDIISAACRPCGTVELVFSKPASLHYNALSFIFIQVRELSFLQWHPFSVSSSPMDGRYHMSVLIKVLGTWTEKLRSIITDVQEKNGGDSELQCGRMTACVEGPYGHESPYHLMYENLVLVAGGIGISPFLAILSDIIHRIEEGKQCMPKNVLVLWSVKKSKELSLLSAVDAQTISSSVSDRLQLDIQAFVTQEPHPPLEDGIVGDDQKVPGMFVKNGTAMSGLVGTGDNFWAAMYFLASTLGFLLAYALVQVYYVKPHNVVAWWYLGLLFMLCMVAGVALPGGLVVLLWHLSEKQRLEDDKWDASQSPRAEQTGPLAAAGGGDDDAAPSVSLAALRTTRYGCRPNFEAEFAAFAERAGDAADVGVLVCGPQGLQTSVARECRARNLRRGGLGAAKSRSGAVFHFNSHSFDL

SEQ ID NO: 276 - protein, 75 aa, Zea mays
MGLCSCCCRCLELLCSVLLPPLGVCLRHGCCSMEFWISVLLTILGYLPGVLYAVYVICSVDPHRHRDNDDYVYVA

SEQ ID NO: 277 - protein, 544 aa, Zea mays
MAGYRGGSSVSASTGGGGSAVAAAFSTRLLLLLTLLPLALAAFAFALQWRGGMRDPAGAAWPADAQRFPGMENSPLSSSHGGAGSYFAVSSSSSSPGADCAEILGRSAASSNGISLYRGWSFDSESAITPKICITGSTSASLHQILPWLYYHKVIGVSHFFLFVEGEAAKPAVTSVLESIRGVKIIYRTKELKEKQEKSRIWNETWLAGFFYKPCNYELFVKQSLNMEMAIIMARDAGMDWIIHLDTDELIHPAGAREYSLRRLLLDVPDNVDMVIFPNYESSIERDDIKDPFTEVSMFKKNYDHLPKDTYFGLYKEATRGNPNYFLTYGNGKSAARVQEHLRPNGAHRWHNYMKSPNEIKLEEAAILHYTYTKFSDLTSRRDRCGCKPTKEDVKRCFILEFDRLAFIIASTATEEEMRNWYKEHVVWTDRDTNLKLLRKSVLTRIYAPMAIIRGLKESGVFTNAVTSAKAQSKTKSSNMGLGNKDPIQPNGTAGQSTLEGSHGKLQATVRKILEMVDTQEEAAMPPMSPPGFLELTESVTAFS

SEQ ID NO: 278 - protein, 272 aa, Zea mays
MSSLRAISSLLHIYSTSAAARRGAGRLGFAPSPGGRFRVPSNSGPPAFVLDEVARAAGGVRRRASTRAASWDSEKSPYETLELGRDADEETIKTAYRRLAKFYHPDVYDGKGTLEEGETAEARFIKIQAAYELLIDGERRRAYDREHHVNPMKASQAWMEWVMKKRKAFDQRGDMAVAAWAEQQQREMTLRARRLSRSKVDPEEERKLFAKEKKASMEFYSTTLKRHTLVLRKRDIMRKKAEEEKDKEISRLLAAEGLELDTDEDENKTFLG

SEQ ID NO: 279 - protein, 155 aa, Zea mays
MASLSSAAVTAPSFAAPAPARAVVRRRSFTVRASLRKATGTAAVAMAASALLAGGAMAQEVLLGAGDGGLVFEPSQFTVKAGDTITFKNNAGFPHNVVFDEDEVPSGVDATKISQEEYLNAPGETYSVTLTVPGTYGFYCEPHQGAGMVGKITVN

SEQ ID NO: 280 - protein, 105 aa, Unknown
  Sequence found in Organisms: Zea mays, Pennisetum glaucum, Sorghum bicolor, Cynodon dactylon, Avena sativa, Saccharum officinarum, Triticum aestivum
MVNVPKTKKTYCKNKECKKHTLHKVTQYKKGKDSLSAQGKRRYDRKQSGYGGQTKPVFHKKAKTTKKIVLKLQCQSCKHYSQHAIKRCKHFEIGGDKKGKGTSLF

SEQ ID NO: 281 - protein, 265 aa, Zea mays
MARGLKKHLKRLNAPKHWMLDKLGGAFAPKPSSGPHKSRECLPLILIIRNRLKYALNYREVISILMQRHVLVDGKVRTDKTYPAGFMDVISIPKTMENYRLLYDTKGRFRLHPIRDEDAKFKLCKVRSVQFGQKGIPYLNTYDGRTIRYPDPLIKANDTIKIDLETNKIMDFIKFDVGNVVMVTGGRNTGRVGVIKNREKHKGGFDTIHVEDSMGHQFATRMGNVFTIGKGNKPWVSLPKGKGIKLSIIEEQRRRDFAAQAAAKA

SEQ ID NO: 282 - protein, 138 aa, Oryza sativa
MARRSSARSRPAPRAAPVRNPPQPARQAPPPAPAQNGGGSILGGIGSTIAQGMAFGTGSAMAHRAVDAVMGPRTIQHETVVSEAAASATPMANATPSDSCSIHSKAFQDCINNYGSDISKCQFYLDMLNECRRGGASA

SEQ ID NO: 283 - protein, 444 aa, Oryza sativa
MRMGKYEMGRALGEGHFGKVKLARHADTGAAFAIKILDRQRILAMKIDEQIKREIATLKLLKHPNVVRLHEVSASKTKIYMVLEYVNGGELFDKIALKGKLSEKEGRKLFQQLMDAVSYCHEKGVYHRDLKPENVLVDAKGNIKVSDFGLSALPQNQRKDGLLHTTCGSPNYIAPEVLLNRGYDGSLSDIWSCGVILYVMLTGNLPFDDQNTVVLYQKILKGDARIPKWLSPGAQDILRKILDPNPITRLDITGIRAHEWFRQDYTPAMPFDDDDDNNISDGNLHMTENQDIETSPAISQINAFQLIGMSSCLDLSGFFEKEDVSERKIRFVSNYSPTSLFEKIESTVTEKGFQVQKNSGKLKVIQVCKEPANPRGHGNLLISAEVFEINESLYVVELKRSSGDCSLYRQLCASLSEDLGICKRQQLLKKDSMRQDLCRYNSSF

SEQ ID NO: 284 - protein, 174 aa, Sorghum bicolor
MAPAATGVGSLAAAPVAKGYTTYRKAAARSVVRLGLPALPPLPGLRLAAQGQASFCECKRLARNVVAMATGEPTAAPVADNEELTEFVNALKKEWDRIEDKYAVTTLAVAATLAMWSAGGVVSAIDRLPLIPGLMEAVGIGYSGWFAYRNLLFKSDRDAFFAKVREVYEDIIRS

SEQ ID NO: 285 - protein, 261 aa, Sorghum bicolor
MASTSCFLHQSTARLGASPRVAAAPRSAQLFVCKAQQKQQQDAAAVDQSDVSRRAALALFAGVAAVGAKVSPAAAAYGEAANVFGKPKTNTEYIAYNGDGFKLLIPSKWNPSKEREFPGQVLRYEDNFDANSNVSVIIQPTSKKTITEYGSPEEFLSQVDFLLGKQAFGGSTDSEGGFETGAVATANVLESSTPVVDGKQYYSVSVLTRTADGDEGGKHQLITATVSDGKLYICKAQAGDKRWFKGARKGVEKAAASFSVA

SEQ ID NO: 286 - protein, 242 aa, Sorghum bicolor
MAPRVADKSPLPPATGLGLGVGGVVGGVGMGPHYRGVRKRPWGRFAAEIRDPAKKSRVWLGTYDTAEEAAKAYDAAAREFRGAKAKTNFPFPSQCAVAAGGAGSPCSNSTVDSSGGASGCAVQAPMQAMPLPPALDLDLFHRAAAVNAVTAGGMRFPFKGYPVARPTPHQYFFYEQAAAAAAAAAGYRMLKVAPPPVTVAAVAQSDSDSSSVVDHTPSPPAVTAKKEVGFELDLNWPPPAEN

SEQ ID NO: 287 - protein, 232 aa, Sorghum bicolor
MMWSHEPAAEQKAAAAAATRQRSSVAKLTTASSSSLANLLSVFVGANNSNSSADPTPPPRRSFDEGGGVGLGIVAAMSHACLTGAGAGVGAEPIAIGAAARRRRAREEDESYTCVITHVAGAGGGSVRKRVYFGFGDGGGWLVEADDEAPAPAPDFLSRCCLCDKRLDGLDIYMYRGEKAFCSSECRCQQMLMDDRADKCGSEALIRSGGDYSYSVSPHSTPMAFSPSVAAA

SEQ ID NO: 288 - protein, 386 aa, Sorghum bicolor
MERMLARLMRRRSSSPLSDLLHHGGAAAAGSLQAAAGATAASPWLFSHHQQQQQQHTAAAALPGLKIRDSASQLIGRTPMVYLNKVTEGCGARIAAKLEFLQPSFSVKDRPAISMLEDAEKRGLITPGKTTLIEPTSGNMGIGLAFMAALKGYELILTMPSYTSLERRVTMRAFGANLVLTDPTKGMGGTVRKAAELYEKHPSAYMLQQFQNPANVKVHYETTGPEIWEDTLGQVDIFVMGIGSGGTVTGVGKYLKEKNPNAKIYGVEPAEANVLNGGKPGPHLITGNGVGFKPDILDMDVMEKVLEVKGEDAVKMARELALKEGLLVGISSGANTVAALELAKKPENKGKLIVTVLPSLGERYLSSALFDELRKEAEAMEPVPVD

SEQ ID NO: 289 - protein, 560 aa, Sorghum bicolor
MDKLGTNPANSCPLTPLGFLERTATVFGDCPSVVYHDTVYTWSQTHRRCLRLASALVSLGVSRGDIVSVLLPNVPAMYEMHFGVPMSGAVLNTINTRLDARTVAVLLRHSGSKLVFADPASVPLVRDALRQLPPGHRAPRVVPVEDPHEKEFPAAPPGTLTYEALLDRGDPEFAWVRPRSEWDPMILNYTSGTTSAPKGVVHCHRGIFLVTVDTLVEWAVPKQPTYLWTLPMFHANGWCFPWGMAAVGGTNVCLRRVHAAEVYATIARRGVDHLCGAPVVLNMLANAPDAARRPLPGKVRILTAGAPPPAAVLHRTESIGFEVTHGYGLTETAGLVVSCAWKGEWNKLPASERARLKARQGVRTPAMAEVDIVDGETGHSVPRDGSTMGEIVLRGGCVMLGYLNDDTATRAAIRDNGWFYTGDVGVMHPDGYMEIRDRSKDVIISGGENISSVEVESVLYNHPAVNEAAVVARPDEFWGETPCAFVSLKEERSGSPGAVTAADVIAWCRDRMPHYMVPKTVVLRAELPKTSTGKIQKYVLRNLAKDMGPTRKGASSSSRM

SEQ ID NO: 290 - protein, 355 aa, Sorghum bicolor
MASEDVVGKSRGDTAVTTIVNLAEEAKLAREGVKAPGHQILTICKSLVAGGVAGGVSRTAVAPLERLKILLQVQNPHSIKYNGTVQGLKYIWRTEGLRGLFKGNGTNCARIVPNSAVKFFSYEQAAKGILWAYRQQTGEEDAQLTPLLRLGAGACAGIIAMSATYPMDMVRGRITVQTDKSPYQYRGMFHALGTVYREEGFRALYRGWLPSVIGVVPYVGLNFAVYESLKDWLLQTNPFGLANDNELHVVTRLGCGAVAGTIGQTVAYPLDVIRRRMQMVGWNHADSIITGKGKEALQYNGMIDAFRKTVRHEGAGALYKGLVPNSVKVVPSIAIAFVTYEVVKDVLGVEMRISD

SEQ ID NO: 291 - protein, 471 aa, Sorghum bicolor
MMDAGGGGVRSQGVNPDCPNAANPFHRCAEYCPVPAPAANKAASASAAAARGKPAPPRPRTTTVAQNGTAKHGDGAARVVPAADAEEEENDGGEREESRAVDPGYYPASKTSPPRQGPAPVLGYAAQNGTARRVVEEECEITVVDDAEEQGESVENYGAEEEQGSGGRTRTSARSPATDGEGSGGRTRTSARSPATDGEAGGERQWQAVNPDCPNAANPFHRCAEYCPVPVPKVPLPPRGYEGSTHSDPGAPHPRPRRRDKGGSGGLPLYVFLREGSDGDGKKVDPRCPNAPNPFHVCTDHCLAKIADAGRSSEGAKSPISLFSRHSRRSSSSSEEGSLKSPGSRKVDPKCPNAGNLFHECGEHCATKMQQTEQHKGFNIKSPRRKGGKNATVIPNWKVDPRCPNASNPFHMCAQYCFDHLSETAQTSATKSDKSRGKDIPKDERRGEINSDCVNASNPYHKCGDHCKRRG

SEQ ID NO: 292 - protein, 507 aa, Glycine max
MDYERIQKPQGVGGFSPGKLRSMLLGVEKKRKEEEELDSTLTTRSQNSDMDESGGSSSDHCKDVDVVSVLPDYSTSAIVRTSSIEAVGGDRFVKANAAVNSRNRVLEDPSSDYDSGHDNMSMSSSMFEFQKAERAPQRVPVGPFSKPAPSKWDDAQKWIASPTSNRPKTAQTQGQGGHAGPRKAGSLGYGSRQSSMKVVVEVPDQKEIALDEPDTKKIDTNQTKMDSGGQKFVSWEADPYAIASFCVSLSQHNLSLAIQNETTFVPPPSTARSVSMRDMGTEMTPIASQEPSRTGTPVRATTPMRSPNSSRPSTPPRASPASTLTDLHSDNLNLNMNELSEKELQMKTRREIMVLGTQLGKMNIAAWASKEEEDKDASTSLKTKAELPKSVVEARAAAWEEAEKAKYMARFRREEMKIQAWENHQKAKTEAKMRKIEVEVERIQGKAQDKLTNKLAAARHKAEEKRAAAEANRNHQAAKTEEQAEYIRRTGHVPSSYLSFSCCNWCS

SEQ ID NO: 293 - protein, 849 aa, Glycine max
MTGKKNVKAMTTAEEEDDQGKHTTSSSFSSSSSPSSSSDEREYEVQDLRDRLKSSQGSMFNLIENQLGLNSTWSKFSRQALLHGIRGFSMDLVKDFVIHPDNRWYRAWTNFILVWAVYSSFFTPMEFGFFRGLPENLFILDIIGQIAFLVDIVLQFFVAYRDSQTYRMVYKRTPIALRYLKSNFIFDLLGCMPWDIIYKACGRKEEVRYLLWIRLYRVRKVEDFFHKLEKDIRVNYIITRIVKLIVVELYCTHTAACIFYYLATTLPESQEGYTWIGSLKLGDFSYSHFREIDLWKRYTTSLYFAIVTMATVGYGDMHAVNMREMIFIMVYVSFDMILGAYLIGNMTALIVKGSKTEKFRDKMTDLMKYMNRNRLGRDIREQIKGHVRLQYESSYTEASVIQDIPISIRAKISQTLYLPYIEKVSLFKGCSSEFINQIVIRLHEEFFLPGEVIMEQGNVVDQLYFVCHGVLEEVGIAEDGTEETVSLLQPNSSFGEISILCNIPQPYTVRVCELGRLLRLDKQSFTNILDIYFYDGRKVLYNLLEGKESFRDKQLESDITFHLGKQEAELALKVNSAAFNGDMYQLKGLIRAGADPNKADYDGRSPLHLAASRGYEDITIFLIQERVDVNIIDNFGNTPLLEAVKNGHDRVASLLVKEGASMKIENAGSFLCTAVARGDSDYLKRLLSNGMDPNLKDYDYRSPLHVAAAEGLYFMAKLLLEAGASVFTRDRWGNTPLDEARMCGNKNLIKLLEDAKSSQLSEFPSQEFTDKMHPKKCTVFPFHPWDPKDNRRHGIVLWIPHSIEELIKSAAEQIEISGGSCILSEDAGKITDVDMIKDGQKLYLVHETH

SEQ ID NO: 294 - protein, 309 aa, Glycine max
MHSLTCTPLSSSYSSHHTTLKPNLNPLLGADATFRPCSLPLKRRTCFTTRAILSSTREDVLKHFSERRALKIISGLQNFNKDNVASVVTAADKGGATHVDIACDPELVKLAIGLTSCPVCVSSVDPATFPAAVEAGALMVEIGNYDSFYEKGIFFTPEKILGLTKETRRILPSVVLSVTVPHTLSLPDQVKLAESLEQVGVDIIQTEGGKCSNPTQSGVMGLIEKATPTLAAAYSISHAVKIPVMCSSGLSAVTAPMAITAGAAGVGVGSAVNRLNDVVAMIAEVRSIANSLQAPFRISTTHAVETQRQ

SEQ ID NO: 295 - protein, 372 aa, Glycine max
MATTSASFASFSVILRPSSSNPQFFLFNVAPRTGTSHSRTRSTRFRCSAGQTGFFTKLGRLIKEKAKSDVEKLFSGFSKTRSNLAVIDELLLYWNLADTDRVLDELEEALLVSDFGPRITIKIVENLREDIFSGKLKSGNEIKEALKRNVLELLTSKGSKTELQLGYRKPAVIMIVGVNGGGKTTSLGKLAYRLKNEGAKILMAAGDTFRAAASDQLEIWAGRTGCEIVVAESEKAKASSVLSQAVKKGKELGFDIVLCDTSGRLHTNYSLMEELISCKKSVAKVIPGAPNEILLVLDGTTGLNMLPQAREFNDVVGVTGLILTKLDGSARGGCVVSVVDELGIPVKFVGVGEGVEDLQPFDAESFVNAIFI

SEQ ID NO: 296 - protein, 926 aa, Triticum aestivum
MEVCCCSTSSSLLASGRFAAPVASARARQWCAAGGGRAVVLAHPLRPAAAPRSARRARRGVTRAVFERFTERAVKAVVHSQKEARGLGEGAVAPRHLLLGLVAEDRSAGGFLSSGITVERAREECRGLIGAASQKAGGLDTDVPFDGGCRRVFEVAVELSRNMGCSFISPEHLAIALFTLGDPTTNNLLRSLGADPSQLASVAVTRLHEELAKDGRDLAGVSSLKVPEKAPAGAGAGRSAFGKSLSKKKDKGALDQFCLDLTTQASGGFIDPIIGREEEIERVVQIICRRTKNNPILLGEAGVGKTAIAEGLALRIANGDVPIFLVAKRIMSLDIGLLIAGAKERGELESRITSLIREVREAGDVILFIDEVHNLVGSGTAGKGKGAGLDISNLLKPPLARGELQCIAATTLDEHRMHFEKDKALNRRFQPVFVDEPSQEDAVKILLGLRENYEAYHKCKFTLEAINAAVYLSARYIPDRQLPDKAIDLIDEAGSRARIESYQKKKEGQSSVLLKEPDEYWQEIKAVQAMHEVVLSNKMKYSPNENKQQNASVNTEAPHQDKAESTIEEPIVVGTEEIARVASLWSGIPVQQLTADDKKILVGLDDELRKRVIGQDDAVAAISRAVKRSRVGLSDPDRPIATMLFCGPTGVGKTELTKALAASYFGSESAMLRLDMSEYMERHTVSKLIGSPPGYVGYGETGTLTEAVRRKPFTVVLLDEIEKAHPDIFNILLQIFEDGHLADSQGRRVSFKNTLIVMTSNVGSTSISNGRRSMGFSTEDTESSRYVAVKSLVMEELKGFFRPELLNRIDETVVFRPLEQTQMLAILDILLEELKGKLLAVGIGLEVSDAMKELICREGYDKNYGARPLRRAITQLMEDVISEAILFGEYKPGDTILVDTDSKGKPCLSRLNQPPIVQVSDSTRTF

SEQ ID NO: 297 - protein, 492 aa, Triticum aestivum
MTSTVTTPTPSRPLPAGPQRRRYRPTVLAIAGGSKPPRRRAPAAATSCAALAAPEKQSTAPSKLPAPSPAPEGTDYDEVAATLETLYKLSPVIVEEDGKRSKKQAATKKKRKQGRAKSGAATTTAATPRRTVVVRSQRRRRMDLGKRVEMRDLAAGKEDEHRDGERAFEEALLREHAVSTDMGSLDWRWMKIPPVLSAPQSARLFKIMQPMKAILEVQENLRNELQSEPTDVEVAEAMNMPVQRLRRLRDVGQAARNSLIKHNLRLVLYAINKYYPDMTGDERFADLCQAGANGLITAIDRFEPKRGFRISTYALFWIRHSVVRAMTLSSFTRFPFAMESERQEINRAREELSFELGRAPTDEETMKKVGLSPARYRDVVRMTRPTYSLHSRNRVTQEELIKEVTDVDAIGVDTHKHNRLLRLAIDDLLDSLKPKESVVIRQRFGLDGRGRRTLSEIAGNLRISREMVRKYELKALMKLKHPTRVDYLRRYM

SEQ ID NO: 298 - protein, 773 aa, Triticum aestivum
MGTSGSKGLDGVGGLGAAALGGGSGGGMGGDEGDGAVTGSWHGGAQLYVSLKMENARIIGDLVPHVYGSEPIIGSWEPARALAMERELASMWELSFVVPPDHETLDFKFLLKPKDAETPCIIEEGPTRLLTGGMLEGDVRLANFRLNGDDELLEFRVFNKADIVSPLDLAASWRVYKENFQPSKVRGIPDISINEAPTHATEDGSGSSLELDLEHYVVPTPTAPPTEYAANLAATPASLDQPETPWTNDMLLSDGIQSPRSAAADFKDDSYHNKDTEASIADSSNSKKLQVSGMVESKSVGTLIQLQKKDRPQGLYVDRGVVSPKLGKSFSACSLASGLNFGSTKAMPEAAGAVAAAAVADRLHGSKEDRKLAIVLVGLPARGKTFTAVKLTRYLRWLGHETKHFNVGKYRRLKHGANQSADFFRPDNQEGIEARNEVAALAMEDMIDWMHGGGQVGIFDATNSTRKRRYMLMKMAEGNCKIIFLETICNDRNIIERNVRLKIQQSPDYADQPDYEAGLQDFLERLTNYEKVYEPVQEGSYIKMIDMVKGEGGQLQVNNISGYLPGRIVFFLVNSHLAPRPILLTRHGESLHNVRGRVGGDTVLSEDGELYSKKLANFIEKRLKNEKTATIWTSTLQRTILTATPIVGFPKIQWRALDEINSGVCDGMTYEEIKKIMPEEYESRKKDKLRYRYPRGESYLDVIQRLEPVIIELERQRAPVVVISHQAVLRALYSYFADRPLREVPDMEMPLHTIIEIQMGVTGVEEKRYKLMD

SEQ ID NO: 299 - protein, 327 aa, Triticum aestivum
MRAVAIASPGGPEALQVREVDDLPAPGEGEVLVAVAAAGVNRADTVQRQGRYPPPPGASPYPGLECSGTILALGANVPPRWAVGDQVCALLTGGGYAERVVVPAGQLLPVPEGVSLTDAAGLPEVACTVWSTVFMTSHLSPGESFLIHGGSSGIGTFAIQIAKHLGVKVFVTAGSEEKLAACKGLGADVCINYKTEDFVARVKEETDGKGVDVILDNIGASYLQRNLNSLAVDGRLFIIGFMGGTTTEVNLQAMLARRLTIQAAGLRNRSLANKAQIVSEVEKNVWPAVVSGKVKPVIYKTFPLSEAAESHKLMETSSHIGKILLIP

SEQ ID NO: 300 - protein, 209 aa, Triticum aestivum
MATAYAPPMASQVMKSGLVCSKPRGMSGASLTRRPRLVVKAVKSDKPTYQVVQPINGDPFIGSLETPVTSSPLVAWYLSNLPAYRTAVSPLLRGIEVGLAHGYLLVGPFALTGPLRNTPIHGQAGTLGAIGLVSILSVCLTMYGVASFNEGAPSTAPALTLTGRKKEADKLQTAEGWSQFTGGFFFGGVSGATWAYFLLYVLDLPYFFK

SEQ ID NO: 301 - protein, 348 aa, Triticum aestivum
MGSAGALLSHPPPQLGSILLRRHHISLPHLSSCMPEPLHCRRRHLRCSAVEGSSRQDTNLPASQREESPSSSLGATLQDPLPGRVENGSFEGVTQEEDQSSLYNFLYPSKELLPDDKEMSIFDHLEELRARIFISVLAVGASIIGCFAFSKDIIKILEAPVSVQGVRFLQLSPGEFFFTTLKVSGYCGLLIGSPIILYEIIAFVLPGLTKDERKFLGPIVLGSSVLFYLGILFSYTVLAPAALNFFVNYAEGAVESIWSIDQYFEFVLVLLFSTGLSFQVPVIQLLLGQVGLVSSEQMLSIWRYVVVGAVVAAAVLTPSTDPLTQMLLAGPLLGLYLGGAWMVRLTGR

SEQ ID NO: 302 - protein, 397 aa, Triticum aestivum
MERSWFGWRKAKQGGGGGAGGGGGEREEEDQAKVVVDGSGIRELVEDREAFGMFAETKFRQLDADGDGRLSVRELQPAVADIGASLGLPAQGSSPNADHIYSEAMSEFTHGHGNQEGVSRAEFQEVLSDILLGMAAGLKKDPIVILRIDGEDLRDFVSSPRYEPAVAAIFSQVGSEDAPLRQCLLAAVQQLGVDHGMPPAADPWVVENVVEPALQQLSADELEQPASRDVFFEQLKKLLGSVAEQLQERHVIVAHTENTFDGSGVRRLLGNKFELDKLLDSVWRDVPAEHRKKAPKGKEHLRVALDKMADAASLPPHGAVAQVDAVVDEALKVADAGDGKAVEEAEFKKLLTEVLGAVMLRLSGQPIFFSTSTVVHEPLSTSATLLPSPAAASPPSE

SEQ ID NO: 303 - protein, 404 aa, Triticum aestivum
MELAATSAAALRRSLASGYPVVPRERRRGMPARVSCVGRGGRGVGGGFADEAHLRYYEAPPRKAVEAAARDLTKLRAMGLVAGDPAKEKILSEATELLLQELNQMKDAEDELKKKQKEEKAAMKALKKQQKEAKKAAMNCGDGSSESSESECEEEQSMKMSCVATTSMPAVEQGMAMSMSVPQIAASNIATAPAMDFDKAAMKAMKKREKEQKKAAKKAMKMKKEEEKRMATLNSCKDEDSSCSSESSNSECEGEVVRMSRCATISAPRTPPASTVFPIIVPQIPDSVALDAQIFSGSANAMQCTATSIAVVEKPVLNRIEVCMGGKCKKAGSLAVLQEFETEVGTGGMVVGCKCLGKCGLGPNVRLRSEGSVQKNSPICIGVGLDDVGTIVAGFIGDDDLGMN

SEQ ID NO: 304 - protein, 126 aa, Zea mays
MSSMMNALSNWLVNPRRNPLARLHMHTVSSRLRKYGLRYDDLYDPYFDLDIKEALGRLPREVVDARIQRLKRAMDLSMKHQYLPEDLQAQQVPFRGYLSDMLALVKKENAEREALGALPLYQRTLP

SEQ ID NO: 305 - protein, 420 aa, Brachypodium distachyon
MSAAATAGPNSILLHRPTSAGPAVASSIRLPARASKVSCAAVAAPSSPHALTGAGERGVYNFAAGPATLPLSVLQKAQAELVDYRGSGMSIMEMSHRGKEFDAAIKKAEADLRALLAVPDTHEVLFLQGGATTQFAAVPLNLCAGASDPVDFVVSGSWSDKAFKEAKKYSAASVAWSGKDGKYTALPQFDAIKQNPEARFLHICSNETIHGVEFKDYPEPKNKSGILVADMSSNFCSKPVDVSRFGIIYAGAQKNVGPSGVTIAIVRKDLVGNAQPITPVMLDYKTHADNASLYNTPPCFAIYICGLVFEDLLAQGGLAEVEKKNQHKAGILYDTIDASGGYFICPVEKSVRSLMNVPFTLAKGADFEKQFIAEAAKEGMLQLKGHRSVGGVRASIYNAMPLSGVEKLVTFMKDFQARNP

SEQ ID NO: 306 - protein, 187 aa, Brachypodium distachyon
MDRPQVVSENYANPITCLFHVLFKAAALAFYILFSLFVKSFVIIFVITVLLAALDFWVVKNVSGRILVGLRWWNEIDDDGNSVWKFECLDAESLARMNKKDSWLFWWTLYLTAAAWIVLGIFSLIRLEADYLLVVGVCLTLSLANIVGFTKCNKDAKKNIRAFAENAAQNAITSRITSSLQSAFSVI

SEQ ID NO: 307 - protein, 924 aa, Brachypodium distachyon
MESHDGVADDLPPPPPLPPSIEPLKPEEADDLPPPPPLPPNVEPIKVEDAKKPRRTLISRPGFGKNGKPIQLVTNHFKVSLKTTDEFFHHYYVNLKYEDDRPVDGKGVGRKVIDKLQQTYASELAHKDFAYDGEKSLFTIGALPQVNNEFVVVLEDVSSGKTAANGSPGNDNSPGSDRKRVRRPYQTKTFKVELNFASRIPMSSIAMALQGQESEHTQEAIRVIDIILRQHAAKQGCLLVRQSFFHNNPSQFVDLGGGVMGCRGFHSSFRATKSGLSLNIDVSTTMIVKPGAVVDFLIANQKVDHPNKIDWAKAKRALKNLRIKTSPANTEFKIVGLSERNCYEQMFSLKQRNNGNGDSEAIEISVYDYFVKNRGIELRYSGDFPCINVGKPKRPTYFPIELCSLVPLQRYTKSLSTLQRSSLVEKSRQKPQERMSVLSDVLKRSSYDTDPMLKACGISIAQGFTQVPGRVLQPPKLKAGNGEDIFTRNGRWNFNNKRLVRASCVERWAVVNFSARCNCNDLVRDLIKCGGMKGIKVDQPFDVFEENSSMRRAPAPKRVEAMFETVKTKLPGAPKFLLCILAERKNSDVYGPWKRKCLAEFGIVTQCVAPTRVNDQYLTNVLLKINAKLGGMNSLLQIELSPAIPLVSKVPTMILGMDVSHGSPGQADTPSIAAVVSSREWPLVSKYRASVRSQSPKSEMIDSLFKPQGTEDDGLIRECLIDFYTSSGKRKPDQIIIFRDGVSESQFTQVLNKELDQINEACKFLDESWSPKFTLIVAQKNHHTKFFIPGSPDNVPPGTVVDNVVCHPKNYDFYMCAHAGMIGTTRPTHYHILHDDIHFTADDLQDLVHSLSYVYQRSTTAISVVSPICYAHLAAAQVSQFVKFDEMSETSSSQGGGGHTSAGSTPVQELPRLHEKVRSSMFFC

SEQ ID NO: 308 - protein, 197 aa, Setaria italica
MMSGKALLVAVLLVGVASRCSASRGLQGDHVAEQKYGGGGYGGGGGGYGGGGGGGGYGGGGGGGGGGGGGYGGGGGGYTPGYSGTGTCDYWKSHPDAIISCIGSLGSILGSFGDVCSAFFGSKLQTLQDALCNTRTDCYGDLLREGAAAYLNSIAAKKYAYSTQQVKDCIAVALTSEVAAAAQAAMFKKANFACHYL

SEQ ID NO: 309 - protein, 661 aa, Setaria italica
MARLGALLLVAVAAAAALLCALPGARGFYLPGSYPHKYNPGEPLSVKVNSLTSIDTEMPFSYYSLPFCVPPEGVKDSAENLGELLMGDRIENSPYRFKMYTNESDVFLCRSAPLAPDAFALLKKRIDEMYQVNLILDNLPAIRYTKKDDYFLRWTGYPVGIRVGVDYYVFNHLQFTVLVHKYEDANVARVMGAADATDAIPAGGKDGGSSSGWMVVGFEVVPCSIKHNPEDVKSTKMYDRYPSKIKCDPTTVSMSIKENEPIVYTYEVSFVESDIKWPSRWDAYLKMEGAKVHWFSILNSLMVIAFLAGIVFVILLRTVRRDLTKYEELDSEAQAQMNEELSGWKLVVSDVFRAPSNPMLLCVMVGDGVQILGMAVVTILFAALGFMSPASRGTLITGMLFFYLVLGILAGYAGVRVWKTIKCGDHSGWVGVSWRVACFFPGIAFLILTTLNFLLWGSQSTGAIPFSLFVVLLLLWFCISVPLTLVGGFLGAKAPHIEYPVRTNQIPREIPPQRYPSWLLVLGAGTLPFGTLFIELFFIMSSIWMGRVYYVFGFLFIVLLLLVIVCAEVSLVLTYMHLCVEDWKWWWKSFFSSGSVAIYIFLYSINYLVFDLKSLSGPVSATLYIGYSLFMVIAIMLATGTVGFISSFCFVHYLFSSVKAD

SEQ ID NO: 310 - protein, 273 aa, Zea mays
MAMRAATAAATGFFSPSTVPPRRFSSVTPPASLCTARCIQRHRLRAFPSLEIPLEELNPSVDLLRRTAEAVGDFRKTPIYIVGTDCTAKRNIAKLLANSIIYRYLSSEELLEDVLGGKDALRAFKESDEKGYLEVETEGLKQLTSMGSLVLCCGDGAVMNSTNLGLLRHGVSIWIDVPLEMAANDMLKSTGTQATTDPDSFSQAMSKLRQRYDELKERYGVSDITVSVQNVASQRGYSSIDLVTLEDMVLEIVRQIEKLIRAKEMMEAAGKPF

SEQ ID NO: 311 - protein, 374 aa, Zea mays
MAALINPIYRRLAAFACRRISAPAVEKPVLPLVYHRNLQQRHNSSLVDASGGFSEMLASTRRCYVFGGKGGVGKTSMAASLAVKFANHGEPTAIVSTEPSPSLGDLFEQDMGVGGKTVRITGFDSLFAVEAGQFKIKGEPEDLGSFINNLLGKMGLGTHSDIMSMIREMLDGMPPGLEEALVLSKVIKSIDVQEADILRRLVLDAPSTGHTLKLLSASDWIEMFLTLSIKGIKVASSMPSFNMYLEDVQFISARLEELRQQVRRVREILFDPQSTEFIVVTIPTMMAVTESSRFHESLKKDGAHTRRLVINQVLPPSASDCRFCAAKRREEARAFRAILEDRELGGLKLIQAPLLDMEVKGVPALRFLSDSVWK

SEQ ID NO: 312 - protein, 308 aa, Zea mays
MAAGLSGAAMTGFVAKNPLLAAAARRRALPPLAGRALPFSPLTTARAPRRRGLGTVTCFVPQDTEHPAAAPAPVAPVPETALDEEARAAAARRVAERKARKRSERRTYLVAAVMSSLGVTSMAVAAVYYRFSWQMEGGAVPVSEMFGTFALSVGAAVGMEFWARWAHRALWHASLWHMHESHHRPREGPFELNDVFAIVNAVPAISLLAYGFFHRGLVPGLCFGAGLGITLFGMAYMFVHDGLVHRRFPVGPIANVPYFRRVAAAHKIHHMDKFEGVPYGLFLGPKELEEVGGLDELEKELARIGRTI

SEQ ID NO: 313 - protein, 487 aa, Zea mays
MLLGSPVKRLLRRAAKRRLEKAELAWLAAAALLLLLLLLLGAASLRCSAAALVAAHGRLWAGGVSIAASADADADHRPVSAPRAAAAGSGGGGEAAAAADDEEEEECDLFDGEWVWAGAGAGGGYPLYHSSDCPFLDVGFRCAENGRPDASYTKWRWQPSRCHLPRFDAKGMLEKLRNKRVVFVGDSIGRNQWESLLCMLSSAVHNKSSIYEVNGSPITKHMGFLIFNFSDYNCTVEYYRSPFIVLQGRAPAGAPEIVRYSIRVDAMDWMSDRGKWKDADVLIFNTGHWWNNEKTIRGGAYFQVGDEVKMGMNVADAYRRSIQTLSDWLRKEVNPSKTHVIYRTYAPVHFRGGDWKTGGSCHLETLPDVMPVKSLDEWADLLQPVDDFLGSNLRSKLAGLDLLNVTRMTAQRKDGHLSVYLSPSGPVPRYKQDCSHWCLPGVPDAWNELLYALVMRRHKKMGQNASLAGARTPNTEEGDGDVFSRPS

SEQ ID NO: 314 - protein, 559 aa, Zea mays
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 315 - protein, 261 aa, Oryza sativa
MAAAALLLAPVAAPWSRVPSAGRRVRCAATAPAPMGEKTEYRDGPVERAFMGLFARKMEKYAVVSSSGGKGKEKKKEKSSRSVWEWDYESFVDVSRRVMVGRTRAQQQEAVREVLLSMLPPGAPEQFKKLFPPTRWACEFNAALTVPFFHWLVGPSEVVEVEVNGVKQKSGVLIKKCRYLENSGCVGMCVNMCKIPTQNFFTNEFGLPLTMNPNFEDMSCEMIYGQVPPPLEEDPASKQPCYANLCSISTPSAPICPKLQT

SEQ ID NO: 316 - protein, 390 aa, Glycine max
MERAEQIGGGKAVATVLAIGTANPPNFILQEDYPDFYFRVTNSDHLHRLKQKFKRICENSKIEKRHIVHTEEYLKQNSDSGTYDGLPLETRQNVPTEQVIKLGMEAASKAIKEWGEPLSEITHLIFYTTSCFGSVPGPDHYLSKQLGLRSTVNRLMLFSHGCHAGGTILRVAKDIAENNPGSRVLAVCSETMFASFRAPSESNVEVLVGQALFGDGAAAVIIGADPKHSIEHPLFELVLASQTTVPDTENAIKGSQQENRLVYYLDKDIPNIVTNNVKKCLVDELGEVGFVDEIDWNKFFYAIHPGGAVIVSGVEEKLGLEKEKLSATWHVLSQHGNMWSPTVIFILDEMRNRSKTEGKSTTGEGLEWGILLGFGPGVAMETVLLRSYPC

SEQ ID NO: 317 - protein, 340 aa, Triticum aestivum
MGVEGCCNKKVMEEEALVKKITGLAAAIGELPSLSPSPAVNALFTELVTSCIPASTVDVDALGPEAQEMRARLIRLCADAEGHLEAHYSDLLAAHDNPLDHLTLFPYFNNYIKLSQLEHGLLARHVPGPAPARVAFLGSGPLPLSSLVLAARHLPDASFDNYDISGEANERASRLVRNDADAGARMAFRTADVADVTTELAGYDVVFLAALVGMAAEEKARLVEHLGRHMAPGAALVVRSAHGARGFLYPVVDPEEIRRGGFEVLTVHHPEDEVINSVIIARKAAAPAAVAADGDVPVNNGGMPAQCAVAVSRPCLGCACELGTRAHQKMKEMAMEEMEA

SEQ ID NO: 318 - protein, 252 aa, Triticum aestivum
MDYHQQQQFLMPPPASLPAQQQQLCAPMMGMDMEMEMEEQLCFVGRGGGGRGAERKRRFTEEQIRSLESMFHAHHAKLEPREKAELARELGLQPRQVAIWFQNKRARWRSKQLEHDFAALRADYDALHSRVESLKQEKLALAAQLQELSERLRERDGGGGGAATATASSSSCNGGGRELDDDKRNVVDVEPPESCVLGGTACGTPADVSASVESECDDHLHYDGAVFPESFCATPELWEPWPWPPVEWNAVA

SEQ ID NO: 319 - protein, 124 aa, Hordeum vulgare
LQGRAGSRPAAVSPLFAELAAGGVDVVPVALHLAVDMFHGTTAGGRKMLDPLYLLMNPVPSYLVQFLDPVECGGQEARAVANEVQRRVAEALGYERTGLTRRDKYLILAGNEGVVGAHDGGMKN

SEQ ID NO: 320 - protein, 414 aa, Hordeum vulgare
GDSPPPLPDNLRCRRSDGKKWRCSARALPTVSFCEYHYAKASKGKKPPADGEVLAVALQRQKKNKRKGRKRLNLAPESPKATRDLPNGLMTISPGSSGPLGSPVTTKVGVDIPAPLRRCYRSKNAEPVPVGPVKVVPHAMSKAKAAQMSCHRCGLKKVARVVKCKNCENKYFCNSCINKWYSGMSRNDIKIQCPVCRGCCDCKKCTLGQTKGGMRKESPGGQGKLIRIKICNHQFYKLLPLKLDQEQLDELEIEAKIQGTKLSNVRVQVAEDDQSGSLYCNNCKLSVHQALRSCPRCPFKLCLSCCQKIREGSMSGSTPEDKFTQRLLQQESAHEDGSISCPSIELGGCGDSLLNLIYTSPSDDQSGELSSGDELDAPGNDSGVKDAQDHSSPLAESNGSLARLSGGQQESMST

SEQ ID NO: 321 - protein, 258 aa, Hordeum vulgare
TDGLIRIKVGLSGILMVKGSPYSHMNQVRENEEMHGTLLSENIIGVIHDHYVTFRLDMDVDGADNSFVRVDMARQDTAPGESPRRSYLKATRHVASTEKDAKVRLKLYEPAEFHVINPTKKTRVGNPVGYKVVPAGTAASLLDPEDPPQKRGAFTNNQIWVTPYNKSEEWAGGLFVYQSKGEDTLATWSERDRPIENKDLVLWYTLGFHHIPCQEDFPIMPTVSSSFDLKPVNFFESNPILKQRPTMEKDLPVCVATA

SEQ ID NO: 322 - protein, 457 aa, Hordeum vulgare
ARGRAMLLGVERRRKDDGVEGRQQEEEEEEEYGAVPMASVRSDDDARRGGSVCEEYKDVDVVSTMSGSSSSLDTGSGHRSRDSHSMGSRFRVPEEDSCDSESVASNFEFHKERGASARSAPTAVVAPFSKPPPSKWDDAQKWIASPATNRPGRAGGAFPRKMEKTGFGGGRLPPTKVVPEPYPEVEPCAKSAPGAESTIIDSAVTLSCDSSTTLHSATACIPPPPTGRSVSMRDMGTEMTPIASQEPSRTGTPVRATSPDCSRPTTPRRTLGINAAGGVINRGECSNADLSEEELQMKTRREIMLLGTQLGKTSIAAWASKKEEEKDASLSLKTVSSDQSAQNATEIRAAAWEEAEKAKYLARFKREEIKIHAWEDHQKAKIEAEMRKIEVEVERMRARAQDKLMSKLASTRHTADEQRAAAESKRDQSAARTAEQAEHIRRTGRMPPSLGCWNWCS

SEQ ID NO: 323 - protein, 118 aa, Hordeum vulgare
RHEGCLRSPRCRRPCRARAGCISITASLDLTEDNVRQAIVDAKAELAQLFDTSVGITGQVDLAELDGPFVKLRLKGKFWHTRATVVARIGNYLKNRIPEILEVEIEDEDQLDDSPAAY

SEQ ID NO: 324 - protein, 150 aa, Hordeum vulgare
TRPHYSPAKLPITSDVPEGCVIIREHVPISNLFTCLWFNEVDRFTARDQISFSTVRDKIRSKVGWMPQMFLDCERRNFVVQAYHRELLEQMIASGRNTPPTAVEPSRKIRPGGSRRAPPSKKPVVKRKKEKKSSSRRRVPKPVTWAMDAV

SEQ ID NO: 325 - protein, 63 aa, Hordeum vulgare
ANPLSFLAEQAGGRGSDGKTRILSIQPVKLHQRLPLFLGSMEDMLELESYGDVQQKVNPGYDV

SEQ ID NO: 326 - protein, 388 aa, Brachypodium distachyon
MTSASAQFAPAPLRMGMYERPPPQQPMPPSPQPVVGMWNNSVDTYKVDSGQATSGSTIMEADTKFDDAELEEVPGMEELEPTRDVDQEASKPPDKVLRRLAQNREAARKSRLRKKAYIQQLETSRIKLAQLEQELQRTRQQQGLYPPGHSGMAGFGGVGGVPMDSGVAAFEIEYGHWVDEQNRHTRELRGALQPGQQTTELELRMLVETGLGNYDHLFRIKNLAASADVFCVMYGLWRSPAERFFLWIGGFRPSEVLKVLRPQLEPLTDQQLEQVYHLQQSSTQAEDALSQGMERLQQTLADALTAAADPFASPDGYSGMNDAIGKLKGLVCFLHQADHLRLETLQQMQKILTTRQAARGLLALGDYFERLRALSSLWAARPRESAIS

SEQ ID NO: 327 - protein, 1039 aa, Zea mays
MELALGAMTSLALKLGDLLMEEYVVQKGLKPDIESLSRELVMMNAALIDASRVPPDQLTEVEKLWARKVRDLSYDMEDAVDDFILRVAGGDDSAADSKFFKKTLAMVKDVMSMKKFKDRRQISDKVKDIKKLSNELAELRAKYTVRGVGADLAASTGIDPRVINLYKKETDLVGIKKSRNKVIRMLSMETKDDDALESHQALKIVSIVGVGGLGKTTLAKTVHDMLKKQFDCSAFISIGRTPNLNRTFEKMLLKLDREYKQVDMARWDLEQFKNELDEFLKDKRYLIVVDDIWDVDSWEAIRYALKDNNCGSRIIMTTRNFGIVTKLEEVYRLKPLSNANSKKLFYKRIESQEGESLDGELSSKIIHKCGGIPLAIIAIASLLVERSREEWSEVYDKIGLGNEDNTTKIMSYSYYDLPPYLKPCLLQLSIYPEDCIIDTNSTIWKWIGEGLVHLEKEEGSLFKVGERYFKELVNRSMIQPTEDKNDRFVEGFRIHDIVFDLICKLSKDEDFITISGQHSSRDSLRREKKTCVPRSDCKLRRLAVRNQRVQRFPEETMDMPEVLRSLSIIDCNIAVMAPIDSFRVCRVLHIENNYVPINLKHLGKLLHLKFLQISGTTIDELPREIGHLRSLQTLILADTGLDELPPAVCSLTRLMCLIALEFERLPADRMGNLTSLEELRLHRVVGRSATQALVAELGKLTRLRVVDITFSEQLEESLQEALVQSLSNLRGLQELTLLFKMTRWGSDMWGDWEPPRQLRRLIIEGIIVFSRQPRWINRSCLPRLCYLSLMVHTLEAQDLDNLARLPELQYLTLDGLSWPPRYTVGPDDFRNLRFCKVGTTFEFRKGAMPRLEVLQFGVFAGYYCWAYNGVPFEQFPTKDLDLDLDNVLLLQQVIVKVNCVGATVTQVEEVEAVVMRAVENHANRPTIKMNRAYEIAILSDEGREALLRRHIEKDCCVRTMKDKSDAFFISQLRRYRHLQKAIIFIDCSGASMCEVQKVEAAFRHAAEVHPNHPSIELIRTNTDGMASSSSDHPNTEPRN

SEQ ID NO: 328 - protein, 840 aa, Glycine max
MTTAEEEDDQGKHTTSSSFSSSSSPSSSSDEREYEVQDLRDRLKSSQGSMFNLIENQLGLNSTWSKFSRQALLHGIRGFSMDLVKDFVIHPDNRWYRAWTNFILVWAVYSSFFTPMEFGFFRGLPENLFILDIIGQIAFLVDIVLQFFVAYRDSQTYRMVYKRTPIALRYLKSNFIFDLLGCMPWDIIYKACGRKEEVRYLLWIRLYRVRKVEDFFHKLEKDIRVNYIITRIVKLIVVELYCTHTAACIFYYLATTLPESQEGYTWIGSLKLGDFSYSHFREIDLWKRYTTSLYFAIVTMATVGYGDMHAVNMREMIFIMVYVSFDMILGAYLIGNMTALIVKGSKTEKFRDKMTDLMKYMNRNRLGRDIREQIKGHVRLQYESSYTEASVIQDIPISIRAKISQTLYLPYIEKVSLFKGCSSEFINQIVIRLHEEFFLPGEVIMEQGNVVDQLYFVCHGVLEEVGIAEDGTEETVSLLQPNSSFGEISILCNIPQPYTVRVCELGRLLRLDKQSFTNILDIYFYDGRKVLYNLLEGKESFRDKQLESDITFHLGKQEAELALKVNSAAFNGDMYQLKGLIRAGADPNKADYDGRSPLHLAASRGYEDITIFLIQERVDVNIIDNFGNTPLLEAVKNGHDRVASLLVKEGASMKIENAGSFLCTAVARGDSDYLKRLLSNGMDPNLKDYDYRSPLHVAAAEGLYFMAKLLLEAGASVFTRDRWGNTPLDEARMCGNKNLIKLLEDAKSSQLSEFPSQEFTDKMHPKKCTVFPFHPWDPKDNRRHGIVLWIPHSIEELIKSAAEQIEISGGSCILSEDAGKITDVDMIKDGQKLYLVHETH

SEQ ID NO: 329 - protein, 809 aa, Triticum aestivum
VERAREECRGLIGSAAQKAGGLDTDVPFDGGCRRVFEVAVELSRNMGCSFISPEHLAIALFTLDDPTTNNLLRSLGADPSQLASVAVTRLHEELAKDGRDLAGASSLKVPEKAPAGAGAGRSAFSKSLSKKKDKGALDQFCLDLTTQASGGFIDPIIGREEEIERVVQIICRRTKNNPILLGEAGVGKTAIAEGLALRIANGDVPIFLVAKRIMSLDIGLLIAGAKERGELESRITSLIREVREAGDVILFIDEVHNLVGSGTAGKGKGAGLDISNLLKPPLARGELQCIAATTLDEHRMHFEKDKALNRRFQPVFVDEPSQEDAVKILLGLRENYEAYHKCKFTLEAINAAVYLSARYIPDRQLPDKAIDLIDEAGSRARIESYQKKKEGQSSVLLKEPDEYWQEIKAVQAMHEVVLSNKMKYSPNENKQQNASVNTEAPHQDKAESTIEEPIVVGTEEIARVASLWSGIPVQQLTADDKKILVGLDDELRKRVIGQDDAVAAISRAVKRSRVGLSDPDRPIATMLFCGPTGVGKTELTKALAASYFGSESAMLRLDMSEYMERHTVSKLIGSPPGYVGYGETGTLTEAVRRKPFTVVLLDEIEKAHPDIFNILLQIFEDGHLADSQGRRVSFKNTLIVMTSNVGSTSISNGRRSMGFSTEDTESSRYVAVKSLVMEELKGFFRPELLNRIDETVVFRPLEQTQMLAILDILLEELKGKLLAVGIGLEVSDAMKELICREGYDKNYGARPLRRAITQLMEDVISEAILFGEYKPGDTILVDTDSKGKPCLSRLNQPPIVQVSDSTRTF

SEQ ID NO: 330 - protein, 199 aa, Triticum aestivum
GLITAIDRFEPKRGFRISTYALFWIRHSVVRAMTLSSFTRFPFAMESERQEINRAREELSFELGRAPTDEETMKKVGLSPARYRDVVRMTRPTYSLHSRNRVTQEELIKEVTDVDAIGVDTHKHNRLLRLAIDDLLDSLKPKESVVIRQRFGLDGRGRRTLSEIAGNLRISREMVRKYELKALMKLKHPTRVDYLRRYM

SEQ ID NO: 331 - protein, 128 aa, Setaria italica
GYGGGGGGYTPGYSGTGTCDYWKSHPDAIISCIGSLGSILGSFGDVCSAFFGSKLQTLQDALCNTRTDCYGDLLREGAAAYLNSIAAKKYAYSTQQVKDCIAVALTSEVAAAAQAAMFKKANFACHYL

SEQ ID NO: 332 - protein, 301 aa, Zea mays
MAAGLSGAAMTSFVAKNPLLAAAARRRAPPLAGRALPFSPLASTRAPRRRGLRLRTVTCFVPQDTAAPAAPVPALDEEARAAAARRVAEKEARKRSERRTYLVAAVMSSLGVTSMAVAAVYYRFSWQMEGGEVPVIETLGTFALSVGAAVGMEFWARWAHRALWHASLWHMHESHHRPREGPFELNDVFAIVNAAPAISLLAYGFFHRGIVPGLCFGAGLGITLFGMAYMFVHDGLVHRRFPVGPIADVPYFRRVAASHKIHHMDKFEGVPYGLFLGPKELEEVGGLDELEKELARIGRTI

SEQ ID NO: 333 - protein, 544 aa, Zea mays
MACKLAQCATAAAATVAPRTPRPAASASVSFSARKPAGGSLRLQRQACCEPSVAPSRAVFACRAAASGSAADLASGGRRSSGVPVFVMMPLDTVKECGTALHRRKAVQASLSALKSAGVEGVMVDVWWGIAERDGPGRYNFAGYAELMEMARKAGLKVQAVMSFHQCGGNVGDSVTIPLPRWAAEEMERDQDLCYTDQWGHRNYEYVSLGCDALPVLKGRTPVECYTDFMRAFRDHFADYLGNTIVEIQVGMGPAGELRYPSYPESNGTWKFPGIGAFQCNDRYMRSRLKAAAEAAGKPQWGHGGPTDAGGYNNWPEDTVFFRGDNGGWSTEYGDFFLSWYSQMLLEHGDRILSGAKSVFGAAPVEVSVKVAGIHWHYGSRSHAPELTAGYYNTRRHDGYLTIARLLARHGAVLNFTCVEMRDHEQPQEARCMPEALVRQVGAAARAAGVGLAGENALPRYDGTAHDQVVTTAAERAAEDRMVAFTYLRMGPDLFHPDNWRRFAAFVRRMNGAGSCREAAEREAHGVAQATGSLVHEAAVALRS

SEQ ID NO: 334 - protein, 177 aa, Sorghum bicolor
MSAPNSDSNMQQLVPIAPPGKASGADSGKELVVADPGGKSSGGVKLREDEEDLEVKLRRIMENVPVRVSNTSGSSAGSGSGDFHQYRQMRRREQDRLARMDADYQKRKEMAEFELRREERIKAAEERTAKKRLKRHKKKQRKKEKRAKTGNNGGEDPNRVDSSDDDEGSDDDDKSKQ

SEQ ID NO: 335 - protein, 209 aa, Zea mays
MASSLARLGAALPRARPRAATRTLPPPRWDAAALGASRRAAPNVCRCLVHSDVKVAPTSDFKDSSKSETWRIKMLYDGDCPLCMREVNMLRERNKSYGAIKFVDISSKDYSPDDNQGLDYETSMGRIHAVLSDGTVVTDVEAFRKLYEEVGLGWVYAVTKYEPVASMANAVYGVWAKYRMQITGRPPLEEIMASRRAAGECKDDKVCKM

SEQ ID NO: 336 - protein, 565 aa, Hordeum vulgare
MSKAFTKSLLLYNKILVRRLKSLIPRAPPAPTSATERLPPSHRRESSTAPLDALPAPGTTDDGNNIGGGAGGGTIVCEVEGGLLMSPSTFPYFMLVALEAGGLLRGLLLLLLYPLLRLLTDELAMKAMAMVTFAGLRKDAFGRLGMAVMPKLFLQDVSAEVFHAATSAPTAAAGGARRRRRCVCVSGMPRAMVEPFLKEYLAIDAVVAPELRELGGYYLGLVEDEGEAVRRMDVEEVIGAKGGAVVGIGGLRCSFQHIFQKYCKEVYVPTESTRRRRGALHPRRYPKPLVFHDGRTAFRPTPAATLAMFAWLPLGAPLALLRTAVFLLLPFSLSVPLLAALGMHNRMIASSPPKYAGVDKSKSKSNLFACNHRSLLDPLCVSAAAGRRDLAAATYSISRLSEMLAPIPTFRLTRDRAADRAAMQAQLARRGGRGGLVVCPEGTTCREPFLLRFSPLFAELAAGGVDVVPVALHLAVDMFHGTTAGGRKMLDPLYLLMNPVPSYLVQFLDPVECGGQEARAVANEVQRRVAEALGYERTGLTRRDKYLILAGNEGVVGAHDGGMKN

SEQ ID NO: 337 - protein, 417 aa, Hordeum vulgare
MQMTAAKTDVPAAAAPHPHPHAHGPQVPHGHGHPHPHHHMPQPRWVVLPYPPPPPMVAAPPPPTPQYVKHFAPQASVTPPPPPAGSGGNGGDENRTIWVGDLQYWMDENYLHSCFGPSGEVVTIKVIRNRHSGVSEGYGFVEFYSHASAEKALQNFAGHVMPNTDRAFKLNWASYSVGEKRSELASDHSIFVGDLAVDVTDDMLMELFANKYRSVKGAKVIIDANTGRSRGYGFVRFGDDIDRTHSMTEMNGMYCSTRPIRIGPATPRRTSGDSGTSPTTQSDGDSTNRTVYVGGLDPNVSEDELRKTFAKYGDVASVKIPVGKQCGFVQFINRADAEEALQGLSGSTIGKQAVRLSWGRSPASKQSRGDSGHRRNGMYYGMPFYGGYGYASPVPHPNVYAAAYGAYPFYGNQQLVS

SEQ ID NO: 338 - protein, 661 aa, Hordeum vulgare
MPPRRSKGGAGGQPDSEASDAEPVETAVDAMSEDEADDGNSNEDSAESGADDTDGEASKEEAADTKAEEMDAEHEEEAGATKAEEMVAEPEANGADAGTKVEAAEAKVEEEAAQSDSERKAGAREADPEAEAEETDGENEEQAARTDGGSGEEAAGTVGEDEEEAAGTDGDNAAEVGGENVDADSEAEGEGTDAEPDALEESPPPSPPARSRRRKRVVKPDPPTEDDEEEETPLPSRRRRRRKAGERGDSPPPLPDNLRCRRSDGKKWRCSARALPTVSFCEYHYAKASKGKKPPADGEVLAVALQRQKKNKRKGRKRLNLAPESPKATRDLPNGLMTISPGSSGPLGSPVTTKVGVDIPAPLRRCYRSKNAEPVPVGPVKVVPHAMSKAKAAQMSCHRCGLKKVARVVKCKNCENKYFCNSCINKWYSGMSRNDIKIQCPVCRGCCDCKKCTLGQTKGGMRKESPGGQGKLIRIKICNHQFYKLLPLKLDQEQLDELEIEAKIQGTKLSNVRVQVAEDDQSGSLYCNNCKLSVHQALRSCPRCPFKLCLSCCQKIREGSMSGSTPEDKFTQRLLQQESAHEDGSISCPSIELGGCGDSLLNLIYTSPSDDQSGELSSGDELDAPGNDSGVKDAQDHSSPLAESNGSLARLSGGQQESMST

SEQ ID NO: 339 - protein, 171 aa, Hordeum vulgare
MDAIRLSLLMVAVMAVLSTASAAIYNVGEPGGAWDLSTNYDTWASSRKFQPGDQIVFKYSPQAHDVLEVSKADYDSCSTANPIATLNTGNDIVTLNATGTRYFICGFPGHCTGGMKVKIDVVPGSSSSSPAPASGPSASNAPPPTPVSTANSVEATGFGLAVLLAFAGIMA

SEQ ID NO: 340 - protein, 732 aa, Hordeum vulgare
MDYSTSLLRLTFLALGAALVLLVARSAFRLPLAIDAPAASFLHGAGGCTRFSPWACRPPRTDTSPPRRPSHETDVPRHPLDPLTVTEISRAREILRAHPPFASAPSALVVHALALDEPDKPAVRRWRKGAHALPPRRAVAVVRFRGESHVLALDLATGSVAPLPTPASGYPTMTMDEMTALCAAPFSDPAFNATILRRGVRLSDVACLPISPGWYGPAEDDGGRRLIKSQCYSTEGTANFYMRPIEGLTVLIDMDTGKVVRISDRGAGIPIPAAKNTDYRHAANADKFGYQTVRAPSMEPAPEGPGFEVSDGHTVRWAGWEFHLKADARAGLIVSRATVQDPATGARREVMYKGMASELFVPYMDPTEAWYFKTYMDAGEYGFGLQAMPLVPLNDCPRHARYMDGVFVAADGRPYVRENMICVFERYAGDIAWRHSESPITGMDIRESRAKVTLVARMAASVANYDYIVDWEFQTDGLIRIKVGLSGILMVKGSPYSHMNQVRQNEEMHGTLLSENIIGVIHDHYVTFRLDMDVDGADNSFVRVDMARQDTAPGESPRRSYLKATRHVASTEKDAKVRLKLYEPAEFHVINPTKKTRVGNPVGYKVVPAGTAASLLDPEDPPQKRGAFTNNQIWVTPYNKSEEWAGGLFVYQSKGEDTLATWTERDRPIKNKDLVLWYTLGFHHIPCQEDFPIMPTVSSSFDLKPVNFFESNPILKQRPTMEKDLPVCVATA

SEQ ID NO: 341 - protein, 508 aa, Hordeum vulgare
MDYERIEKPSFPTQGGGFSPKRLRAMLLGVERRRKDDGVEGRQQEEEEEEEYGAVPMASVRSDDDARRGGSVCEEYKDVDVVSTMSGSSSSLDTGSGHRSRDSHSMGSRFRVPEEDSCDSESVASNFEFHKERGASARSAPTAVVAPFSKPPPSKWDDAQKWIASPATNRPGRAGGAFPRKMEKTGFGGGRLPPTKVVLEAMEEIDTKRIDSSQEKREIGWQKAANWATPEPYPEVEPCAKSAPGAESTIIDSAVTLSCDSSTTLHSATACIPPPPTGRSVSMRDMGTEMTPIASQEPSRTGTPVRATSPDCSRPTTPRRTLGINAAGGVINRGECSNADLSEEELQMKTRREIMLLGTQLGKTSIAAWASKKEEEKDASLSLKTVSSDQSAQNATEIRAAAWEEAEKAKYLARFKREEIKIHAWEDHQKAKIEAEMRKIEVEVERMRARAQDKLMSKLASTRHTADEQRAAAESKRDQSAARTAEQAEHIRRTGRMPPSLGCWNWCS

SEQ ID NO: 342 - protein, 157 aa, Hordeum vulgare
MAFAAIHARLAVFPPRLSAAASSLRSAPPRARLPQLRTSAGYRCLRSPRCRRPCRARAGCISITASLDLTEDNVRQAIVDAKAELAQLFDTSVGITGQVDLAELDGPFVKLRLKGKFWHTRATVVARIGNYLKNRIPEILEVEIEDEDQLDDSPAAY

SEQ ID NO: 343 - protein, 404 aa, Hordeum vulgare
MTLSPHTLCPPLLPPLPPSSNRRPPPPRSRPCPRILLPALAGRRSRVLLARPPRAGAGAGDGMASQDAHYPTLLEHMGRAGAPADLAVLVAHIQAACKRIAALVASPGNADLSRAKPAAAAGGASAAGRDAPKPLDELSNEIILSSLQSSGKVAVVASEENDHPVWMCDDGPYVVVTDPLDGSRNIEVSIPTGTIFGIYDRLVELDHLPVEEKAQLNSLQSGSRLVAAGYVLYSSATIFCISFGEGTHGFTLDRSTGEFVLTYPFMQIPPRGQIYSVNDARYFDWPEGLKKYIDTIRQGKGQNPKKYSARYVCSLVADFHRTVIYGGVAMNPRDHLRLVYEANPLSFLAEQAGGRGSDGKTRILSIQPVKLHQRLPLFLGSMEDMLELESYGDVQQKVNPGYDV

SEQ ID NO: 344 - protein, 207 aa, Brachypodium distachyon
MAAEEAKKVEVEVTPEPEAPPAVPAAEPEAPAKDVTEEKAVIPAPAAEEEKPPVDDSKALVVVEKVADEKPADEKAAHGGSNDRDIALARVETEKRNSLIKAWEENEKTKAENKAAKKVSAILSWENTKKANIEAQLRKIEEQLEKKKAEYAEKIKNKAAMIHKEAEEKKAMVEAKRGEEVLKAEEMAAKYRATGNSPKKTMGCFGA

SEQ ID NO: 345 - protein, 227 aa, Brachypodium distachyon
MVRGKTELKRIENTTSRQVTFSKRRNGLLKKAFELSVLCDAEVALVVFSPRGRLYEFASSASLQKTIDRYKAYTKDNVNKKTAQQDIQQIRADTVGLAKKLEALEDSKRKILGENLGECTTQELHILEAKIEKSLHIIRAKKSQLLERQIAKLKEKETMLLKDNEELREKQQHLAALMVVPSLNHVALSPLQPEPEPEPSSDAIDTVETELYIGLPGRERASNRQSG

SEQ ID NO: 346 - protein, 308 aa, Brachypodium distachyon
MAAPRAVPAFESLAGIRPLAESGRFKAWFLDQFGVLHDGKKPYPGAILALEKLAGFGAKMVIISNSSRRASVTMEKLGSLGFDTSCFLAAVTSGELTHQYLQKREDPWFAALGRKCVHLTWGSRGAISLEGLGLQVVSNVDDADFILAHGTEALGLPSGDPLPKSLGELEQVLVLGIQKRLPMVVANPDYVTVEARDLCVMPGTLAAKYESLGGEVKWMGKPDKVIYTSAMSLAGVETHECITVGDSLHHDIKGANGVGMASAFITGGIHASELGLSEFGETAGDDTVSTLCCKHSAYPSYVLPSFTW

SEQ ID NO: 347 - protein, 588 aa, Brachypodium distachyon
MARILSRALPFASHSHLQFSPPIRGAALLSSAPLLPHLPAASTVSLLSWRGFTPTPEPSRSVPPFAGFLAGIRGFRRARRGQAAAKREQAQEDPAPPPPPKESEIELYARIGVDEDLPDDLEVLNIIEILKLNVPMAIKIALDGLLEYNYNTRDTSISDVGKYEKVEVSVLLGNDNFIQNLNKEWRGEDCATDMLSMSQYIPDLDVPILMLGDIAISVETAARQAEERGHTLLDELRTLVVRGLLHLLGFDRQASNEAAVEMEKEELLILKSLRWKGKGFAKSALDLSKPRTETSDGRATNGLKKAGSLRFYRPKFKYIFCDLDGTLLNSKSRVTARNAEALKEARSRGVNIVIATGKTRPAAIDVLNMVGLSGRNGFVSESSPGVFLQGLVVYGLEGQEIYKRNLDQEVCREALLYSLEHKVPLAAFSKDRSFSLFEDPSVDSLHYVYHEPKAEIVSSIDQLLGTAEIQKVLFLGTPEGISTTLRPYWEKAIGERAGVVQGQPDMLELVPPATSKGRGVKMLLDHLCISPDEVMAIGDGENDIEMLQLASLGVAMANGAEKTKAVANVIGATNDEDGVAQAIYDYAF

SEQ ID NO: 348 - protein, 415 aa, Brachypodium distachyon
MELYPGYLEDHFNIHKLSGAGTSPPEYMTSATAQFAPAPLRMGMYERPPPQQPMPPSPQPVVGMWNNSVDTYKVDSGQATSGSTIMEADTKFDDAELEEIPGMEELEPARDVDQEASKPPDKVLRRLAQNREAARKSRLRKKAYIQQLETSRIKLAQLEQELQRTRQQQGVYPPGHSGMAGFGGVGGVPMDSGVAAFEIEYGHWVDEQNRHTRELRGALQPGQQTTELELRMLVETGLGNYDHLFRIKNLAASADVFCVMYGLWRSPAERFFLWIGGFRPSEVLKVLRPQLEPLTDQQLEQVYHLQQSSTQAEDALSQGMERLQQTLADALTAAADPFASPDGYSGMNDAIGKLKGLVCFLHQADHLRLETLQQMQKILTTRQAARGLLALGDYFERLRALSSLWAARPRESAIS

SEQ ID NO: 349 - protein, 222 aa, Setaria italica
MQPPLPLLRCLTASSSSALPLSVLVRKHKLGLLFSTAMDDGVSSQDKKTSPPPAGGVAERIMPHLLNIYGSRATARDFEIYAPNATFEDPLMRAHGVQQIKSSFYTLPKVFGESKIVEYTVHENPTGPGKAEILIDNKQHYKVLGKAVELTTLIRLQVQDGKVVTHEDWWDKKPLKNRDTVGFPLLGRVAEATRRGAMLLTHALMGFGKDPPAHPPPASSSS

SEQ ID NO: 350 - protein, 163 aa, Zea mays
MPHPAPLDVSRRKRKRSSDKAERHRSVSLLNSRSLARSKRKKLAFIMASLAFGSTVAAAVAATSGRTRPARRSVLVVPPAASRGGPAPAKEEKGLGETIFGFIFKKDQLVETDPLLNKVGAAPAAASRAKTTAGKKAAGGDDSGSGGGFNLGGLGGLFAKKSS

SEQ ID NO: 351 - protein, 296 aa, Zea mays
MSPPSVMGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGARNFRVMKSFNQQAGIQGGLGGAAFPSHATFPHYAIPQGLPFHVYGYSPYTPDYGYPTNFYNIYGGAQYPFYGGATAGMVTGTSPFYPYFQFGQSGNTTTNYTSGQGYNLQQYPQMFHFSTVSSTAAAVTGFAQQYGGPLSLAASPQAQAGMTMALTAPTLPTPTQAAHPYRLIPSHFAVSAAPEQPLA

SEQ ID NO: 352 - protein, 290 aa, Zea mays
MAASALLLSPRLVSFPPHPSLAPLFTKRPPPYPLGGAGARLRAVGDGPGAGLPPEQATVYDGAYGPWTLEDSDVREVLLYRSGLVTAAASFVAAASAAFLPEGNPAASAVTGAADLLYAAGAAGLGLSLVLIHIYVTPIKRFLQALWAAGALGSVGTYLVAARPLDEGLVQYVLDHPAALWFVGPTFAALTGLVFKEGLCYGKLEAGILTFLIPGLLLGHLSGLMDNSTKAGLLGLWMLLFTIFAARKFQQPIKDDVGDKSVFMFNALPEEEKKAWIQKLERQKGQELFE

SEQ ID NO: 353 - protein, 449 aa, Zea mays
MAAGGRSIACFAAVLLAAALLLSAPTTTEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFFTADGRRVTQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKEYWRVKITITNFNFRMNYTQWNLVAQHPNFDNITQLFSFNYKPLTPYGGGINDTAMFWGVKFYNDLLMQAGKLGNVQSELLLRKDSRTFTFEKGWAFPRRVYFNGDNCVMPSPENYPWLPNASPLTKQPLTLPLLIFWVALAALLAYA

SEQ ID NO: 354 - protein, 520 aa, Zea mays
MEMVECSLVATLAPRPLPGQVRKALPRPAAFGARARLRVRSVGREEPLHPQQTAVRASGPDHGGRALGQAAVGFAAAAVVSLTGFSGDVSPLPTPPARAESLTVAFPVSKAREVNRVQRTLVETWGLIRETFVDPTFNHQDWDQKLQQTMVEIFPLKSADAAYSKISGMLSTLGDPFTRIISPKEYQSFRIGSDGNVQGVGVFINKEPSSGRLLVMDCIQGGPADRAGIHEGDELVEIDGKSVSGLDGEAAAQRLRGRVGTTVKVKLLDGTDDERGGGLRQKEVQLSREIINLSPLSTAIISHRTDDGHECKTGYVRLASFYQTAAAEMENAVKRMEDIGVQSYILDLRNNPGGLVKAGLDVAQIWLDGDETLVNTIDREGNVLPINMIQGHSLTHDPLVVLVNEGSASASEILAGALHDNGRAILVGHRTFGKGKIQSVTELDDGSALFITVAKYLSPALHEIDQVGIQPDIQCSPDILSLPTAPSLRENSNATNLEMDSCIMVAEQALEIQQSKGSAS

SEQ ID NO: 355 - protein, 760 aa, Zea mays
MAHEREPLLQQRQTGVGNACGAKGSSSAPAPSAAALPSLARTVLKFLMWAVFLTWAAGIFLYPTKPVQAVFRKWVGLTRDSMFGIVGGIFLTFSAPILIIALLAYVYISFFPSEHVVEKRKLRSLSFRLWTFPVLVDGPFGVVSAVEFIGIVLFIVFVVYSMTYYAVDAVSLVSKFDIPSMTESELILDVIGLRLGAVGLFCMLFLFLPVARGSVLLRLIDIPFEHATRYHVWLGHLTMALFTLHGLFYVISWSMQGRLREELRQWKEIGVANLPGVISLAAGLLMWVTSLHPVRKRFFELFFYTHQLYVVFIVFLAFHVGDFIFSICAGAVFLFMLDRFLRFWQSRAKVDIISAACRPCGTVELVFSKPASLHYNALSFIFIQVRELSFLQWHPFSVSSSPMDGRYHMSVLIKVLGTWTEKLRSIITDVQEKNGGDSELQCGRMTACVEGPYGHESPYHLMYENLVLVAGGIGISPFLAILSDIIHRIEEGKQCMPKNVLVLWSVKKSKELSLLSAVDAQTISSSVSDRLQLDIQAFVTQEPHPPLEDGIVGDDQKVPGMFVKNGTAMSGLVGTGDNFWAAMYFLASTLGFLLAYALVQVYYVKPHNVVAWWYLGLLFMLCMVAGVALPGGLVVLLWHLSEKQRLEDDKWDASQSPRAEQTGPLAAAGGGDDDAAPSVSLAALRTTRYGCRPNFEAEFAAFAERAGDAADVGVLVCGPQGLQTSVARECRARNLRRGGVGAAKSRSGAVFHFNSHSFDL

SEQ ID NO: 356 - protein, 172 aa, Sorghum bicolor
MAPAATGVGSLAAAPVAKGYTTYRKAAARSVVRLGLPALPPLPGLRLAAQGQASFCKRLARNVVAMATGEPTAAPVADNEELTEFVNALKKEWDRIEDKYAVTTLAVAATLAMWSAGGVVSAIDRLPLIPGLMEAVGIGYSGWFAYRNLLFKSDRDAFFAKVREVYEDIIRS

SEQ ID NO: 357 - protein, 232 aa, Sorghum bicolor
MMWSHEPAAEQKAAAAAATRQRSSMAKLTTASSSSLANLLSVFVGANNSNSSADPTPPPRRSFDEGGGVGLGIVAAMSHACLTGAGAGVGAEPIAIGAAARRRRAREEDESYTCVITHVAGAGGGSVRKRVYFGFGDGGGWLVEADDEAPAPAPDFLSRCCLCDKRLDGLDIYMYRGEKAFCSSECRCQQMLMDDRADKCGSEALIRSGGDYSYSVSPHSTPMAFSPSVAAA

SEQ ID NO: 358 - protein, 560 aa, Sorghum bicolor
MDKLGTNPANSCPLTPLGFLERTATVFGDCPSVVYHDTVYTWSQTHRRCLRLASALVSLGVSRGDIVSVLLPNVPAMYEMHFGVPMSGAVLNTINTRLDARTVAVLLRHSGSKLVFADPASVPLVRDALRQLPPGHRAPRVVPVEDPHEKEFPAAPPGTLTYEALLDRGDPEFAWVRPRSEWDPMILNYTSGTTSAPKGVVHCHRGIFLVTVDTLVEWAVPKQPTYLWTLPMFHANGWCFPWGMAAVGGTNVCLRRVHAAEVYATIARRGVDHLCGAPVVLNMLANAPDAARRPLPGKVRILTAGAPPPAAVLHRTESIGFEVTHGYGLTETAGLVVSCAWKGEWNKLPASERARLKARQGVRTPAMAEVDIVDGETGHSVPRDGSTMGDIVLRGGCVMLGYLNDDTATRAAIRDNGWFYTGDVGVMHPDGYMEIRDRSKDVIISGGENISSVEVESVLYNHPAVNEAAVVARPDEFWGETPCAFVSLKEERSGSPGAVTAADVIAWCRDRMPHYMVPKTVVLRAELPKTSTGKIQKYVLRNLAKDMGPTRKGASSSSRM

SEQ ID NO: 359 - protein, 372 aa, Glycine max
MATTSASFASFSVILRPSSSNPQFFLFNVAPRTGTSHSRTRSARFRCSAGQTGFFTKLGRLIKEKAKSDVEKLFSGFSKTRSNLAVIDELLLYWNLADTDRVLDELEEALLVSDFGPRITIKIVENLREDIFSGKLKSGNEIKEALKRNVLELLTSKGSKTELQLGYRKPAVIMIVGVNGGGKTTSLGKLAYRLKNEGAKILMAAGDTFRAAASDQLEIWAGRTGCEIVVAESEKAKASSVLSQAVKKGKELGFDIVLCDTSGRLHTNYSLMEELISCKKSVAKVIPGAPNEILLVLDGTTGLNMLPQAREFNDVVGVTGLILTKLDGSARGGCVVSVVDELGIPVKFVGVGEGVEDLQPFDAEAFVNAIFI

SEQ ID NO: 360 - protein, 492 aa, Triticum aestivum
MTSTVTTPTPSRPLPAGPQRRRYRPTVLAIAGGSKPPRRRAPAAATSCVALAAPEKQSTAPSKLPAPSPAPEGTDYDEVAATLETLYKLSPVIVEEDGKSSKKQAATKKKRKQGRAKSAATTATAATPRRTVVVRSQRRRRMDLGKRVEMRDQAAGKEDEHRDGERAFEEALLREHAVSTDMGSLDWRRMKIPPVLSAVQSARLFKIMQPMKAILEVQENLRNELQSEPTDAEVAEAMNMPVQRLRRLRDVGRAARNKLIKHNLRLVLYAINKYYPDMTVDERFADLCQASANGLITAIDRFEPKRGFRISTYALFWIRHSVVRAMTLSSFTRFSFAMESERQEINRAREELSFELGRAPTDEETMKKVGLSPARYRDVVRMTRPTYSLHSRNRVTQEELIKEVTDVDAIGVDTHKHNRLLRLAIDDLLDSLKPKESVVIRQRFGLDGRGRRTLSEIAGNLRISREMVRKYELKALMKLKHPTRVDYLRRYM

SEQ ID NO: 361 - protein, 773 aa, Triticum aestivum
MGTSGSKGLDGVGGLGAAALGGGSGGGMGGDEGDGAVTGSWHGGAQLYVSLKMEKARIIGDLVPHVYGSEPIIGSWEPARALAMERELASMWELSFVVPPDHETLDFKFLLKPKDAETPCIIEEGPTRLLTGGMLEGDVRLANFRLNGDDELLEFRVFNKADIVSPLDLAASWRVYKENFQPSKVRGIPDISINEAPTHATEDGSGSSLELDLEHYVVPTPTAPPTEYAANLAATPASLDQPETPWTNDMLLSDGIQSPRSAAADFKDDSYHNKDTEASIADSSNSKKLQVSGMVESKSVGTLIQLQKKDMPQGLYVDRGVVSPKLGKSFSACSLASGLNFGSTKAMPEAAGAVAAAAVADRLHGSKEDRKLAIVLVGLPARGKTFTAVKLTRYLRWLGHETKHFNVGKYRRLKHGANQSADFFRPDNQEGIEARNEVAALAMEDMIDWMHGGGQVGIFDATNSTRKRRYMLMKMAEGNCKIIFLETICNDRNIIERNVRLKIQQSPDYADQPDYEAGLQDFLERLTNYEKVYEPVQEGSYIKMIDMVKGEGGQLQVNNISGYLPGRIVFFLVNSHLAPRPILLTRHGESLHNVRGRVGGDTVLSEDGELYSKKLANFIEKRLKNEKTATIWTSTLQRTILTATPIVGFPKIQWRALDEINSGVCDGMTYEEIKKIMPEEYESRKKDKLRYRYPRGESYLDVIQRLEPVIIELERQRAPVVVISHQAVLRALYSYFADRPLREVPDMEMPLHTIIEIQMGVTGVEEKRYKLMD

SEQ ID NO: 362 - protein, 396 aa, Triticum aestivum
MERSWFGWRKAKQGGGGGAGGGGGEKEEDQAKVVVDGSGIRELVEDREAFGMFAESKFRQLDADGDGRLSVRELQPAVADIGASLGLPAQGSSPNADHIYSEAMSEFTHGHGNQEGVSRAEFQEVLSDILLGMAAGLKKDPIVILRIDGEDLRDFVSSPRYEPAVAAIFSQVVSGDLSLRQCLLAAVQQLGVDHGMPPAADPWVVENVVEPALQQLSADELEQPSSRDVFFEQLKKLLGSVADQLQERHVIVAHTENTFDGSGVRRLLGNKFELDKLLDSVWRDVPAEHRKKAPKGKEHLRVALDKMADAASLPPHGAVAQVDAVVDEALKVADAGDGKAVEEAEFKKLLTEVLGAVMLRLSGQPIFFSTSTVVHEPLSTSATLLPSPAAASPPSE

SEQ ID NO: 363 - protein, 403 aa, Triticum aestivum
MELAATSAAALRRSLASGYPVVPRERRSGMPARVSCVGRGGRGVGGGFADEAHLRYYEAPRKAVEAAARDLTKLRAMGLVAGDPAKEKILSEATELLLQELNQMKDAEDELKKKQKEEKAAMKALKKQQKEAKKAAMNCGDGSSESSESECEEGQSMKMRCVATTSVPAVEQGMVMSMSVPQIAASNIATAPAMDFDKAAMKAMKKREKEQKKAAKKAMKMKKEEEKRMATLNSCKDEDSSCSSESSNSECEGEVVRMSCCATISAPRTPPASTVFPIIVPQIPDSVALDAQIFSGSANAMQCTATSIAVVEKPVLNRIEVCMGGKCKKAGSLAVLQEFETEVGTGGMVVGCKCLGKCRLGPNVRLRSEGSVQKNSPICIGVGLDDVGTIVAGFIGDGDVGMN

SEQ ID NO: 364 - protein, 423 aa, Brachypodium distachyon
MSAAATAATSGPNSILLHRPTSAGPAVASSIRLPARASKVSCAAVAAPSSPHALTGAGERGVYNFAAGPATLPLSVLQKAQAELVDYRGSGMSIMEMSHRGKEFDAAIKKAEADLRALLAVPDTHEVLFLQGGATTQFAAVPLNLCAGASDPVDFVVSGSWSDKAFKEAKKYSAASVAWSGKDGKYTALPQFDAIKQNPEARFLHICSNETIHGVEFKDYPEPKNKSGILVADMSSNFCSKPVDVSRFGIIYAGAQKNVGPSGVTIAIVRKDLVGNAQPITPVMLDYKTHADNASLYNTPPCFAIYICGLVFEDLLAQGGLAEVEKKNEHKAGILYDTIDASGGYFICPVEKSVRSLMNVPFTLAKGADFEKQFIAEAAKEGMLQLKGHRSVGGVRASIYNAMPLSGVEKLVTFMKDFQARNS

SEQ ID NO: 365 - protein, 924 aa, Brachypodium distachyon
MESHDGVADDLPPPPPLPPSIEPLKPEEADDLPPPPPLPPNVEPIKVEDAKKPRRTLISRPGFGKNGKPIQLVTNHFKVSLKTTDEFFHHYYVNLKYEDDRPVDGKGVGRKVIDKLQQTYASELAHKDFAYDGEKSLFTIGALPQVNNEFVVVLEDVSSGKTAANGSPGNDNSPGSDRKRVRRPYQTKTFKVELNFASRIPMSSIAMALQGQESEHTQEAIRVIDIILRQHAAKQGCLLVRQSFFHNNPSQFVDLGGGVMGCRGFHSSFRATKSGLSLNIDVSTTMIVKPGAVVDFLIANQKVDHPNKIDWAKAKRALKNLRIKTSPANTEFKIVGLSERNCYEQMFSLKQRNNGNGDSEAIEISVYDYFVKNRGIELRYSGDFPCINVGKPKRPTYFPIELCSLVPLQRYTKSLSTLQRSSLVEKSRQKPQERMSVLSDVLKRSSYDTDPMLKACGISIAQGFTQVPGRVLQPPKLKAGNGEDIFTRNGRWNFNNKRLVRASCVERWAVVNFSARCNCNDLVRDLIKCGGMKGIKVDQPFDVFEENSSMRRAPAPKRVEAMFETVKTKLPGAPKFLLCILAERKNSDVYGPWKRKCLAEFGIVTQCVAPTRVNDQYLTNVLLKINAKLGGMNSLLQIELSPAIPLVSKVPTMILGMDVSHGSPGQADTPSIAAVVSSREWPLVSKYRASVRSQSPKSEMIDSLFKPQGTEDDGLIRECLIDFYTSSGKRKPDQIIIFRDGVSESQFTQVLNKELDQINEACKFLDESWSPKFTLIVAQKNHHTKFFIPGSPDNVPPGTVIDNVVCHPKNYDFYMCAHAGMIGTTRPTHYHILHDDIHFTADDLQDLVHSLSYVYQRSTTAISVVSPICYAHLAAAQVSQFVKFDEMSETSSSQGGGGHTSAGSTPVQELPRLHEKVRSSMFFC

SEQ ID NO: 366 - protein, 340 aa, Triticum aestivum
MGVEGCCNKKVMEEEALVKKITGLAAAIGELPSLSPSPAVNALFTELVTSCIPASTVDVDALGPEAQEMRARLIRLCADAEGHLEAHYSDLLAAHDNPLAHLTLFPYFNNYIKLSQLEHGLLARHVPGPAPARVAFLGSGPLPLSSLVLAARHLPDASFDNYDISGEANERASRLVRNDADAGARMAFRTADVADVTTELAGYDVVFLAALVGMAAEEKARLVEHLGRHMAPGAALVVRSAHGARGFLYPVVDPEEIRRGGFEVLTVHHPEDEVINSVIIARKAAAPAAVAADGDVPVNNGGMPAQCAVAVSRPCLGCACELGTRAHQKMKEMAMEEMEA

SEQ ID NO: 367 - DNA, 2259 bp, Sorghum bicolor
cacctgcgacgcttgtcttcatcgacctctcgatccattgagtttactaataaattcttgttgggatatattcctccatttcccctcctcctcccaacaacaatctggtcgatctctcccgccaaacccaaaaccccccaaaaaaaaaaaacacccaacccaatccgatcccatagaaactctctcagtttcagttcgatcgatcgctcccgtctcgatcgtttgcacaaaaacatggccttcaacctggctcagtgcgccaccgctgcggcgtccgtcgcgccccgcacccctcgccctgctaggtccgcggtcgcggcgtccgtgtctgtctccacaaggaaggcggcggacggcaggctgcggctgcagcggcaggcgagctgcgagccgtcggtggcgccgtcgcgttcggtgttctgccgggccgcggtgtcggggaagagcgcggccgaccgggccgcctccaccaggaggaggtccggcgtgccggtgttcgtcatgatgccgctggacaccgtgaagaagtgcggcagcgcgctgaaccgccgcaaggcggtgcaggcgagcctgtccgcgctcaagagcgcgggcgtggagggcatcatggtggacgtgtggtggggcatcgccgagagcgacggccccgggaggtacaacttcgcggggtacatggagctcatggagatggcgcgcaaggccgggctcaaggtgcaggccgtcatgtccttccaccagtgcggcggcaacgtcggcgactccgtcaacatcccgctgccgcggtgggccgtggaggagatggagaaggaccaggacctctgctacaccgaccagtggggccgacgcaactacgagtacgtctccctcggctgcgacgccatgcccgtcctcaagggccgcacccccgtcgagtgctacaccgacttcatgcgcgcgttccgggaccacttcgccgactacctcggcaacaccatcgtggaaatccaggtcggcatgggccccgccggcgagctgcgctacccgtcgtacccggagagcaacggcacctggaagttccccggcatcggcgccttccaatgcaacgacaggcacatgcgtagcagcctgaaggcggcggcggaggcggccggcaagccggagtggggccacggtggccccacggacgctggcggctacaacaactggcccgaggacaccctcttcttccgcgccgacaacggcgggtggagcacccagtacggcgacttcttcctgtcgtggtactcgcagatgctgctggagcacggcgaccgcatcctgtcgggcgccacgtccgtgttcggcgcgtcgtcgcccgtggaggtgtccgtgaaggtggccggcatccactggcactacggcacccggtcgcacgcgccggagctgaccgcggggtactacaacacgcggcaccacgacgggtaccgccccatcgcggacctcctggcccgccacggcgccgtgctcaacttcacctgcgtggagatgcgggaccacgagcagccgcaggaggcgcagtgcatgccggagcacctggtccggcaggtgggcgccgcggcgcgcgcagcgggcgtgggcctcgcgggcgagaacgcgctgcccaggtacgacggcacggcgcacgaccaggtggtagccaccgccgcgcagcgcgccgccgaggaccggatggtggcgttcacgtacctgcgcatggggcccgacctcttccacccggacaactggcagcggttcgccgccttcgtgcgccgcatgaacggcgccgggtcgtgccgggaggccgcggagcgggaggcgcacggcgtcgcgcaggcaaccgggtcgctggtgcacgaggccgccgtcgcgctgcggagctgacccccaccggaagccgcctgcgatggatttgattgtgtaggggttgggagctcgggttcttgttgggtttttccttttggggtggggagagaggagagggagcgctgccgagagcgagcagagactctcgtgcagctcatcccgcgtagacgacgagattgtgacgaagccggggaaaagggaggggaggacaaaagattgttttttttttgtcacgtttcaggctccgaccatcaccggagtttgttcggggaatatatccatgcatttcctgcagaaatccgcagaaaatgccgtacgtgtgtcctgcactggctgattcggtgctgcttccatttcagtctactcctactcttctcctctcatctgctctgctgtggc

SEQ ID NO: 368 - DNA, 3058 bp, Sorghum bicolor
ctttcaccatggcgcagcacgccagcacgtgtccccgactatcccgcccggccattccctgtcctccccatcgtcccgtcccgtcccgtccacacaagccctcctcggccatcacccacgtgtcgtgctcgcccttgctcgtgatcaccacccgtcttctcctatataaacagcaacacctgcgacgcttgtcttcatcgacctctcgatccattgagtttactaataaattcttgttgggatatattcctccatttcccctcctcctcccaacaacaatctggtcgatctctcccgccaaacccaaaaccccccaaaaaaaaaaaacacccaacccaatccgatcccatagaaactctctcagtttcagttcgatcgatcgctcccgtctcgatcgtttgcacaaaaacatggccttcaacctggctcagtgcgccaccgctgcggcgtccgtcgcgccccgcacccctcgccctgctaggtccgcggtcgcggcgtccgtgtctgtctccacaaggaaggcggcggacggcaggctgcggctgcagcggcaggcgagctgcgagccgtcggtggcgccgtcgcgttcggtgttctgccgggccgcggtgtcggggaagagcgcggccgaccgggccgcctccaccaggaggaggtccggcgtgccggtgttcgtcatgatgccgctggacaccgtgaagaagtgcggcagcgcgctgaaccgccgcaaggcggtgcaggcgagcctgtccgcgctcaagagcgcgggcgtggagggcatcatggtggacgtgtggtggggcatcgccgagagcgacggccccgggaggtacaacttcgcggggtacatggagctcatggagatggcgcgcaaggccgggctcaaggtgcaggccgtcatgtccttccaccagtgcggcggcaacgtcggcgactccgtcaacatcccgctgccgcggtgggccgtggaggagatggagaaggaccaggacctctgctacaccgaccagtggggccgacgcaactacgagtacgtctccctcggctgcgacgccatgcccgtcctcaagggccgcacccccgtcgagtgctacaccgacttcatgcgcgcgttccgggaccacttcgccgactacctcggcaacaccatcgtggaaatccaggtcggcatgggccccgccggcgagctgcgctacccgtcgtacccggagagcaacggcacctggaagttccccggcatcggcgccttccaatgcaacgacaggcacatgcgtagcagcctgaaggcggcggcggaggcggccggcaagccggagtggggccacggtggccccacggacgctggcggctacaacaactggcccgaggacaccctcttcttccgcgccgacaacggcgggtggagcacccagtacggcgacttcttcctgtcgtggtactcgcagatgctgctggagcacggcgaccgcatcctgtcgggcgccacgtccgtgttcggcgcgtcgtcgcccgtggaggtgtccgtgaaggtggccggcatccactggcactacggcacccggtcgcacgcgccggagctgaccgcggggtactacaacacgcggcaccacgacgggtaccgccccatcgcggacctcctggcccgccacggcgccgtgctcaacttcacctgcgtggagatgcgggaccacgagcagccgcaggaggcgcagtgcatgccggagcacctggtccggcaggtgggcgccgcggcgcgcgcagcgggcgtgggcctcgcgggcgagaacgcgctgcccaggtacgacggcacggcgcacgaccaggtggtagccaccgccgcgcagcgcgccgccgaggaccggatggtggcgttcacgtacctgcgcatggggcccgacctcttccacccggacaactggcagcggttcgccgccttcgtgcgccgcatgaacggcgccgggtcgtgccgggaggccgcggagcgggaggcgcacggcgtcgcgcaggcaaccgggtcgctggtgcacgaggccgccgtcgcgctgcggagctgacccccaccggaagccgcctgcgatggatttgatgtacatacaggggttgggacttgggagggagctcaggttcttgttgggttttcctttgggtggagagcgagggagcgcagtcgacagccagcgagcagtctctcgtgcagtgcagtcccgcgtagacgacgagattgtgacgaagccggggaaaagggaggggaggacaaaagattgttttttttttgtcacgtttcaggctccgaccatcaccggagtttgttcggggaatatatccatgcatttcctgcagaaatccgcagaaaatgccgtacgtgtgtcctgcactggctgattcggtgctgcttccatttcagtctactcctactcttctcctctcatctgctctgctgtggccggctctgacaggctgcttgaggtcgacggcctgtgtttgagccggccgcagccctttttatggatgtctgtaaatcagtatttctaacagaagttacattgcatccatttcaaaatgagtccacaagatgcatgttaatagtgaccagtagaattgttaggattgtccatgtagaaacagtgcaaaatttacacatatatggattgatcatccaaggggattattttgtttccagacgaggcgaaaagggagctacagagatgttgggacgtattcagatagatcaacgaaagacagtcatcctcgtgaggaagacacgaagggaacgtactcctaagcttccgttgctagaaaatttcatataaaaccgcgtccaagtttgtccactgcgtgcatgactttgataaatttagggcattgtgtgtgggttttttttgttcgcttggctgataagtcatgattgaaagtattattcgttgattgataaatttagctgataattttaaacgaataagtttttttttcgaaagatccggaatcccggctttcattaataaaagcttgaaggtgtaattacaagaaagaggctttcatggcacagattgggtcagcc

SEQ ID NO: 369 - DNA, 2331 bp, Setaria italica
ccctcgcctcctatttgaacagcaccacctgcgacgcttacctccatcgacctccacccattgaattttaataaattcttgttgggatatattcccccaatttcccctcctcctcccaacaatctggtcgatcactcccgcgccaaaaccaaaacaaaaaacaaagccgttccgaaatccgatccgatcccacaacaagaaaagaaaagaaaacccaacactttctcacttcgatcgtcgtttggcaatcacccagattgaaaccatggccttcaaccttgctcagagcaccgccgccgcggcgtccgtcgcgccccgcacccctcgccacgcggccgcggcgcccgcgtccgtctccgtgaggaaggcgggcggcgcgccgccatcgtcgagcggcctcaggctgcagcggcaggcgtgctgcgagccgtcggtggcgccggcgcgtccggtggcgtgccgcgccgcggcggcggcggccgagcgcgcctcgaggaggagggcgggcgtgcctgtgttcgtgatgatgccgctcgacaccgtcaagaagtgcggcaccgcgctgaaccggcgcaaggcggtgcaggcgagccttgcggcgctcaagagcgccggcgtggagggcgtcatggtggacgtgtggtggggaatcgccgagagcgacggccccgggaggtacaacttcgcggggtacgcggagctcatggagatggcgcgcaagacggggctcaaggtccaggccgtcatgtccttccaccagtgcggcgggaacgtcggcgactccgtcaacatcccgctgccgcgctgggcgctggaggagatggagaaggaccaggacctctgctacaccgaccagtggggccgccgcaacttcgagtacgtctcgctcggatgcgacgccatgcccgtgctcaagggccgcacgcccgtcgagtgctacaccgacttcatgcgcgccttccgtgaccacttcgccgactacctcggcaacaccatcgtcgaaatccaagtcggcatgggccccgccggcgagctgcgctacccgtcctacccggagagcaacggcacctggaggttccccggcatcggcgccttccaatgcaacgacaggtacatgcttagcagcctgaaggcggcagcggaggcggccggcaagccggagtggggccacggcgggccgacggacgccggcagctacaacaactggccggaggacaccatcttcttccgccgggagaacggcgggtggagcaccgagtacggcgacttcttcctgtcgtggtactcgcagatgctcatggagcacggcgaccgcatcctcaccggcgcgtcgtccgtgttctccgcctcccccgtcgaggtctccgtgaaggtcgccggcatccactggcactacggcacccggtcgcacgcgccggagctcaccgcggggtactacaacacccggcaccacgacgggtacctccccgtggcgcggctgctggcccgccatggcgccgtgctcaacttcacctgcgtcgagatgcgggaccacgagcagccgcaggacgcgcagtgcatgcccgaggcgctggtgcggcaggtgggcgcggcggcgcgcgccgccggcgtgggcctggcgggcgagaacgcgctgccacggtacgacggcgcggcgcacgaccaggtggtgtccacggccgccgagcgcgccgccgaggaccggatggtggcgttcacgtacctgcgcatgggcgccgacctcttccacccggacaactggcaccggttcgccgccttcgtgcgccgcatggacggcgccgggtcgtgccgggaggccgcggagcgggaggcgcgaagcgtcgcgcaggccaccggctcgctggtgcacgaggccgccgtcgcgctgcggagctgacctgaggtttcccatcgctttgtgtaggggttttctttgggagggagggtgctcggaggtcgacggcgagcgatctctcggggtacggttacgcgtagacgagattgtgaccaaggcgggagggaaagggaggggaggacaaaaaaaaatggtgtttttttttgtcacgttctcaggctccgacgatcgtcgccggggcttgttcggggaatatatccagaagtttctgcagaaatccgcagaaaacgctgtgttcttgcactggctgattcggtgctgcttccagtcttctttctcctctcatctgctctgctctgccctgttgcttggccggccgataggctgctagaggtcgacggcccgtgtttgagccggccgcaacatttttatggatgtctgtaaatcactattgcaatagaagtcatattgcattc

SEQ ID NO: 370 - DNA, 2255 bp, Pennisetum glaucum
cagtccctcgccgccagccccacctccatatccgatcgacgacgacccattgaattttaataaaattcctgttgggatatattcccccaattcccctcctcctcccaacaacaatctggtcgatcactcccgcgccaagaaacccaatcaaaaacacaaacccgttccgaaatccgatccgatcccccacacaacaagaaaagaaaagagagagagagaaaaagacccaacacagtttctccgctcgatcgtcgcttgccaacaatcacccagaccggaaaagccatggcctccaacctggctcagagcaccgccgccgcggcgtccttcgctccccgcacccctcgccccgctgccgcggcgccagcgttcgtctccgtgcggaaggcgggcggcgcgccgtcgagcgtcggcctcaggctgcagtggcggcaggcgtgcttcgagccgtcggtagcgccgacgcgtccggtggcggcgtgccgggcggccactgcggccgccgaacgcgcctcgaggaggcgtgcgggcgtgccggtgttcgtgatgatgccgctcgacaccgtcaagaagtgcggcaccgcgctgaaccgtcgcaaggcggtgcaggcgagcctggcggcgctcaagagcgccggcgtggagggcgtcatggtggacgtgtggtggggcatcgccgagagcgacgggcccgggaggtacaacttcgccgggtacgcggagctcgtggagatggcgcgcaagacggggctcaaggtccaggccgtcatgtccttccaccagtgcggcggcaacgtcggcgactccgtcaacgtcccgctgccgcgctgggcggtggaggagatggagaaggaccaggacctctgctacaccgaccagtggggccgccgcaacttcgagtacgtctcgctcgggtgcgacgccatgcccgtcctcaagggccgcacccccgtcgagtgctacaccgacttcatgcgcgccttccgtgaccacttcgccgagtacctcggcaacaccatcgtcgaaatccaagtcggcatgggccccgccggcgagctgcgctacccgtcctacccggagagcaacggcacctggaggttccccggcatcggcgccttccaatgctacgacaggtacatgcttagccgcctgaaggcggcagcggaggcggccggcaagccggagtggggacacggcggtccgaccgacgccggcagctacaacaactggccggaggacaccatcttcttccgccgggagaacggcgggtggagcaccgagtacggcgacttcttcctgtcgtggtactcgcagatgctcctggagcacggcgaccgcatcctcaccggcgcgtcgtccgtgttctccgcctcccccgtcgaggtctccgtgaaggtggccggcatccactggcactacggcacccggtcgcacgcgccggagctcaccgcggggtactacaacacccggcaccacgacgggtacctccccgtggcgcggctgctggcccgccacggcgccgtgctcaacttcacctgcgtggagatgcgggaccacgagcagccgcaggaggcgcagtgcatgcccgaggcgctggtgcggcaggtgggcgcggcggcgcgcgccgccggcgtgggcctggcgggcgagaacgcgctgccgcggtacgacggcgcggcgcacgaccaggtggtggccacggccgccgagcgcgccgccgaggaccggatggtggcgttcacgtacctgcgcatgggcgccgacctcttccacccggacaactggcgccggttcgccgccttcgtgcgccgcatggacggcgccgggtcgtgccgggaggccgcggagcgggaggcgcgcggcgtcgcgcaggccaccgggtcgctggtgcacgaggctgccgtcgcgctgcggagctgacctgaggttgccggtcgctttgtgtagggggttttctttggagcgcgctccgaggtcgacggcgaacgatctctcggggtcggggcagagggggtacgcgtagacgagattgtgaccaaggcgggagggaaagggaggggaggacaaaaaaatggtgtttttttttgtcacgttctcaggctccgacgaccctcgacggagcttgttcggggaatatatccggaagttcctgcagaaaatcggcagaaaacgctgtgttcttgcactggctggtgatccggtgctgcttccagtcttcttcggttcgtcctcctctcatctgctctgctgtgcgc

SEQ ID NO: 371 - DNA, 2287 bp, Panicum virgatum
cccccaattcccctccttctcgtcccaacaacaatctggtcgatcactcccgccaaaaccgaaacgaaaacccagttcagttccatcccaatccgatcccacaaaagcagagaaagaacccaacaccatcccagttcagctcgatcgccgttggccaatcacccagaccggaaggaaacgatggccttcagcgtggctcagagcgccgccgccgctgcggcgtccgtcgcgcccggcacgcctcgacacgcgccggcgcccgcgtcgtccgtctccgtgaggaaagccggcggcgcgccgtcggccagcctcaggctgcagccttcggtgccgccggcgcgtccggtggcgtgccgggcagcggcgggcggcggcggccgagcgcgcctcgaggaggagcgcgggggtgccggtgttcgtcatgatgccgctcgacaccgtcaacaagtgcggcaccgcgctgaaccgccggaaggccgtccaggcgagcctggcggcgctcaagagcgcgggcgtcgagggcgtcatggtggacgtgtggtggggcatcgccgagagcgacggccccgggaggtacaacttcgccgggtacatggagctcatggagatggcgcgcaagacggggctcaaggtccaggccgtcatgtccttccaccagtgcggcggcaacgtcggcgactccgtcaccatcccgctgccgcgctgggtcctggaggagatggaggaggaccgggacctctgctacaccgaccagtggggccgccgcaactgcgagtacgtctccctcggctgcgacgccatgcccgtcctcaagggccgcacccccgtcgagtgctacaccgacttcatgcgcgccttccgcgaccacttcgccgactacctcggcaacaccatcgtcgaaatccaagtcggcatgggccccgccggcgagctgcgctacccgtcctacccggagagcaacggcacctggaggttccccggcatcggcgccttccaatgcaacgacaggtacatgcttagcagcctgaaggaggcggcggcggcggccggcaagccggagtggggccacggcgggccgaccgacgccggcagctacaacaactggccggaggacaccatcttcttccgccgcgagaacggcgggtggagcaccgagtacggcgacttcttcctgtcgtggtactcgcggatgctcctggagcacggcgaccgcgtcctcaccggcgcgacgtccgtgttctcggcctcgcccgtcgcgatctccgtgaaggtggccggcatccactggcactacggcacccggtcgcacgcgccggagctcaccgcggggtactacaacacgcggcaccgcgacgggtacctccccatcgcgcggctgctggcgcgccacggcgccgtgctcaacttcacctgcgtggagatgcgggaccacgagcagccgcgggaggcgcagtgcatgcccgaggcgctggtgcggcaggtgggcgccgcggcgcgcgccgccggcgcgggcctggccggcgagaacgcgctcccccggtacgacggcgcggcgcacgaccaggtggtggccacggccgccgagcgcgccgccgaggaccggatggtggccttcacctacctgcgcatgggcgccgacctcttccacccggacaactggcaccggttcgccgccttcgtgcgccgcatgagcggcgccgggtcgtgccgggaggccgcggagcgggaggcgcgcggcgtggcgcaggccaccgggtcgctggtgcgcgaggccgccgtcgcgctgcggagctgaccgcgaccgaatccgatcgccgctttgtctaggggttgggaagggggagctcggggtttgtcgttttggctttccttgggagggaaacgcgctcggatctcgagagcgggcgatctctcgggcaggttacgcgtagacgagattgtgacgaggccgggaggggatgacaaaaaaaaagatgattttttttttgtcacgttacaggctccgacgatcgccggagcttgttgggggaatatgaccatcgcctgcagaaatccgtagaaaccgctgtgtgcttgcacgaaactggctgattcggtgctgcttcaaacagtcttgtttctcctctcatctgcttctgctctgctgcgcgctgttgcttggccggacgataggctgctagaggtcgacggcctgtgtttgagccggccgtaactttcttttggatgtctgtaaatgactacttcaatagaaaggaaaagtgcattcgttccaatggagtctccaatt

SEQ ID NO: 372 - DNA, 2649 bp, Oryza sativa
tcctcatcgacctccaccccacattgaataattatttttaataattttagttttttttttttggctttagatatattcccaatccccaacctcccaataatccgatctctcccagttctgttcggatcaaggctgtgtcgatcgcaaaaaagaaaaaaaaaacaatttccttttggggtggttcatctgttgatcacttctttgtttcccgcgttttgttggggattcgattttcgggttaagattttctacacgatggccttgaacttggctcagagcgccgcggcggcagcgtgcttcgcgaccgccggtgatgcgcggcgagctgcttcggtggtcgccatgccgtcgtcgtcgtcgtcggccacgacgagcctgaggatgaagaggcaggcggcgtgcgagccggtggcgtgccgggcggtggccaggcacgtggcggcggcggcggcgagcagcaggaggaacggcgtgccggtgttcgtgatgatgccgctggacacggtgagcaagtgcgggagcgcgctgaaccggaggaaggcggtggcggcgagcctggcggcgctgaagagcgccggcgtggaggggatcatggtggacgtgtggtggggcatcgtggagagcgagggccccggccggtacaacttcgacggctacgtggagctcatggagatggcccgcaagaccggcctcaaggtccaggccgtcatgtccttccaccagtgcggcggcaacgtcggcgactccgtcaacatcccgctcccgaggtgggtggtggaggagatggagaaggacaacgacctcgcctacaccgaccaatggggacgccgcaacttcgagtacatctccctcggctgcgacgccatgcccgtcttcaagggccgcacgcccgtcgagtgctacaccgacttcatgcgcgccttccgcgaccacttcgcctccttcctcggcgacaccatcgtcgaaatccaagtcggcatgggccccgccggcgagcttcggtacccgtcctacccggagagcaacggcacctggaggttccccggcatcggcgccttccaatgcaacgacaggtacatgcgtagcagcctgaaggcggcggcggaggcgaggggcaagccggagtggggccacggcgggccgacggacgccggcggctacaacaactggccggaagacacggtgttcttccgcggcgactgcggcgggtggagcaccgagtacggcgagttcttcctgtcgtggtattcgcagatgctgctggagcacggcgagcgcgtgctgtcgggcgcgacgtccgtgttcggcgacggcgccggcgccaagatctcggtcaaggtggccggcatccactggcactacggcacgcggtcgcacgcgccggagctcacggcggggtactacaacacgcggcaccgcgacggctacctcccgatcgcgcgcatgctggcgcgccacggcgccgtgctcaacttcacctgcgtggagatgcgcgaccacgagcagccgcaggaggcgcagtgcatgcccgaggcgctcgtcaggcaggtggccgccgcggcgcgcgcggcgggcgtcgggctcgccggggagaacgcgctgccgcggtacgacggcacggcgcacgaccaggtggtcgccgccgccgccgaccgcgcggcggaggaccggatggtcgccttcacctacctccggatggggcccgacctcttccacccggacaactggcgccggttcgtcgccttcgtccgccgcatgtccgagtctggctcgccgcgggaggccgccgagagcgccgcgcacggcgtcgcgcaggccaccggctcgctcgtgcacgaggccgcggtcgcgctccggagctagcacggtcagacgctcatatacaccgtcgcctcgaggtcggattccgatgtgggatcattcgatctcccttttttttttcttctttttgccattttgtacagccttttggggagctttggatttgtgctttttgtctcgggaggaaaaccgctctggaggtcgaagagagcgtcattttcctcccgttgaagatcacgaatcatttacgttagagatgatgtaattaagcagggaggggaggggaacacacacacactggcactcaaaagttgttgtcacgcttggggaatatatccatttccagccaaaaaaaaaacgcagaaatgcgttgtgttcttgcgctctggttcgttgctgctgtgggtcagattcagctggtgaaaaaactacagtactactgaaactgaaactactagagcctagagggagattaagctaagttaattgcacgagtaattactccacggttgtgtttagggtctacgtcggcagattttgctttctggtagatccctaaccttatgtttgttgggaattttataaaggagctaagtttgcctattgatttgcaatctacacatatctcttgtgtcacaaaacattggtgccttcacgtctttggtctcccctctaaaaacttgcctggcgaatttcacatgaacttcacacgaagtcgttcatttcttgcaagaagtagggaaaagaatcactgctacaaatggtgtgaagtaattcatttcttgcaagaaataggaaaatttccctgctccaaactaaagagtttac

SEQ ID NO: 373 - DNA, 2445 bp, Oryza sativa
tcctcatcgacctccaccccacattgaataattatttttaataattttagttttttttttttggctttagatatattcccaatccccaacctcccaataatccgatctctcccagttctgttcggatcaaggctgtgtcgatcgcaaaaaagaaaaaaaaaacaatttccttttggggtggttcatctgttgatcacttctttgtttcccgcgttttgttggggattcgattttcgggttaagattttctacacgatggccttgaacttggctcagagcgccgcggcggcagcgtgcttcgcgaccgccggtgatgcgcggcgagctgcttcggtggtcgccatgccgtcgtcgtcgtcgtcggccacgacgagcctgaggatgaagaggcaggcggcgtgcgagccggtggcgtgccgggcggtggccaggcacgtggcggcggcggcggcgagcagcaggaggaacggcgtgccggtgttcgtgatgatgccgctggacacggtgagcaagtgcgggagcgcgctgaaccggaggaaggcggtggcggcgagcctggcggcgctgaagagcgccggcgtggaggggatcatggtggacgtgtggtggggcatcgtggagagcgagggccccggccggtacaacttcgacggctacgtggagctcatggagatggcccgcaagaccggcctcaaggtccaggccgtcatgtccttccaccagtgcggcggcaacgtcggcgactccgtcaacatcccgctcccgaggtgggtggtggaggagatggagaaggacaacgacctcgcctacaccgaccaatggggacgccgcaacttcgagtacatctccctcggctgcgacgccatgcccgtcttcaagggccgcacgcccgtcgagtgctacaccgacttcatgcgcgccttccgcgaccacttcgcctccttcctcggcgacaccatcgtcgaaatccaagtcggcatgggccccgccggcgagcttcggtacccgtcctacccggagagcaacggcacctggaggttccccggcatcggcgccttccaatgcaacgacaggtacatgcgtagcagcctgaaggcggcggcggaggcgaggggcaagccggagtggggccacggcgggccgacggacgccggcggctacaacaactggccggaagacacggtgttcttccgcggcgactgcggcgggtggagcaccgagtacggcgagttcttcctgtcgtggtattcgcagatgctgctggagcacggcgagcgcgtgctgtcgggcgcgacgtccgtgttcggcgacggcgccggcgccaagatctcggtcaaggtggccggcatccactggcactacggcacgcggtcgcacgcgccggagctcacggcggggtactacaacacgcggcaccgcgacggctacctcccgatcgcgcgcatgctggcgcgccacggcgccgtgctcaacttcacctgcgtggagatgcgcgaccacgagcagccgcaggaggcgcagtgcatgcccgaggcgctcgtcaggcaggtggccgccgcggcgcgcgcggcgggcgtcgggctcgccggggagaacgcgctgccgcggtacgacggcacggcgcacgaccaggtggtcgccgccgccgccgaccgcgcggcggaggaccggatggtcgccttcacctacctccggatggggcccgacctcttccacccggacaactggcgccggttcgtcgccttcgtccgccgcatgtccgagtctggctcgccgcgggaggccgccgagagcgccgcgcacggcgtcgcgcaggccaccggctcgctcgtgcacgaggccgcggtcgcgctccggagctagcacggtcagacgctcatatacaccgtcgcctcgaggtcggattccgatgtgggatcattcgatctcccttttttttttcttctttttgccattttgtacagccttttggggagctttggatttgtgctttttgtctcgggaggaaaaccgctctggaggtcgaagagagcgtcattttcctcccgttgaagatcacgaatcatttacgttagagatgatgtaattaagcagggaggggaggggaacacacacacactggcactcaaaagttgttgtcacgcttggggaatatatccatttccagccaaaaaaaaaacgcagaaatgcgttgtgttcttgcgctctggttcgttgctgctgtgggtcagattcagctggtgaaaaaactacagtactactgaaactgaaactactagagcctagagggagattaagctaagttaattgcacgagtaattactccacggttgtgtttagggtctacgtcggcagattttgctttctggtagatccctaaccttatgtttgttgggaattttataaaggagctaagtttgcctattgatttgcaatctacacata

SEQ ID NO: 374 - DNA, 662 bp, Saccharum officinarum
tcccgggtcgacccacgcgtccgccccgcttcgccgccccgccgccgccgccgtccccgcccgcagccaaaatgccgttcaagaggttcgtggagatcgggcgagtggcccttgtgaactacggcaaggagtatggccgcctcgtcgtcatcgtcgacgtcgtcgaccagaacagggcccttgtggatgcccctgacatggtccgttgccaaatgaacttcaagcggctttctctgactgacatcaagattgatattaaacgtgttccaaagaagaccacattgattaaggcaatggaggaagctgatgtgaaaagcaagtgggagaatagctcatggggcaagaagctgattgtccagaagaggagagcatcgctcaatgactttgacaggttcaaggtcatgttggcgaagatcaagaggggtggtgccatcaggcaagagcttgctaagcttaaaaaggtggctgctgctgcttagattgctttggtggttttgattttgatcctctatgcttcgatgtcttgaaaatgtaatgcgcgaatcacttccagttagcttgtcaagatgtcaattttaaactggcttgtttagatattttgtctaaaatgctattctgaatctgagatagtgttatattctggtatcgatcgagtgttgcat

SEQ ID NO: 375 - DNA, 732 bp, Sorghum bicolor
tcagccgcacaccccgcttcgccgccccgccgccgctgccgtccccgcccgcagccaaaatgccgttcaagaggttcgtggagatcgggcgggtggctcttgtgaactacggcaaggagtatggccgccttgtcgtcatcgtcgacgtcgtcgaccagaacagggctcttgtggatgcccctgacatggtccgttgccaaatgaacttcaagcggctttccctgactgatatcaagattgacattaaacgtgtcccaaagaagactacattgattaaggcaatggaggaagctgatgtgaaaaccaagtgggagaatagctcatggggcaagaagctgattgtgcagaagaggagagcatcgctcaatgactttgacaggttcaagatcatgttggcgaagatcaagaggggtggtgccatcaggcaagagcttgctaagcttaaaaaggtggctgctgctgcttagattgctttggtggttttgattttgatcctttatgcttcgatgtcttgaaaaatgtaatgcacgaattacttccagttagcttgtcaagatgtcagttttgaactgccttgtttagatattgtctaaaatgctattctgaatctgagatagtgttatattctggtatctatcaagtgttgcatccttgttccattcaatgttgttgctggctggctttcagtttcatgtgaccaatatttgccgtttagaatttgaatgccctctg

SEQ ID NO: 376 - DNA, 869 bp, Sorghum bicolor
gctcacccacatcccattcctctctatatacgtctgcggcatcaacaaaacccctcttcctcagccgcacaccccgcttcgccgccccgccgccgctgccgtccccgcccgcagccaaaatgccgttcaagaggttcgtggagatcgggcgggtggctcttgtgaactacggcaaggagtatggccgccttgtcgtcatcgtcgacgtcgtcgaccagaacagggctcttgtggatgcccctgacatggtccgttgccaaatgaacttcaagcggctttccctgactgatatcaagattgacattaaacgtgtcccaaagaagactacattgattaaggcaatggaggaagctgatgtgaaaaccaagtgggagaatagctcatggggcaagaagctgattgtgcagaagaggagagcatcgctcaatgactttgacaggttcaagatcatgttggcgaagatcaagaggggtggtgccatcaggcaagagcttgctaagcttaaaaaggtggctgctgctgcttagattgctttggtggttttgattttgatcctttatgcttcgatgtcttgaaaaatgtaatgcacgaattacttccagttagcttgtcaagatgtcagttttgaactgccttgtttagatattgtctaaaatgctattctgaatctgagatagtgttatattctggtatctatcaagtgttgcatccttgttccattcaatgttgttgctggctggctttcagtttcatgtgaccaatatttgccgtttagaatttgaatgccctctgaaggggatgagtgtaaatgaaaatagacctaaaaacaggtatctgccacctaaaacataagcgatttattgaggtgg

SEQ ID NO: 377 - DNA, 723 bp, Panicum virgatum
gcaccccgcctcgccgtctcgctcgctcccgcttcgccgcgccgccgccgccgcaaaaatgccgttcaagaggttcgtggagatcgggcgggtggcgctggtgaactacggcaaggactacggccgcctcgtcgtcattgtcgacgtcgtcgaccagaacagggcacttgtggatgcccccgacatggtccgttgccagatgaacttcaagcggctttccctgactgacatcaagattgacattaaacgtgtcccaaagaagactacattgattaaggcaatggaggaagctgatgtgaaaagcaagtgggagaagagctcgtggggcaagaagctgattgtccagaagaggagagcatcactcaacgactttgacaggttcaaggtcatgttggcaaagatcaagaggggtggtgctatcagacaggagcttgctaagcttaaaaaggaggttgctgctgcttagattgctttggtggtttagattttggtcggctatgttttgatatctgaaaaaggaacatgtaatgtgcgagttacttcaacggtttatcagagcttgtcaaaatgctaattttaaacagggcttatttagaaattttgcccagatggctttttctgattctgtgatagttcgacaatatgaagatatctggtgccgtgcctactgttttattttctgttgccgtacctattatatattacaaatgttataatattctc

SEQ ID NO: 378 - DNA, 640 bp, Pseudoroegneria spicata
  misc_feature (453)..(453): n is a, c, g, or t
cctctctccgccgccgccgccgccgcccgcgcagccgcaaaatgccgttcaagaggtttgtggagatcgggcgggtcgccctcgtgaactacggcaaggactacggccgcctcgtcgtcatcgtcgacgttgttgaccagaacagggcacttgttgatgcaccggacatggtccgctgccagatgaacttcaagcggctctccctgactgacatcaagattgacatcaagcgggtccctaagaaggcaactttgatcaaagctatggaggaagctgatgtgaagaccaagtgggagaacagctcatggggcaagaagctgattgtccagaagaggagggcatcgctcaatgactttgacaggttcaaggtcatgctcgccaagatcaagaggggaggagctatcaggcaggagctagcgaagcttaagaaggaggttgctgctgcttagatcncttcggtgggcgacctgttgagattttgatcagcgatgtatcttcatcccaaactcctgaaatattgtgtgaatcactcattgctgttattggtgtatcagatgaaagtttagtagtgtttaagattgttggtggacttcttcaggatctgagatagtatgttatctgtctgttatgtgtgatgcca

SEQ ID NO: 379 - DNA, 986 bp, Oryza sativa
acggccgggggaaccctagttcctctttgcctttccgcttctccgcgccccccccccccgccgcttctcccgaccgccgccgcgagaatgccgttcaagaggttcgtggagatcgggcgggtggccctggtgaactacggcaaggactacggccgcctcgtcgtcatcgttgatgtcgtcgaccagaaccgggcacttgtggatgctcctgacatggtcaggtgccagatcaacttcaagaggctttccctgactgacatcaagattgacatcaaacgtgtcccgaagaagacaactttgattaaggctatggaggaggctgatgttaagaacaagtgggagaatagctcatggggcaagaagctaattgtccagaagaggagagcgtcactcaatgactttgacaggttcaaggttatgttggccaagatcaagaggggaggtgctatcaggcaagagcttgcgaagctcaagaagactgccgcggcttagtagtgccatgttgagtttttggttccaagttggatcagcaatatgtttcaatggtcttagagccagaattagtactactgtttaatggaacctatttcatatttaaattgagcatggttgtgctttagagattttgtatgactgatggctgttaaatagtttccaacatatgatcactggtgatttgtgtggactctactcgttaccagttgagattgccgtgttttgctcgtgcagcatattgcagtcttgagtcgctgcaccgggttattgaatgttacaccacctactgagactggaatattcacttgctcagtcgtgccgaatggcagacgctatctgtttcaatttttcaaatggtaggcgtgcttctacattgaagaatggaaaatcgttccatttcctgagttagatggaaaatccttccattttctgagttagcaattttttctctcattttcagtagttggaaaattaaaacagcaatataccca

SEQ ID NO: 380 - DNA, 619 bp, Oryza sativa
gaaccctagttcctctttgcctttccgcttctccgcgccccccccccccgccgcttctcccgaccgccgccgcgagaatgccgttcaagaggttcgtggagatcgggcgggtggccctggtgaactacggcaaggactacggccgcctcgtcgtcatcgttgatgtcgtcgaccagaaccgggcacttgtggatgctcctgacatggtcaggtgccagatcaacttcaagaggctttccctgactgacatcaagattgacatcaaacgtgtcccgaagaagacaactttgattaaggctatggaggaggctgatgttaagaacaagtgggagaatagctcatggggcaagaagctaattgtccagaagaggagagcgtcactcaatgactttgacaggttcaaggttatgttggccaagatcaagaggggaggtgctatcaggcaagagcttgcgaagctcaagaagactgccgcggcttagtagtgccatgttgagtttttggttccaagttggatcagcaatatgtttcaatggtcttagagccagaattagtactactgtttaatggaacctatttcatatttaaattgagcatggttgtgctttagagattttgt

SEQ ID NO: 381 - DNA, 997 bp, Oryza sativa
ggaatccctcgccacgagatccaccggctcacgcagatccgccccctccgctatatagacccaccacatctgaaccctcctctcctctagccgcactgcgcgcctcccctcccctcgtctcgccgccgcttcgtcgccgccgccgcagcatcagccgcctcctccccgcggaaatgccgttcaagaggttcgtggagatcgggcgggtggccctggtgaactacggcaaggactacggccgcctcgtcgtcattgtcgatgtcgtcgaccagaacagggcacttgtggatgcccctgatatggtccgctgccagataaacttcaagcggctttctctgactgacattaagattgacatcaagcgtgtccctaagaagaccaccttgattaaggcaatggaggaagctgatgtgaagaacaagtgggagaacagctcatggggtaagaaactgattgtccagaagaggagagcatccctcaacgactttgacaggttcaaggttatgttggcgaagatcaagcgtggcggcgctatcagacaggagcttgctaagcttaagaaggaggctgctgcgtagatcattttggtggtgatcagttgagattttgatcaatgatgtttgatgtccctaaatatgaaacattgtgccagccactgttattgggatctcatgaaaaatttaagttttgaactcctgtgtttagaccttgtgccacaaattctattcagaatctaagatagtatgccatatgttgtgtgaattctttcgtcgtggctgaccatggtgttagatgttccaattccccatcattacgaaaattcatcctaagcgtttaccacaatgccactgttattgtgctcttttccaatgccttttccagttgccacaacataatttcccaaaaaaatgcactgtaatatttctgtaaaaacgtaagcctgagtatatgctaaagcactgtgatgtttttatataaaaaaacataagcgtgacta

SEQ ID NO: 382 - DNA, 972 bp, Oryza sativa
ggctcacgcagatccgccccctccgctatatagacccaccacatctgaaccctcctctcctctagccgcactgcgcgcctcccctcccctcgtctcgccgccgcttcgtcgccgccgccgcagcatcagccgcctcctccccgcggaaatgccgttcaagaggttcgtggagatcgggcgggtggccctggtgaactacggcaaggactacggccgcctcgtcgtcattgtcgatgtcgtcgaccagaacagggcacttgtggatgcccctgatatggtccgctgccagataaacttcaagcggctttctctgactgacattaagattgacatcaagcgtgtccctaagaagaccaccttgattaaggcaatggaggaagctgatgtgaagaacaagtgggagaacagctcatggggtaagaaactgattgtccagaagaggagagcatccctcaacgactttgacaggttcaaggttatgttggcgaagatcaagcgtggcggcgctatcagacaggagcttgctaagcttaagaaggaggctgctgcgtagatcattttggtggtgatcagttgagattttgatcaatgatgtttgatgtccctaaatatgaaacattgtgccagccactgttattgggatctcatgaaaaatttaagttttgaactcctgtgtttagaccttgtgccacaaattctattcagaatctaagatagtatgccatatgttgtgtgaattctttcgtcgtggctgaccatggtgttagatgttccaattccccatcattacgaaaattcatcctaagcgtttaccacaatgccactgttattgtgctcttttccaatgccttttccagtttccacaacataatttcccaaaaaaatgcactgtaatatttctgtaaaaacgtaagcctgactatatgctaaagcactgtgatgtttttatataaaaaaacataagcctgacta

SEQ ID NO: 383 - DNA, 662 bp, Panicum virgatum
gtctccagccgcaccccgcctcgccgtcccgctcgctcccgcttcgccgctgccgccaaaatgccgttcaagaggttcgtggagatcgggcgggtggccctggtgaactacggcaaggactacggccgcctcgtcgtcatcgtcgacgtcgtcgaccagaacagggcacttgtggatgcccccgacatggtccgctgccagatgaacttcaagcggctttccctgactgacatcaagattgacattaaacgtgtcccaaagaagactacattgattaaggccatggaggaagctgatgtgaaaaacaagtgggagaagagctcatggggcaagaagctgattgtccagaagaggagagcatcactcaatgacttcgacaggttcaaggtcatgttggcaaagatcaagaggggtggtgctatcagacaggagcttgctaagcttaaaaaggaggttgctgctgcttagattgctttggtggtttagattttgtttgtctatgtttcgatatctgaaaaaggaacatgtacaatgtgcgaattacttcgacggtttatcagagcttgtcaaaatggtaatttcaaacatggcttgtttagaaattttgcccagattactttttctgaatatgagatagtttgacaatatgaagatatatggtg

SEQ ID NO: 384 - DNA, 918 bp, Setaria italica
gcgtcgtctaaacccttccctctccagccgccccccgcctcgccgtctcgctcgctcccgcttcgccgccgcagccgccgccgattcccccgccgccaaaatgccgttcaagaggttcgtggagatcgggcgggtggccctggtgaactacggcaaggactacggccgcctcgtcgtcatcgtcgacgttgtcgaccagaacagggcacttgtggatgcccccgacatggttcgttgccagatgaacttcaagcggctttctctgaccgacatcaagattgacattaaacgtgttccaaagaagactacattgattaaggcaatggaggaagctgatgtgaaaaacaagtgggagaagagctcatggggcaagaagctgattgtccagaagaggagagcatcgctcaacgactttgacaggttcaaggtcatgttggcgaagatcaagaggggtggtgctatcaggcaggagcttgctaagcttaaaaaggaggttgctgctgcttaggttcctttggtggttttgattttgatcggctatgcttcgatatctggaaaagaatcatgtaatgtgcgaattacttagacggtttatcagagcttgtcaaaatgttaatttgaaacatggcttgtttagagattttgcccagattgctattcaaaatctgagatagtttgttacatgcagatatctcttatctaatgtttcattctccttgttgcttgccaccttgccatttgccaccttgccatatgcctgttggttacaaccgcatgtttgtggttgcagccttaacttctgtaattggcaatacacgtcctagtgaatggggtagagtgtggtacacaggtagtggtaggtaatgctcatatgatgaatctacaagacgttgaagcagtcgagtgtttttgattcct

SEQ ID NO: 385 - DNA, 678 bp, Pennisetum glaucum
ccgcccacccgcatcgccgtctcgctcgccgccgccgccgattcctcttccgccaaaatgccgttcaagaggttcgttgagatcgggcgggtggccctggtgaactacggcaaggactacggccgcctcgtcgtcatcgtcgacgttgtcgaccagaacagggcacttgtggatgcccccgacatggtccgctgccagatgaacttcaagcgactgtccctgactgacatcaagatcgacattaaacgtgtcccaaagaagactacattgattaaggcaatggaggaagctgatgtgaaaaacaagtgggagaagagctcatggggcaagaagcttattgtccagaagaggagagcatccctcaacgactttgacaggttcaaggtcatgctggcgaagatcaagaggggtggtgctatccgacaggagcttgctaagcttaaaaaggaggttgctgccgcttaggttgctttggttaggttttcattttgatcgcctatgctttggatatctggaaaagaatcatgtaatgtgcgaattacttggatcatcagagcttgtcaaaatgttaatttgaaatatggcttgtttagagattatgctattcaaatctgatatactcctacctaattttcattcccttttcttgcttgccccttgccatcatgtttggcgttg

SEQ ID NO: 386 - DNA, 788 bp, Avena sativa
tttatatcccacaccccagacgaaccctagctcctcttgcctttccgccagcccgcccgaaccctcgccgctgctaccgccgccgccgcgtttgttccggcccgccgcaaagatgccgttcaagaggttcgtcgagatcgggcgggtggccctggtgaactacggcaaggattatggccgcctcgtggtcatcgtcgacgtcgtcgaccagaaccgggcacttgtggatgctcccgatatggtcaggtgccagattaacttcaagcgtctttctctgactgacattaagatcgacatcaagcgtgtccccaagaaggcaactttgatcaaggcaatggaggaagctgatgtgaagagcaagtgggagaacagctcgtggggcaagaagcttattgtccagaagagaagagcgtcgctgaatgactttgacaggttcaaggtcatgttggctaagattaagagaggcggtgctatcaggcaagagcttgccaagctcaagaaggaggttgctgcttagaatatctttggtggatgacatgttgagttttttgttccaagttggatctgcactatgttctagtgtccttgaagccataattagtactactgttttcaggaacctatttcatatattgtcgtggctgttattgaataccaaatcttgtttgcgacataaccatgcctctgttatggttcctatggttgattggtttctctgttttgacttctgactgccactgttgcttggttattatctattcgtagagagttgatttcatgtcaaaaaa

SEQ ID NO: 387 - DNA, 746 bp, Secale cereale
aaaatgccgttcaagaggttcgtggagatcgggcgggtggccctggtgaactacggcaaggactacggccgcctcgtcgtgatcgtcgatgttgttgaccagaacagggcacttgttgatgctccggacatggtccgctgccagatgaacttcaagcggctctctctgaccgacatcaagattgacatcaagcggatccctaagaaggcaactttggtcaaagctatggaggaagctgatgtgaagaccaagtgggaaaacagctcatggggcaagaagctgattgtccagaagaggagggcatcgctcaatgacttcgacaggttcaaggtcatgctcgccaagatcaagaggggaggagccatcaggcaggagctagcgaagcttaagaaggaggttgctgctgcttagatcactttggtgggcagactattgagcttttggtcagcgttgtatcttcgccccaaaatcgtgaaatattgtgcgaatcactcatcactgttattggtgtatcagatgaaaattagtgtttgagattttggtggacttgtcaggatctgatgttatttgtgatgccttctaaattcatgggcctcgtgcttactgttagtctgtgcctgtttacctccaggggaccaaaatcatgaaccccagtggctccaacgggcattattcctggaacagctttgttccaatcgatcatgtttatttggcccgaaataatagatgatgttatcgatggcaaa

SEQ ID NO: 388 - DNA, 527 bp, Secale cereale
aaaatgccgttcaagaggttcgtggagatcgggcgggtggccctggtgaactatggcaaggactacggccgcctcgtcgtcatcgtcgacgttgttgaccagaacagggcacttgttgatgctccggacatggtccgctgccagatgaacttcaagcggctctctctgaccgacatcaagattgacatcaagcggatccctaagaaggcaactttgatcaaagctatggaggaagctgatgtgaagaccaagtgggagaacagctcatggggcaagaagttggttgtccagaagaggagggcatcgctcaatgactttgacaggttcaaggtcatgctcgccaagatcaagaggggaggagctatcaggcaggagctagctaagcttaagaaggaggttgctgctgcttagatcactttggcgggcagactgttgagcctttggtcagcgttgtatcttcgccccaaaatcgtgaaatattgtgtgaatcactcagcactgttattggtgtatcagatgaaatttag

SEQ ID NO: 389 - DNA, 1038 bp, Brachypodium distachyon
aatcaaaaccctcccctctctagccgcactccgcccccatcgtgtgcctccctcccgcttcgcgccgccgtcgccgccgccgccgccaagatgccgttcaagaggtttgtggagatcgggcgggtggccctcgtgaactacggcaaggactatggccgcctcgttgtcatcgtcgatgtcgtcgaccagaacagggcacttgtggatgcacctgatatggtccgttgccagattaacttcaagcgcctttctcttacggatatcaagattgacatcaagcgtgtccccaagaaggcaaccttgattaaggcaatggaggaagctgatgtgaagaacaaatgggagaatagctcatggggcaagaagctgattgtccagaagaggagagcatccctcaatgactttgacaggtttaaggtcatgttggccaaaatcaagaggggaggagctatcaggcaggagctcgctaagcttaaaaaggaggtcgctgcctcttagatcacggcctgttgagatttttaccggcaatgtctcgatgttccaaaatcctgaagtatttcatgagttacttacactgttatctggattttatcagtcctttatgttacaccttgcagtctagagattttgcaagaatccttcagtctatgatgttgtgttatgcggtgttattctcttgtctgtcatatcgtcctgcgagccatgatgtccttgttgtttccttgctgtgcgtttgctgctcttggaattcgtggtcattgaccaatgctgccagttttttttccatgttcaggtttcttgtaacctgtaacaggcacatcttggggtgctatagaaggactggaacttgtttggacaaggtactcagttcagattgtaggttttagcactgtatttgctttaacacctcaggtcggatagtgttgttgctttcatttttgttggtttctgggagataagaaaaagatggaaagaaatcggcggcatgtaacaagttgcccctgattgaaaatgaataatatggcggcaatattgacc

SEQ ID NO: 390 - DNA, 1226 bp, Brachypodium distachyon
tatatagatccgcaatcaaaaccctcccctctctagccgcactccgcccccatcgtgtgcctccctcccgcttcgcgccgccgtcgccgccgccgccgccaagatgccgttcaagaggtttgtggagatcgggcgggtggccctcgtgaactacggcaaggactatggccgcctcgttgtcatcgtcgatgtcgtcgaccagaacagggcacttgtggatgcacctgatatggtccgttgccagattaacttcaagcgcctttctcttacggatatcaagattgacatcaagcgtgtccccaagaaggcaaccttgattaaggcaatggaggaagctgatgtgaagaacaaatgggagaatagctcatggggcaagaagctgattgtccagaagaggagagcatccctcaatgactttgacaggtttaaggtcatgttggccaaaatcaagaggggaggagctatcaggcaggagctcgctaagcttaaaaaggaggtcgctgcctcttagatcacggcctgttgagatttttaccggcaatgtctcgatgttccaaaatcctgaagtatttcatgagttacttacactgttatctggattttatcagtcctttatgttacaccttgcagtctagagattttgcaagaatccttcagtctatgatgttgtgttatgcggtgttattctcttgtctgtcatatcgtcctgcgagccatgatgtccttgttgtttccttgctgtgcgtttgctgctcttggaattcgtggtcattgaccaatgctgccagttttttttccatgttcaggtttcttgtaacctgtaacaggcacatcttggggtgctatagaaggactggaacttgtttggacaaggtactcagttcagattgtaggttttagcactgtatttgctttaacacctcaggtcggatagtgttgttgctttcatttttgttggtttctgggagataagaaaaagatggaaagaaatcggcggcatgtaacaagttgcccctgattgaaaatgaataatatggcggcaatattgaccaatgatctaatggagtgggcaccgaagcggtctgccgattttggactcttttgttgacgtactgtataacaatgttgtttcggtgtgtctgtgtatgcttgtaacaatcttgaaacatagaaacggaaacaacaatgatgccatatatgaaacttgtgcatcttaaaatggaaaa

SEQ ID NO: 391 - DNA, 828 bp, Triticum aestivum
tcgacccacgcgtccgcagcccctcgatcccctgttctagccgccctccgcctccccgtctcgctcgctcccacctctcgccgccgccgccgccgccgccgcccgcgcagccgcaaaatgccgttcaagaggttcgtggagatcgggcgggtggccctggtgaactatggcaaggactacggccgcctcgtcgtcatcgtcgacgttgttgaccagaacagggcacttgttgatgctccggacatggtccgctgccagatgaacttcaagcggctctctctgaccgacatcaagattgacatcaagcggatccctaagaaggcaactttgatcaaagcaatggaggaagctgatgtgaagaccaagtgggaaaacagctcatggggcaagaagctggttgtccagaagaggagggcatcgctcaatgacttcgacaggttcaaggtcatgctcgccaagatcaagaggggaggagctatcaggcaggagctagcgaagcttaagaaggaggttgctgctgcttagatcactttggtgggcagactgttgagcttttggtcagcgttgtatctttgccccaaaatcgtgaaatattgtgtgaatcactcatcactgttattggtgtatcagatgaaaatttagtagtgtttgagattttgctggacttgtcaggatctgagatggtatgttatctatctgttatttgtgatgccatctaaatacatgggcctagtgcttactgttagtctgctgcgtgtttaccccagtggctacaccgggcattattcctagaacagctttgttccaatcgatcatgtttatgtatta

SEQ ID NO: 392 - DNA, 874 bp, Pennisetum glaucum
ataatggtgacacaagtatacctgatgatattatatactcggcatcaggtatacttgtgtcaccattatgcacttccgccccgtctcgccgtctccctcactgccgctcgcgccgccgccaccgccaccgccgctcgcctccccgactgccgtcaggatgccgttcaagaggttcgtggagatcgggcgcgtggccctggtgaactacggcaaggactatggccgcctcgtcgtcatcgtcgacgtggtcgaccagaacagggcacttgtggatgcccctgatatggtcaggtgccagatgaacttcaagcggctctcccttactgacatcaagattgacatcaaacgtgtacctaagaagacaactctgatcaaggcgatggaggaagctgatgtgaagaccaagtgggagaacagctcatggggcaagaagctgattgtccagaagaggagagcagcgctcaatgactttgacaggttcaaggtcatgctggcgaagatcaagaggggtggagctatcaggcaagagctcgccaagctcaagaaggcgtccactgcttagagtatcatacggtggatagcttgttgaggttttggtttcatgttggatcagcaattcgttggagtgttgttaaagccagaattagtacttctgtttcctatgaacccttttcgaacctttatcaagcatggctgtgctctggagattttgtcatgaatgatatggaatatctaaggtagtttgtgatgaatgatcaacgtgcctttgtttctaatatcttttgtttgctggtcatttgtagctgagtctgagatgcgtctatattaacctggtttgcaatgaatgtgcaatgtgcatttatttggttccgtc

SEQ ID NO: 393 - DNA, 841 bp, Setaria italica
ctttatagcccgctcccactgccgaaccctagcttctatttgcacttccgccccgcctcgccgtctccctcgctgccgcttcccgccgctgcagccgccgctcgcctctccgaccgccgcgaggatgccgttcaagaggttcgtggagatcgggcgcgtggccctggtgaactacggcaaggactatggccgcctcgtcgttatcgtcgacgtggtcgaccagaacagggcacttgtggatgcccctgatatggtcaggtgccagatgaacttcaagcggctctcacttaccgacatcaagattgacatcaaacgtgtacccaagaagacaactctgatcaaggcgatggaggaagctgatgtgaagactaagtgggagaacagctcatggggcaagaagctgattgtccagaagaggagagcagcgctcaatgacttcgacaggttcaaggtcatgctggcgaagatcaagaggggtggtgctatcaggcaagagcttgccaagctcaagaaggcgtccacggcttagagtatctttcagtggatggcatgtttagtttttggtttcatgttggatcagcaattcgttcgagtgttgttaaagccagaattaaatctactgtttcctatgaacccttttcaaacctttatcaagcatggctgtgctctggggattttgcatgaatgatatggagtatctaattttagatatggatcagcaaggtctttgatgaatgtgcaatgtgcctttgtttccatttgcttttgttgctggtgattcgtagctgtgatgcatctatatccacctagtttgcgacgaatgtgcaatgtgcatttgttt

SEQ ID NO: 394 - DNA, 551 bp, Lolium multiflorum
ccgccgtccccgccgccgcgttttttctccgaccgcgcaaagatgccgttcaagaggttcgtcgagatcgggcgggtggccctggtgaactacggcaaggactacggccgcctcgtggtcatcgtcgatgtcgtcgaccagaaccgggcgcttgtggatgctcctgatatggtcaggtgccagatcaacttcaagcgtctctctctgactgacatcaagattgacatcaagcgtgtccccaagaaggcaaccttgatcaaggcaatggaggaagctgatgtgaagaccaagtgggagaacagctcgtggggcaagaagcttattgtccagaagagaagagcgtccctgaatgactttgacaggttcaaggtcatgttggctaagatcaagagaggcggtgctatcaggcaggagcttgccaagctcaagaaggaggttgctgcttagattatcttggtggatgacatgttgagatttttgttccaagctggatccaaactatgttctagtgtccttcaagccttaattagtacctcggccgcgaccacgct

SEQ ID NO: 395 - DNA, 620 bp, Avena sativa
cgtcacccgcgccgccgcaaaatgccgttcaagaggtttgtggagatcgggcgggtggcccttgtcaactacgggaaggactacggccgcctggtcgtcatcgtcgacgtcgtcgaccagaacagggcacttgtggatgcacctgacatggtccgatgccagatgaacttcaagaggctctcgctgaccgacatcaagatcgacatcaagcgcatccctaagaaggcgactttgatcaaggcactggaggaagctgatgtgaagaacaagtgggagaacagctcgtggggcaagaagctgattgtccagaagaggagggcatcgctcaatgactttgacaggttcaaggtcatgctggccaagatcaagaggggaggagctatcaggcaagagcttgcgaagcttaagaaggaggtcgctgctgcttagatcagtttggtgtgcaacctgttgaggttttgatcagcactgttttggtgtttaaatcctgatgaaatattgtgtgaattactcgtaactgttattgatgtgatgagatggtagtattaaacatgcagtgtttgagattttgccagaattcttttgaatctgcggtggtatgttgtctgttatgctatctt

SEQ ID NO: 396 - DNA, 737 bp, Zea mays
tagtttctggtttatcttcctctgcgcttcgcccacacgctccagccgcttcaccgcgccgccaccgccaccgcgaggatgccgttcaagaggttcgtggagatcgggcgcgtggccctggtgaactacgggaaggactatggccgtctcgtcgtcatcgtagatgtggtcgaccagaacagggcacttgtggatgcccctgatatggtcaggtgccaggtgaacttcaagcggctctcacttactgacatcaagattgacatcaaacgtgtccccaagaagacaaccctgatcaaggcgatggaggaagctgatgtgaagaccaagtgggagaacagctcatggggcaagaagctgattgtccagaagaggagagcatcgctcaatgactttgataggttcaaagtcatgctggcgaagattaagaggggcggtgctatcaggcaagagctcgccaagctgaagaaggcgtccacggcttaaggagtctctttccgtgaatgtcatgttagagtttttggttatgagttggatcagcaattcgattgagcgttgtcaaagccagagttaccaatatgttccctgtaaacccatttcaaactttatcaagcacgggcgtgctcaggatacttttgccatgaatgatatggaatatctatggtgtagcttgtggcaaatgtgtaacgaggccgcaaatctcgtgactatcaactcaaagtttcttcctcacatttcaa

SEQ ID NO: 397 - DNA, 757 bp, Saccharum officinarum
cccacgcgtccgcgccgcgcttcgccctctcgctccagccgcttcacagcgccgccgccgctcgcctctccgaccgccgcgaggatgccgttcaagaggttcgtggagatcgggcgcgtggccctggtgaactacggcaaggactatggccgcctcgtcgtcatcgtcgatgtggtcgaccagaacagggcacttgtggacgcccctgatatggtcaggtgccagatgaacttcaagcggctctcacttaccgacatcaagattgacatcaaacgtgtccccaagaagacaaccctgatcaaggcgatggaggaagctgatgtgaagaccaagtgggagaacagctcatggggcaagaaactgattgtccagaagaggagagcagcgctcaatgactttgacaggttcaaggtcatgctggcaaagatcaagaggggtggtgccatcaggcaagagcttgccaagctgaagaaggcgtccacggcttaagtcccttttggtggatggcatgtgttagagtttttggttccgtgttggatcagcaatttgttttagtgttgtcaaagccagaattagtaatatgttccctgtgaacctgtttcaaacttcatcaagaatgggtgtgctttgaatgttttgtcgtgaatgatttggaatatctaaggtagtttgcgacaaatgtgcattccttcccatttgagttgtttatggccagtgtttttaggtaaccaggatattggcataaatctattttgtg

SEQ ID NO: 398 - DNA, 932 bp, Triticum aestivum
tcgacccacgcgtccgcagcccctcgatcccctgttctagccgccctccgcctccccgtctcgctcgctcccacctctcgccgccgccgccgccgccgccgcccgcgcagccgcaaaatgccgttcaagaggttcgtggagatcgggcgggtggccctggtgaactacggcaaggactacggccgcctcgtcgtcatcgtcgacgttgttgaccagaacagggcacttgttgatgctccggacatggtccgctgccagatgaacttcaagcggctctctctgaccgacatcaagattgacatcaagcggatccctaagaaggcaactttgatcaaagctatggaggaagctgatgtgaagaccaagtgggaaaacagctcatggggcaagaagctggttgtccagaagaggagggcatcgctcaatgacttcgacaggttcaaggtcatgctcgccaagatcaagaggggaggagctatcaggcaggagctagcgaagcttaagaaggaggttgctgctgcttagatcactttggcgggcagactgttgagcttttggtcagcgttgtatctttgccccaaaatcgtgaaatattgtgtgaatcactcatcactgttattggtgtatcagatgaaaatttagtagtgtttgagattttgctggacttgtcaggatctgagatggtatgttatctatctgttatttgtgatgccatctaaattcatgggcctggtgcttactgttagtatgctgcctgtttacctccagctgtccaaaatcatggacccccagtggctccaccgggcattattcctggaacagctttgttccaatcgatcctgtttatgttatacggagtactatcgcaagaaaaagagctcgaaacggtcagtatgttcttgccaaccacgcgttggaagggaaaaaaaaaa

SEQ ID NO: 399 - DNA, 994 bp, Hordeum vulgare
cagagctcgcgtcacgatccacgggctcaccggggcttgcacgctgcctttataattggctctcgccgccgaaccctagctcctcttgcctttctgcccgcccacccgcctatcgtcgccgtctcgctcctcgccgccgcaaagatgccgttcaagaggttcgtcgagatcgggcgggtggccctggtgaactacggcaaggactacggccgcctcgtcgtcatcgtcgacgtcgtcgaccagaaccgggcactcgtcgacgctcctgatatgatcaggtgccagatgaacttcaagcgtctttcactgaccgacatcaagattgacatcaagcgtatccccaaaaaggcaactttgatcaaggccatggaggaagctgatgtgaaaaccaaatgggagaacagctcctggggcaagaagcttattgttcagaagagaagagcatcgctgaatgactttgacaggttcaaggtcatgttggctaagattaagaggggtggtgctatcaggcaagagcttgccaagctcaagaaggaggttgctgcttagaataccttagtggatgttgcatgttgagttttttgttccaagttggatctgctctatgttccagtgttcttaaagccagagttagtacaactgttttcaggaaactatttcatatcttttcatggctgttattgaatacccaagctagtttgctacagatgtgccgctgccttcatttgaatgttgcttgtttatccgtctttacttgtgactgtcattgtgttccagtggttattacctgttagaacttggcatgccctttgtctgtcactatagttggttacaatatataggttttgtcaggtttgcctttcagagttgagttggatcttttaaatttaagtggaactgttaattgtgcagtaaactgtaatctgaatgggatgaaaacaaagtctggttgttccttaattctattcctgatcaaaatcattattgatccgtc

SEQ ID NO: 400 - DNA, 854 bp, Hordeum vulgare
gcctccccctgtctagccgccctccgcctcctcgtcccgctcgctcccgccctctctccgccgccgccgccatcgcccgcgcagccgcaaaatgccgttcaagaggtttgtggagatcgggcgggtggccctggtgaactacggcaaggactacggccgcctcgtcgtcatcgtcgacgttgtcgaccagaacagggcacttattgatgcaccggacatgatccgctgccagatgaacttcaagcggctctccctgaccgacatcaagattgacatcaagcggatccctaagaaggcaactctgatcaaagctatggaggaagctgatgtgaagaccaagtgggagaacagttcatggggcaagaagctgattgtccagaagaggagggcatcgctcaatgactttgacaggttcaaggtcatgcttgccaagatcaagaggggaggagctatcaggcaggagctagcgaagcttaagaaggaggttgccgctgcttagatcactttggtgggcaacctgttgagattttgttgagcgatgtatcttattcccgtgctcgtgaaatattgtgcgaattactcatcactggtattggtggatcagatgaaattttagtattaaaacttattcttgaggatctgaggtagtatgttatgtatctgttatgtgtgagggctgaaatcatggtcctgttgcttgcttactgttagtttgctgcctgtttacctgaattccagcggactgaatcatgcccctgaaactattcacaatgggagtaatatatatgtagtaagatgtcatctaagcaaaaaagaagatgtggtaattaattaatgagaagtgagagaaattg

SEQ ID NO: 401 - DNA, 736 bp, Secale cereale
ccgttcaagaggttcgtggagatcgggcgggtggccctggtgaactacggcaaggactacggccgcctcgtcgtgatcgttgatgttgttgaccagaacagggcacttgttgatgctccggacatggtccgctgccagatgaacttcaagcggctctctctgaccgacatcaagattgacatcaagcggatccctaagaaggcaactttggtcaaagctatggaggaagctgatgtgaagaccaagtgggaaaacagctcatggggcaagaagctgattgtccagaagaggagggcatcgctcaatgacttcgacaggttcaaggtcatgctcgccaagatcaagaggggaggagccatcaggcaggagctagcgaagcttaagaaggaggttgctgctgcttagatcactttggtgggcagactattgagcttttggtcagcgttgtatcttcgccccaaaatcgtgaaatattgtgcgaatcactcatcactgttattggtgtatcagatgaaaattagtgtttgagattttggtggacttgtcaggatctgatgttatttgtgatgccttctaaattcatgggcctcgtgcttactgttagtctgtgcctgtttacctccagcggtccgaaatcatgaaccccagtggctccaacgggcattattcctggaacagctttgttccaatcgatcatgtttatttggcccgaaataatagatgatgttatcgatgg

SEQ ID NO: 402 - DNA, 883 bp, Triticum aestivum
gcccgcccacccgtctcctcgcctcgccgtctcgccccacgccgccgacgcaaagatgccgttcaagaggttcgtcgagatcgggcgcgtggccctggtgaactacggcaaggactacggccgcctcgtcgtcatcgtcgacgtcgtcgaccagaaccgggcacttgtggatgctcctgatatggtcaggtgccagatgaacttcaagcgtctttcgctgaccgacatcaagattgacatcaagcgtatccctaagaaggcaactttgatcaaggccatggaggaagcagatgtgaaaaccaaatgggagaacagctcatggggtaagaagcttgttgtccagaagagaagagcatcgctgaatgactttgacaggttcaaggtcatgttggctaagattaagaggggtggtgcgatcaggcaagagcttgccaagctcaagaaggaggttgctgcttagattatcttagtggatggcatgttgagttttttgttccaagttggatctgctctatgttccagtgttcttaaagccagaattagtacaactgttttcggagaactacttcatattttgtcatggctgttattgaatacccaagctagtttgctacagatgtgcctcttgccttattcatatgtgatatgttgcccggttctctgcttttacttttgacttgtgctcttgtggttattttttaagatttcagtagggtaagcatgtcttttgaatctaagtgggaaatgttaattaaataagatcaaaataaagtgcagtggtacctttattctattcccgatcgatatcattgttggtcagttgctctgtctcgtgccgattggtttgatgtcctagacgactataatatcaaaacagcacact

SEQ ID NO: 403 - DNA, 674 bp, Triticum aestivum
cgccgccgccgccgccctcgcagccgcaaaatgccgttcaagaggtttgtggagatcgggcgggtcgccctggtgaactacggcaaggactacggccgtctcgtcgtcatcgtcgacgttgttgaccagaacagggcacttgttgatgctccggacatggtccgctgccagatgaacttcaagcggctctctctgaccgacatcaagattgacatcaagcggatccctaagaaggcaactttgatcaaagctatggaggaagctgatgtgaagaccaagtgggaaaacagctcatggggcaagaagctgattgtccagaagaagagggctgcgctcaatgacttcgacaggttcaaggtcatgcttgccaagatcaagaggggaggagctatcaggcaggagctagcgaagcttaagaaggaggttgctgctgcttagatcactttggcgggcagactgttgagcttttggtcagagttgtatctttgccccaaaatcgtgaaatattgtgcgaatcactcatcactgttattggtgtatcagatgaaaatttagtagtgtttgagattttgctggacttgtcaggatccgagatggtatgttatctatctgttatttgtgatgccatctaaattcatgggcctggtgcttgctgttagtatgctgcctgttta

SEQ ID NO: 404 - DNA, 686 bp, Hordeum vulgare
ccgcctccgcgtcccgctcgctcccgcctctctcctcctccgccgccgccgtcgccgtcgcccgcgcagccgcgaaatgccgttcaagaggtttgtggagatcgggcgggtggccctggtgaactacggcaaggactacggccgcctcgtcgtcatcgtcgacgttgtcgaccagaacagggcacttattgatgcaccggacatgatccgctgccagatgaacttcaagcggctctccctgaccgacatcaagattgacatcaagcggatccctaagaaggcaactctgatcaaagctatggaggaagctgatgtgaagaccaagtgggagaacagttcatggggcaagaagctgattgtccagaagaggagggcatcgctcaatgactttgacaggttcaaggtcatgcttgccaagatcaagaggggaggagctatcaggcaggagctagcgaagcttaagaaggaggttgccgctgcttagatcactttggtgggcaacctgttgagattttgttgagcgatgtatcttattcccgtgctcgtgaaatattgtgcgaattactcatcactggtattggtggatcagatgaaattttagtattaaaacttattcttgaggatctgaggtagtatgttatgtatctgttatgtgtgagggctgaaatcatggtcctgttgcttgc

SEQ ID NO: 405 - DNA, 901 bp, Hordeum vulgare
gagagagagagagagagagagagagagagagagagagagcgcccacccgcctgtcgtcgccgtctcgctcctcgccgccgccgcagccgccgcaaagatgccgttcaagaggttcgtcgagatcgggcgggtggccctggtgaactacggcaaggactacggccgcctcgtcgtcatcgtcgacgtcgtcgaccagaaccgggcactcgtcgacgctcctgatatgatcaggtgccagatgaacttcaagcgtctttcactgaccgacatcaagattgacatcaagcgtatccccaaaaaggcaactttgatcaaggccatggaggaagctgatgtgaaaaccaaatgggagaacagctcctggggcaagaagcttattgttcagaagagaagagcatcgctgaatgactttgacaggttcaaggtcatgttggctaagattaagaggggtggtgctatcaggcaagagcttgccaagctcaagaaggaggttgctgcttagaataccttagtggatgttgcatgttgagttttttgttccaagttggatctgctctatgttccagtgttcttaaagccagagttagtacaactgttttcaggaaactatttcatatcttttcatggctgttattgaatacccaagctagtttgctacagatgtgccgctgccttcatttgaatgttgcttgtttatccgtttttacttgtgactgtcattgtgttccagtggttattacctgttagaacttggcatgccctttgtctgtcactatagttggttacaatatataggttttgtcaggtttgcctttcagagttgagttggatcttttaaatttaagtggaactgttaattgtgcagtaaactgtaatctgaatgggatgaaaacaaagtctg

SEQ ID NO: 406 - DNA, 778 bp, Brachypodium distachyon
atcttcaccccacacctctctagccgcaccccgccgcctccccgactacctcgctcccgcttagcgcctccgcctccgcctccgccgtcgaagatgccgttcaagaggtttgtcgagatcgggcgggtggccctggtgaactacggcaaggactacggccgcctcgtcgtcatcgtcgacgtcgtcgaccagaacagggcactcatcgacgcacctgatatggtccgttgccagatcaacttcaagcgcctttctctgacagatatcaagatcgatatcaagcgtgtgcccaagaaggcaactttgattaaggcaatggaggaagctgatgttaagaacaaatgggaaaatagctcatggggcaagaagctaattgtccagaagaggagagcatccctcaatgacttcgacaggtttaaggtcatgttggccaagatcaagagaggaggagctatcaggcaagagcttgctaagcttaaaaaggaggttgctgcttagatgactttgttggctggcctgttgagattttgatcagcaatgtttcgatgtcccagaatcctttagtattgttatctggatcttataaaaactttgttacattgcagtgtttagtgattttgccagaattcttaagaatctgcgatgcagtgtgctgaaatctcgtatctatatttcttgtcttgcaaaattatgtatttctgtttgcttgcttgcttccgttttgctacgttagtaaaatagtagttgtatcaaagtactaatggatgatgataaattc

SEQ ID NO: 407 - DNA, 1764 bp, Brachypodium distachyon
gcccgccttggctatatagatctgcgatatcttcaccccacacctctctagccgcaccccgccgcctccccgactacctcgctcccgcttagcgcctccgcctccgcctccgccgtcgaagatgccgttcaagaggtttgtcgagatcgggcgggtggccctggtgaactacggcaaggactacggccgcctcgtcgtcatcgtcgacgtcgtcgaccagaacagggcactcatcgacgcacctgatatggtccgttgccagatcaacttcaagcgcctttctctgacagatatcaagatcgatatcaagcgtgtgcccaagaaggcaactttgattaaggcaatggaggaagctgatgttaagaacaaatgggaaaatagctcatggggcaagaagctaattgtccagaagaggagagcatccctcaatgacttcgacaggtttaaggtcatgttggccaagatcaagagaggaggagctatcaggcaagagcttgctaagcttaaaaaggaggttgctgcttagatgactttgttggctggcctgttgagattttgatcagcaatgtttcgatgtcccagaatcctttagtattgttatctggatcttataaaaactttgttacattgcagtgtttagtgattttgccagaattcttaagaatctgcgatgcagtgtgctgaaatctcgtatctatatttcttgtcttgcaaaattatgtatttctgtttgcttgcttgcttccgttttgctacgttagtaaaatagtagttgtatcaaagtactaatggatgatgataaattcattgtcatctccaggagtcctgtttcattaggaagcatatcttgtcaagagtgttacttggcagccagaacactaacttttgttgacaaaattgctcttggctactgcttaagtcgaaccatcgaaagcttgcgttacatacagctgacacagctgacacaaaatacattagctcacactataggcataaattgtcatttattgtctctattcggcataatcgtaacggtaacatgaaaaaaaacatacacatgtacacgaatgttgactgcctgtgcctccaaatgctacaaaggtcgcctgcccctaccttgagatgatgctgtacgttgcagaggagggaggatacacatgtatatgaatgtcgcctgccccttccttacggtgctgtacgttgtagaggaagatggccggggggcatgggaacatggctagaagaactggctgaactgattcgtgagagagttcttcaagttggagaagaggccgaagagagagtactgccgcagcttcgacacctcgtaccacgagttgagcacctcctcgtgcttgtcggtgccggagaaggcgagctgtatcccagggctgcagtccacctgcccggcgccgttgcctttgcagctcgacgtcttgatcgcgcagctctggtcgacgcaggcgaaatcagattgcccggagcacgacgagcagccgtcggtcttccagaagaagttctgtagtatgcctttctggaactcgaggacctggaggcatatggagaattcagttgagcaaatgatcatcagtgctgggctttgtgagtgagcgtgtgatttgagtatacaggctaaggtttatggggcgcaccagggtgaaaccagttactgtgtatgagctgttgctgacgaaaacaggaggcgaccttgccgcgtatttcctcccggcaaaagctaccatgtatccaccagcagatgcctgg

SEQ ID NO: 408 - DNA, 691 bp, Panicum virgatum
ccgccccgcctcgccgtctacctcgctgccgcttcgcgccgccgccgctcgctcgcctctccgaccgccgcgaggatgccgttcaagaggttcgtggagatcgggcgcgtggccctggtgaactacggcaaggactatggccgcctcgtcgtcatcgtcgacgtggtcgaccagaacagggcacttgtggatgcccctgacatggtcaggtgccagatgaacttcaagcgtctctcacttaccgacatcaagattgacatcaaacgtgtacccaagaagacaactctgatcaaggcgatggaggaagctgatgtgaagaccaagtgggagaacagctcatggggcaagaagctgattgtccagaagaggagagcagcactcaatgacttcgataggttcaaggtcatgttggcgaagatcaagaggggtggtgctgtcaggcaagagcttgccaagctcaagaaggcgtccacggcttagattatcttttggtggatggcatgttgagtttttggtaccttattatatcagtgattcgtttgagtgttgttaagccagaattagcactcctgtttcctatgaactcttttcaaaccttaatcaagcatggctgtgctctggaggattttgtcatgatggtatgaaatatctaaggtagtttgcgactaatgtgcaatgtgcatttatttcc

SEQ ID NO: 409 - DNA, 680 bp, Panicum virgatum
gagcatccttccgctccgccccgcctcgccgtctcgctcgctgccgccgcctcgcgccgccgctcgcctctccgcccgccgcgaggatgccgttcaagaggttcgtggagatcgggcgcgtggccctggtgaactacggcaaggactatggccgcctcgtcgtcatcgtcgacgtggtcgaccagaacagggcacttgtggatgcccctgacatggtcaggtgccagatgaacttcaagcggctctcacttaccgacatcaagattgacatcaaacgtgtacccaagaagacaaccctgatcaaggcgatggaggaagctgatgtgaagaccaagtgggagaacagctcatggggcaagaagctgattgtccaaaagaggagagcagcgctcaatgactttgataggttcaaggtcatgttggcgaagatcaagaggggtggggcggtcaggcaagagctggccaagctcaagaaggcgtccacagcttagagtatcttttggtgaatggcatgttgagtttttggtaccttgttggatcagtcattcgtttgagtgttgttaaagccagaattagcactactgtttcctatgaactcttttcaaaccttaatcaagaatggctgtgctctggagatttttgtcatggatgttatgaaatatctaaggtagtttgcgccc

SEQ ID NO: 410 - DNA, 695 bp, Triticum aestivum
ctcttgcctttctgcccgcccacccgtctcctcgcctcgccgtctcgccccacgccgccgacgcaaagatgccgttcaagaggttcgtcgagatcgggcgcgtggccctggtgaactacggcaaggactacggccgcctcgtcgtcatcgtcgacgtcgtcgaccagaaccgggcacttgtggatgctcctgatatggtcaggtgccagatgaacttcaagcgtctttcgctgaccgacatcaagattgacatcaagcgtatccctaagaaggcaactttgatcaaggccatggaggaagcagatgtgaaaaccaaatgggagaacagctcatggggtaagaagcttgttgtccagaagagaagagcatcgctgaatgactttgacaggttcaaggtcatgttggctaagattaagaggggtggtgctatcaggcaagagcttgccaagctcaagaaggaggttgctgcttagaatatcctagtggatggcatgttgagttttttgttccaagttggatctgctctatgttccagtgttcttaaagccagaattagtacaactgttttcggagaactacttcatattttgtcatggctgttattgaatacccaagctagtttgctacagatgtgcctcttgccttattcatatgtgatatgttgcccggttctctgtttttacttttgacttgtg

SEQ ID NO: 411 - DNA, 723 bp, Triticum aestivum
cctcttgcctttctgcccgcccacccgtctcctcgcctcgccgtctcgccccacgccaccgccgcagccgctgcaaagatgccgttcaagaggttcgtcgagatcgggcgggtggccctggtgaactacggcaaggactacggccgcctcgtcgtcatcgttgacgttgtcgaccagaaccgggcacttgtggatgctcccgatatggtcaggtgccagatgaacttcaagcgtctttcgctgaccgacatcaagattgacatcaagcgtatccctaagaaggccactttgatcaaggccatggaggaagctgatgtgaaaaccaaatgggagaacagctcatggggtaagaagcttgttgtccagaagagaagagcatcgctgaatgactttgacaggttcaaggtcatgttggctaagattaagaggggtggtgctatcaggcaagagcttgccaagctcaagaaggaggttgctgcttagaatatcttagtggatgacatgttgagttttttgttccaagttggatctgctctatgttccagtgttcttgaagccagaattagtacaactgttttcagcgaactatttcatattttgtcatggttgttattgaatacccaagctagtttgctacagatgtgcctcttgccttcgttcatatgtgatatgttgcccggttctctgcttttacttttgacttgtgctcttgtggttattttt

SEQ ID NO: 412 - DNA, 798 bp, Triticum aestivum
tcatcgctgtctggaacagcgatgctcttgcctttctgcccgcccacccgtctcctcgcctcgccgtctcgccccacgccgccgacgcaaagatgccgttcaagaggttcgtcgagatcgggcgcgtggccctggtgaactacggcaaggactacggccgcctcgtcgtcatcgtcgacgtcgtcgaccagaaccgggcacttgtggatgctcctgatatggtcaggtgccagatgaacttcaagcgtctttcgctgaccgacatcaagattgacatcaagcgtatccctaagaaggcaactttgatcaaggccatggaggaagcagatgtgaaaaccaaatgggagaacagctcatggggtaagaagcttgttgtccagaagagaagagcatcgctgaatgactttgacaggttcaaggtcatgttggctaagattaagaggggtggtgctatcaggcaagagcttgccaagctcaagaaggaggttgctgcttagaatatcttagtggatggcatgttgagttttttgttccaagttggatctgctctatgttccagtgttcttaaagccagaattagtacaactgttttcagcgaactatttcatattttgtcatggctgttattgaatacccaagctagtttgctacagatgtgcctcttgccttctttcatatgtgatatgttgcccggttctctgcttttacttttgacttgtgctcttgtggttatttattaagatttcagtagggtaagcatgtcttttgaatctaagtgggaactgttaattaaataag

SEQ ID NO: 413 - DNA, 663 bp, Avena sativa
ggcctccccaactcgctcgctccagcttctctgagccgccgccgccgtcgtccgcaccgccgcaaaatgccgttcaagaggtttgtggagatcgggcgggttgcccttgtgaactacgggaaggactacggacgcctggtcgtcatcgtcgacgtcgtcgaccagaacagggcacttgtggatgcacctgacatggtccgatgccagatgaacttcaagaggctctcgctgaccgacatcaagatcgacatcaagcgcatccctaagaaggcgactctgatcaaggcactggaggaagctgatgtgaagaacaagtgggagaacagctcttggggcaagaagctgattgtccagaagaggagggcatcgctcaatgactttgacaggttcaaggtcatgctggccaagatcaagaggggaggagctatcaggcaagagcttgcgaagcttaagaaggaggttgcttctgcttagatcagtttggtgtgcaacctgttgaggttttgatcagagcactgttttggtgtttaaatcctgaaatattgtgtgaattactcgtaactgttattgatgtgatgagatggtagtattaaacatgcagtgtttgagattttgccagaattcttcagaatcgtaggtggtatgttgtctgttatgctatct

SEQ ID NO: 414 - DNA, 708 bp, Secale cereale
tgaaatcaaagagaaacaccaaccagcccaccctgcaccgcactctccctcctctccccgttccccaaccaaccgccgccagcctctcacccagcctccgccgccgctgcgaagatgccgttcaagaggttcgtcgagatcgggcgggtggccctggtgaactacggcaaggactacggccgcctcgtcgtcatcgtcgacgtcgtcgaccagaaccgggcactcgtggatgctcctgatatggtcaggtgccagatgaacttcaagcgtctttcgctcaccgacatcaagattgacatcaagcgtatccctaagaaggcaactttgatcaaggccatggaggaagcagatgtgaaaaccaaaatgggagaacagctcatggggtaagaagcttgttgtccagaagagaagagcatcgctgaatgactttgacaggttcaaggtcatgttggctaagattaagaggggtggtgctatcaggcaagagcttgccaagctcaagaaggaggttgctgcttagaatatcttagtgaatggcatgttgagttttttgttccaagttggatctgctctatgttccagtgttcttaaagccagaattagtacaactgttttcagcgaactatttcatattttgtcatggctgttattgaatacccaagctagtttgctacagaagtgcctcttgccgttattcatatgtgatat

SEQ ID NO: 415 - DNA, 1857 bp, Triticum aestivum
cacatggtcgagctcgacggaagaaggtgcctttgtcgctgtggtcttcgccggtgtgctccacgtcgtgtacgacggcgacctcctagctcgggctcttcgtcaagttggtgatgttgcctagagtatcccgacgacgacggaggaggagaacaaggaccaccggcccctaagggctgacgagaaccaacaccttcaagccgccatggagctcccatccctcccctggagtgcgtcaaggtccttcttcccctccccgcagcatgtatctctcctactccatcaactcttgctgttcgtgatgataaatcccagcgtttcttgcttttttctgttattagagagtaggaaacgttgacactttaggaattgccattgttatttacgcatagcaaggaatcctgccaagagagccttggtgatggggtcacaaaggacagcagcagcagaaagaacattaacacctctatctgaaaaacatcactaattgttagcttttggtaggaagacatgtacgtaacctaagatcagagtttaactagatatatatacaacctaaagcaaatcaaggttcagagaggcacacttacctttggcagcagctttttcttgctgttgatgttgatgaacacagcagtcacacgaatagataaagcatacatagaaggagaagctgtccaataaaactgatgcatgttgacagttcctcgagttctcttaagatgatataattgtttggtagacgcatggatggatggacacgtacagctagcagcctagcagtgctagtcacaaaagaaaaaccttgtgattgattcatggtcatggcacaacaacaatggatacttgctaattggtgatggtggtcgtgccgctgccgccttcggcaccatcccagctcgcagcctcagtcgatttgctctgcgtctccaaccgtccaaagatcccaaccctatcatcgtctcctaccacgagcttggcaacgagatcggacatggcaagttcggctccgttcggatctatggtaggaagacctgtgaaatccaactcgccgttaggccttttctgtcgccttctctctggtggtcttggttgttgaccatggttgccttgtttttgtgctcgtacaaccgttcaagaggttcgtggagatcgggcgggtggccctggtgaactacggcaaggactacggccgccttgtcgtcatcgtcgacgtcgtcgaccagaacagggcacttgttgatgctccggacatggtccgctgccagatgaacttcaagcggctctctctgaccgacatcaagattgacatcaagcggatccctaagaaggcaactttgatcaaagctatggaggaagctgatgtgaagaccaagtgggagaacagctcatggggcaagaagttggttgtccagaagaggagggcatcgctcaatgactttgacaggttcaaggtcatgctcgccaagatcaagaggggaggagctatcaggcaggagctagctaagcttaagaaggaggttgctgctgcttagatcactttggcgggcagactgttgagcctttggtcagcgttgtatcttcgccccaaaatcgtgaaatattgtgtgaatcactcagcactgttattggtgtatcagatgaaaatttagtagtgtttgagattttgctggacttgtcaggatctgagatagtatgttatctatctgctatttgtgatgccatctaaattcatgggccttgtgcttactgttagtatgctgcctgtttacctccagctgtccaaaatcatggacccccagtggctccaccgggcattattcctggaacagctttgttccaatcgatcatgtttat

SEQ ID NO: 416 - DNA, 802 bp, Eragrostis curvula
  misc_feature (225)..(225): n is a, c, g, or t
  misc_feature (665)..(667): n is a, c, g, or t
  misc_feature (690)..(692): n is a, c, g, or t
  misc_feature (694)..(694): n is a, c, g, or t
  misc_feature (700)..(700): n is a, c, g, or t
  misc_feature (706)..(707): n is a, c, g, or t
  misc_feature (710)..(710): n is a, c, g, or t
  misc_feature (712)..(712): n is a, c, g, or t
  misc_feature (738)..(738): n is a, c, g, or t
  misc_feature (746)..(746): n is a, c, g, or t
  misc_feature (749)..(749): n is a, c, g, or t
ctcgctcgccgtctctctcgctgccgcttcgcgccgccgctcgcctctccgaccgccgcgaagatgccgttcaagaggttcgtcgagatggggcgggtggccctggtgaactacggcaaggactacggccgcctcgtcgtcatcgtcgatgtcgtcgaccagaacagggctcttgtggatgccccggatatggtcaggtgccagatgaacttcaagcgcctttcncttaccgacatcaagattgacatcaagcgtgtccctaagaagtcgaccctgatcaaggcaatggaggaagctgatgtgaagggcaagtgggagaacagctcatggggcaagaagctgattgtccagaagaggagagcagcgctcaacgactttgacaggttcaaggtcatgttggcgaagatcaagaggggtggtgctgtcaggcaagagctcgccaagctcaagaaggcggccacagcttaggtggactgcatgttgagtttttggttccgtgttggatcagcaatggtttcagtgttcttaaagccagaattagtactactgtttcatgtgaacccatttcgaattttatcaagcacatggatgtgccttagagattttgtcatgactgttgtgtgggatgcctgaggtagctttgtgatgaatgtgcaacgtgcaannnaaaaaaaaaaaaaaaaaaaaaannntnctcggngttgannccncngtttaatcaaattcccccggcccccnggggggcnggnaacatgcaacttcgggcccatttccccctatagggagtcaaattacaattccg

SEQ ID NO: 417 - DNA, 899 bp, Sorghum bicolor
cactttataggccactcccaccgccgaaccctagtttctgtttggacttccgccgcgcttcgccctctcgctccagccgcttcacagcgtcgccgccgcagctcgcctctccgaccgccgcgaggatgccgttcaagaggttcgtggagatcgggcgcgtggccctggtgaactacggcaaggactatggccgcctcgtcgtcatcgtcgatgtggtcgaccagaacagggcacttgtggacgcccctgatatgatcaggtgccagataaacttcaagcgtctttcacttactgacatcaagattgacatcaaacgtgtccccaagaagacaaccctgatcaaggcgatggaggaagctgacgtgaagaccaagtgggagaacagttcatggggcaagaagctgatcgttcagaagaggagggcagcgctcaatgactttgacaggttcaaggtcatgctggcaaagatcaagaggggtggtgctatcaggcaagagctcgccaagctgaagaaggcatccacggcttagtctccttcagtggatggcatgttacagtttttggttctgagttgtatcagcaattcgatcgagtgttgtcaaagccagaattagtaatatgtttcctgtgaacccatttcaaactttgtcaagcatgggtgtgttctggatattttgtcgtgaatgttatggaatatctaaggtagcctgtgacaaatgtgcgatccttacaatttctgttttgtttattgctagtgtttttaggcaaccagggtattggcataatcgatattgcgatcctgcctaagctgtcatttctttttcactgcttgcatgcctatgtggtcttttgaatggaaagttgctccaatagttctcaaagtgttttctacctcatcc

SEQ ID NO: 418 - DNA, 784 bp, Saccharum officinarum
cctgctggtaccctgtcagtacggtccggaatcccgggtcgcaccacgcgtccgcgccgcgcttcgccctctcgctccagccgcttcacagcgccgccgccgctcgcctctccgaccgccgcgaggatgccgttcaagaggttcgtggagatcgggcgcgtggccctggtgaactacggcaaggactatggccgcctcgtcgtcatcgtcgatgtggtcgaccagaacagggcacttgtggacgcccctgatatggtcaggtgccagctgaacttcaagcggctctcacttactgacatcaagattgacatcaaacgtgtccccaagaagacaactctgatcaaggcgatggaggaagctgatgtgaagaccaagtgggagaacagctcatggggcaagaagctgattgtccagaagaggagagcagcactcaatgacttcgacaggttcaaggtcatgctggttaagatcaagaggggaggtgctatccggcaagaactcgccaagctgaagaaggcctccacggcatagagtctctattggtggatggcatgttagagtttttggttctgagttggatcagcaattcgattgagtgttgtcaaagccagaattagtaatatgtttcttgtgaacccgtttcaaactttatcaagcatgggtgcagtgcactctggatattttgtcttgaatgatgtggaatatctaatgtagcttatgaccatatcatttctgttttgcttattgccagtgtttctaggccacttggataatgttggcataa

SEQ ID NO: 419 - DNA, 1220 bp, Sorghum bicolor
cgcacgccactttataggccactcccaccgccgaaccctagtttctgtttggacttccgccgcgcttcgccctctcgctccagccgcttcacagcgtcgccgccgcagctcgcctctccgaccgccgcgaggatgccgttcaagaggttcgtggagatcgggcgcgtggccctggtgaactacggcaaggactatggccgcctcgtcgtcatcgtcgatgtggtcgaccagaacagggcacttgtggacgcccctgatatgatcaggtgccagataaacttcaagcgtctttcacttactgacatcaagattgacatcaaacgtgtccccaagaagacaaccctgatcaaggcgatggaggaagctgacgtgaagaccaagtgggagaacagttcatggggcaagaagctgatcgttcagaagaggagggcagcgctcaatgactttgacaggttcaaggtcatgctggcaaagatcaagaggggtggtgctatcaggcaagagctcgccaagctgaagaaggcatccacggcttagtctccttcagtggatggcatgttacagtttttggttctgagttgtatcagcaattcgatcgagtgttgtcaaagccagaattagtaatatgtttcctgtgaacccatttcaaactttgtcaagcatgggtgtgttctggatattttgtcgtgaatgttatggaatatctaaggtagcctgtgacaaatgtgcgatccttacaatttctgttttgtttattgctagtgtttttaggcaaccagggtattggcataatcgatattgcgatcctgcctaagctgtcatttctttttcactgcttgcatgcctatgtggtcttttgaatggaaagttgctccaatagttctcaaagtgttttctacctcatccatgccatccagcaatgaaatttctgtacttggtgcataattttgctgtgcactcgttgcacatcttgctgcatgccagatatcctttggtgaagtgtttttaaacccttgggaatgcacggtggagtatccagatactagggtgaggcacccgtgccagtgctctttgacgaggctctgctgcgcctgttattgttcaacgtgggcatcttcctattcttgtatacaagcatgagctcttttcaaacttcagagaccggagaccctttgtcttgatgacaatgactcttgggaatgcaatggacagtggctgcg

SEQ ID NO: 420 - DNA, 592 bp, Festuca arundinacea
gccgcaaaatgccgttcaacaggtatgtggagatcgggcgggtggcccttgtgaactacggcaaggactacggccggctggtcgtcatcgtcgacgtcgtcgaccagaacagggcacttgtggacgcacctgacatggtccgatgccagatgaacttcaagcggctctcgctgactgacatcaaggttgacatcaagcgcatccctaagaaggcaactttgatcaaggcactggaggaagctgatgtgaagaacaagtgggagaacagctcatggggcaagaagctgattgtccagaagaggagggcttcgctcaatgactttgacaggttcaaggtcatgctggccaagatcaagaggggaggagctatcaggcaagagctcgccaagctgaaaaaggaggttgctgctgcttagaacactttggtgtgcaacctgttgagattttaatcagcaatgttttgatgccctaaatcctgaaatattgtgtgaattactcactgttattcgtgacttgatgaaatgttagtattgaacatccagtcgttgagatcttgcagaattcataagaatctgagatgttatgtttggta

SEQ ID NO: 421 - DNA, 1158 bp, Zea mays
cacattatatgtcactcccaccgccgaaccctagtttctgttcggacttccgccgcgcttcgccctctcgctccagccgcttcacagcgccgccgctcgcctctccgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaagacgaagtgggaaaacagctcatggggcaagaagctgattgtccagaagaggagggctgcgctcagtgactttgacaggttcaaggtcatgctggcaaggatcaagaggggtggtgctatcaggcaagagctcgccaagctgaagaaggcgtccacggcttaagtcccttttggtggatggcatgttagtttttggtttcatgttgcatcagcattttgttttgagtgttgtcaaagccagaattagtaatatgtttcatgtgtacccttttcaaacttcatcaagaatgggtgtgctctggatattttgtcgggaatgatatgaaatacttaagttagcttgcgacaaatgtgcatgcttcccatttgagttttgtttattgccagtgtttttaggcagggtttaaaatagcggcgctatagccggcgttttgggtgaccaaaagctacgctaaaccattttcacgcgctatatcacctatgagtgctatagcttaaaatagcgccgctaaatgcaatagtgctagcacgaaatagctggcactatttctggagtggaccaaaaatagagcataatcctacggtccatgaaggcccaaaattaaacctaaagtcatctgagagggacagctggacaagcactaagccacgtccctcaaacctcaaagaaacggcggcgtgtctccttgctggtgctcacagggctccatttcgtgacggcgaggaccgaggagaagcagcggaggtgttcagttgctggcgtgttccttcacttccttgcttagctgcttcctggc

SEQ ID NO: 422 - DNA, 620 bp, Musa acuminata
gcacgaggtttcttcgctcccatcgactgcggcggacgttctcggtctcttgcctctgtgtcgcccgcaagatgccgttcaagcgatatgtggagatcggcagggttgccctcgtgaactacggaaaggaatacggcaggcttgtcgtcatcgttgacgtgatcgatcagaacagagccttggttgatgctcctgacatggtacgtggccaaatgaacttcaagaggctctctctcactgatataaagatcgacataccacgagttcccaaaaagaagacccttatcagtgccatggaggctgctgatgtgaagaacaaatgggagaacagttcgtggggcaggaagctaatcgtgcagaagagaagagcttcactaaatgactttgacaggttcaaggtcatgctggcaaagattaagagaggaggtgctatcaggcaggagctggccaagctaaaaaaggagaacgcagcttgagcttctcacgagtggttggtgaattttgttcaattcatcttggaactccatttgtgttcgttaggattggattttctgcagatccttggacttaggttgggagtactgatggccttgaaatattaaattgcaagctttggttct

SEQ ID NO: 423 - DNA, 981 bp, Musa acuminata
atggccgatcagggacccgacccggctcaggtaaagccggtccgggacgtgtgcaccggttcaaatgtatcagttcagaccgaattgcttgggtttttacgaattcgaggctcaaagtggctgttcccacctcatctacccctttcttgccctctctctaccccgcggcggacgtctccctctctcgtcctcaaaatgccgttcaagcgatatgtggagatcggcagggttgccctcgtgaactatgggaaggaatatggccggcttgtcgtcattgtcgacgttatcgatcagaacagagctttggttgatgctcctgacatggtacgtggccaaatgaacttcaagagactctctcttactgacataaagattgacataccacgagtccccaaaaagaagacccttattgatgccatggaagcggctgatgtgaagaacaaatgggagaaaagctcatggggcaggaagttgattgtgcagaagaggagagcttcattgaatgactttgacaggttcaaggtcatgttggcaaagattaagagaggaggtgctatcaggcaagagctggccaagcttaaaaaggagaatgcagcttgagcttctcattgaaagttgatgaattttgtcaaatttatttcctgtcaagcagtggtgtctgtcttaaatcaaaaatctctgatgtgactttagattttgcatttagtactggaggtcttaaaaggtttttgtgacactgattgagctatggttttaatgttatgtttttatcatcatttctcctggaatttcggcaacaaagtgataaaatcatgaaatataacttgttaggtcatgttttcgcagcagtttttagttacccggaatgcaatgccggggtgccaacttgattactagataccggttagaaccatgcttcattgagctgcttgacttctggagataattgaaggcttaaaatgaatcgttttgacatcagaa

SEQ ID NO: 424 - DNA, 681 bp, Musa acuminata
gggccctctctcgcccgcggcggacgtctccctctctcgccctcaaaatgccgttcaagcgatatgtggagatcggcagggttgccctcgtgaactatgggaaggaatatggccggcttgtcgtcattgtcgacgttatcgatcagaacagagctttggttgatgctcccgacatggtacgtggccaaatgaacttcaagagactctctcttactgacataaagattgacataccacgagtccccaaaaagaagacccttattgatgccatggaagcggctgatgtgaagaacaaatgggagaaaagctcatggggcaggaagttgattgtgcagaagaggagagcttcattgaatgactttgacaggttcaaggtcatgttggcaaagattaagagaggaggtgctatcaggcaagagctggccaagcttaaaaaggagaatgcagcttgagcttctcattgaaagttgaattttgtcatttatttcttgtcaagcagtggtgtctatcttaagtcaaaaatctctgatgcgactttagattttgcatttagtactggagctcttaaaaggtttttgtgacactgattgaactatggttttaatgttatgtttttatcatcatttctcctggaatttcggcaacaaagtgataaaatcatgaaatataacctgttaggac

SEQ ID NO: 425 - DNA, 825 bp, Actinidia deliciosa
cctctctctactctctccctagccggtcctctgaaagccgtagccaaaatgcctttcaagcgttacgtcgagatcgggagagtagccctcgtcaactacggcaaggaatacggcaggcttgtcgtcatcgtcgatgtcatcgaccagaatcgagctcttgtggatgcccctgacatggtgagatgccaaatgaattttaagaggctgtctctcacagacatcacaattgacatcaaaagagttccgaaaaagaagacactgattgctgcaatggaggctgcagatgttaagaacaagtgggagaatagctcctggggcagaaagctgattgtgcaaaagagaagggcctctcttaatgattttgataggttcaagctcatgttggcaaaaatcaagaggggtgggctgatccgacaagagctagcaaagcttaaaaaacagaacgcagcatgctgagcgtttttattttgttatgtaattccaattttgttatgaattatctcaagctgaatttgttgctttttgattctgagttaatgtctgtcagtcttgagaacttttggctactcattttcgtctcctctttccttttttttttagttttgagaagatattagaacttcaaaaaccatttgttctgttttaagtgttgggtcttctttgaaggtttcttcccatgtcatatctttgttggtttcagttttttgttcaattttactatctgcaaaaacccatcagctggaaaagttgaatagaaagtatattcctacggcttcactgtcagtgatgcgtaaattgccgattgaacgctacgcatgttgaatc

SEQ ID NO: 426 - DNA, 716 bp, Musa acuminata
atgaacccgccgatccccctttttgccgtcccgtttgttcgctcccatcgactgcggcggacgttctcggtctcttgtctctctccgttcaagcgatatgtggagatcggcagggttgccctcgtgaactacggaaaggaatacggcaggcttgtcgtcatcgttgacgtgatcgatcagaacagagccttagttgatgctcctgacatggtacgtggccaaatgaacttcaagaggctttcactcactgatataaagatcgacataccacgagttcccaaaaagaagacccttatcagtgccatggaggctgctgatgtgaagaacaaatgggagaacagttcgtggggcaggaagctaatcgtgcagaagaggagagcttcgctaaatgactttgacaggttcaaggtcatgctggcaaagattaagagaggaggtgctatcaggcaggagctggccaagctaaaaaaggagaacgcagcttgagcttctcacgagtggttggtgaattttgttcgatacatcttggaactccatttgtgttcgttaggattggattttctgcagatcgttggacttaggttgggagtactgatggccttgaaatattaaattgcaagctttggttctcatgtcatctttgtcctcaccatgtgttgctgctttcttcaattattgccccgcaagtgatctgaatccttcagggattgttttgg

SEQ ID NO: 427 - DNA, 500 bp, Gossypium hirsutum
gcaccaggcctatcgtcgccgtctcgctcctcgccgccgcaaagatgccgttcaagaggttcgtcgagatcgggcgggtggccctggtgaactacggcaaggactacggccgcctcgtcgtcatcgtcgacgtcgtcgaccagaaccgggcactcgtcgacgctcctgatatgatcaggtgccagatgaacttcaagcgtctttcactgactgacatcaagattgacatcaagcgtatccccaaaaaggcaactttgatcaaggccatggaggaagctgatgtgaaaaccaaatgggagaacagctgctggggcaagaagcttattgttcagaagagaagagcatcgctgaatgactttgacaggttcaaggtcatgttggctaatattaacaggggtggtgctatcaagcaagagcttgccaagctcaagaaggaggttgctgcttacaatacctgactggatgttgcatgttgagttttgcgttaccatagtcttggg

SEQ ID NO: 428 - DNA, 674 bp, Musa acuminata
gggacggccaacgaagcaagcctgaaacaccggttcgttataagaccttggcacaccccccaactcgccgccttgtctcttcccccttccatcgcgtgcggcggcctcgttctctctttgtcggattcaaatgccgttcaagcgatatgtagagatcggcagggttgccctcgtgaactacgggaaggaatacggcaggcttgtcgtcatcgtcgacgttattgatcagaacagagccttggtcgatgctcctgacatggtgcgtggtcaaatgaacttcaagaggctttctcttactgatataaggatcgacataccacgagttcccaagaagaagacccttattgctgccatggaagctgctgatgtgaagaacaaatgggagaacagctcatggggcaggaagctaattgtgcagaagaggagagcttcactaaatgactttgacaggttcaaggtcatgttggcaaagattaagagagggggtgctatcaggcaagagctggccaagcttaaaaaggagactgcagtttgagttcctctcgagtagtaggcgaattttgtcgaatttatttctgttttgttgagagctcgcagcgaaaactaatgaattccttgtgtgttttgtggatttggatttttgagaaatattcaaactttataagctgctgttt

SEQ ID NO: 429 - DNA, 1010 bp, Vitis vinifera
atgaaatgggttgaattggatttacatttaatttgggcttctcgaaaaaggcccaaagggttttccgctgtctccacattcatcctccttttttgcatcgtccgcctctctgctctcagccacgcccaggccaaaatgcctttcaagcggtacgtggagatcgggcgagtcgctctcgtcaactacggcaaagaatacggcaggctcgtcgtcatagtcgatgtcattgatcagaatcgggctcttgtggatgcacccgacatggtgagatgccaaatgaactttaagaggctttcactcactgatatcaaaattgacatcaaaagggtgcctaagaaaaaaacattgattgaagctatgaatgccgcggatgttaagaacaagtgggagaatagttcctggggcagaaagttgattgtccagaagaggagggcctctcttaatgactttgataggttcaagatcatgttggcaaagattaagaggggtggagtgatcaggcaagagctggcaaagctgaaaaaacagactgcatcctaggcactaattttcaatgggatcccaattttgttatgaattttctgcaatttggattgttttgtctattagttttaaagtttaaaagctacttaagaaacttcttgtatctttttacagaccagtaatcagtcttagtttttttgggggagactattatgttaagatgcatggatgtgatcactgggttgtttatcaccactataaggttgctgtctttgtcgtctaatttcctatgggaattggatagggtgtgatttagaacaaatcaacatgcatctataagctctgggatttcatttagaggctttgtgtacggaattgttttcttgtcatatggattactatcttgtcctatttgcctgtgccagcaggttataggattcttgagtttgttgcaatctggatgatgctagaactgcattttgccctagcaacctgtttttaagacaggtctgtgttcggccaaactt

SEQ ID NO: 430 - DNA, 608 bp, Musa acuminata
gggccttgtctcttcccccttccatcgcgtgcggcggcctcggtctctccttgtcgccttcaaatgccgttcaagcgatatgtagagatcggcagggttgccctcgtgaactacgggaaggaatacggcaggcttgtcgtcatcgtcgacgttattgatcagaacagagccttggtcgatgctcctgacatggtgcgtggtcaaatgaacttcaagaggctttctcttactgatataaggatcgacataccacgagttcccaagaagaagacccttattgctgccatggaagctgctgatgtgaagaacaaatgggagaacagctcatggggcaggaagctaattgtgcagaagaggagagcttcactaaatgactttgacaggttcaaggtcatgttggcaaagattaagagaggtggtgctatcaggcaagagctggccaagcttaaaaaggagactgcagtttgagctcctctctaagtagtaggctaattttgtcgaatttatttctgttttgttgagagctcgaagcgaaaactaatgaattccttgtgtgttttgtggatttggattttcgagaaatattcaaactttataagctgctgttt

SEQ ID NO: 431 - DNA, 1039 bp, Vitis vinifera
atggagttttttaatttatataatttacatggtcataaggttttgaaccaaattagacttatatcgggcttcaactcccccaaaaaggcccaaagggcttccaagcccaataccatcgtaacacaaagatcaaggacccagatcggtccaaaacggactataaagaaacccagaaaaaccctaagccccgtctctccatctaccccccttgcatcttccatttttcccctccctgctgtcagccgcgccctagcaaatatgcctttcaagcggtacgtggagatcgggcgagtcgctctcgtcaactacggaaaagactacggcaggctcgtcgtcatagtcgatgtcattgatcagaatcgggcccttgtggacgcacctgatatggtgagatgccaaatgaactttaagaggctttcactcacagatatcaaaattgacatcaaaagggtgcctaagaaaaaaacattgattgaagcaatgactgctgcagatgttaagaacaagtgggagaatagctcctggggcagaaagctgattgtgcagaagaggagagcatctcttaatgactttgataggttcaagatcatgttggcaaagatcaagaggggtggagtgatcaggcaagagcttgcaaagctgaaaaaacagactgcatcctaggcgctaattttcgatggaattccaattttgttatgcattttctgcaacttggattgttttatctttattagttttaaagcttgaaatcagcttatgaaaaacttcttgcgtcttattaaagacaagtaatcagtgttgtttttttgttagactattttgtcagaacgagcctagatcgagccttgtgtttattgggtgagatgcatggatgtggcagcaggttttttatcaccactataatgttcctgccattgtttgattccctattttaagggaatagggtgggatatagaacaaatcaatttgcatcaatagaacttgtgctgaccttgaattgattcctgtggaattggctttttgtcagatggattaatat

SEQ ID NO: 432 - DNA, 822 bp, Sarracenia psittacina
gtatctttctctccggtccattgaataaatcctcggccaaaatgccattcaagcgttacgttgagatcgggagggttgccctcgtgaactacggaaaggactatgggaggctcgtcgtcatcgtcgacgttatcgatcagaaccgagctcttgtggatgcccctgacatggtgagatgccaaatgaattttaagaggctctctctcacagacatcacaatcgatattaaaagggtgccaaataagaaaacgctgattgcagcgatggaggctgcagatgttaagaacaagtgggagaatagctcttggggcagaaagctcattgttcaaaaaagaagggcatctctcaatgattttgataggttcaagctcatgctggcaaaaatcaagaggggtggactgatcagacaagagcttgcaaagcttaaaaagcaaaacgcatcctgagcctttttatattgcaatgaaataccaactttattatgaatttttgcaagctgcagttcggattttcttcccttgtttgttgattaagagactaatgtcagttttaaggataagtggaactctgaagtttttccccccattttgtttgatgatttcttgcgaggccgctgctgatttcactgtctttgatttcactctcttggtctatcttctttccaatctggaacttaggagccatcgctatgcctccttttctaaatttgggctgtcgtgcaacgctatgttttctatttctcacatatgcaacgacgttgtagacgaagtttaggtgcttgaggaatgagcattcaaaatgagaattctcattttatgaaac

SEQ ID NO: 433 - DNA, 481 bp, Aquilegia formosa
gaaaatggtaaaacctttcaacttgaatctctttcttgattctcttgattgtttactaacttttgatcgatttgtgtagcctttcaagcgatatgttgagatagggagagttgctcttgtgaactatgggaaagattatggaagacttgttgttatcgttgatgttatcgatcagaatcgggctcttgttgatgccccagatatggttagaagccaaatgaattttaaaaggctttcgttgacagacatcaagatcgaaattggcagggtccctaaaaagaagaatctgatagaggccatggaagctgcagatgtcaagaacaaatgggaaaacagctcctggggcaggaagctgattgtgcagaagaggagggcttctctgaatgactttgataggttcaaactcatgttagctaaaatcaagagaggtggagcaatcaggcaagaacttgcaaaactgaagaaacaagcagcttgatat

SEQ ID NO: 434 - DNA, 1002 bp, Musa acuminata
atggcagatcttagaagatccagccccaaaacattattacggcaccattctggatctcgaatcttgttaggaagcgatgactctacgagttgtaatctaatgcacaagttaaactgtaagcaaaacaagagcttttcaggactgtcagatcaaagcgaacggaatggggtgtgcaatcgtggaggtcgcgaatcagaacgatcggaatatatagagatatcagtggctcccgatctggggaattcgtcgaagagcgaattggcggatagctgtattgggattcagggagatgaacggcaaagagggccggccaagaatcaaagactcttcacgaccgacgcagagagggagacttgtgacgaaaagtttgtcgggagggaggataatacgtacgagagggaagggaccctttctaccccaagtcattttgtggttgcaagaccaaggccgttttggtatatcgcatcatgccctagatcggacggtcagggaggcaagatcaaatcccgaacgatcagaaaaccttataggtgctttacggccctctctcttgagcgtggcggtacactctctctctctctctctctcgccctcgaaatgccgttcaagcgatatgtggagatcggcagggttgcgcttgtgacctacgggaaggaatacggcaggctcgtcgttatcgtcgatgttatcgatcagaacagagctctggtcgattctcctgacatggtacgaggccaaatcaatttcaagaggctctctcttactgatataaagattgacataccacgggtccccaagaagaagacccttcttgatgccatggaagctgctgatgtgaagaacaaatgggagaacagctcatggggaagaaaactaattgttcagaagaggagagcttcactgaatgattttgacaggttcaaggtcatgctggcaaagattaagagaggaggcgccatcaggcaagagctggccaagcttaaaaaggcagatgtggcttga

SEQ ID NO: 435 - DNA, 746 bp, Vaccinium corymbosum
tggttccttattacggccggggccaccaggcaccttcttcatttcccctctctcctcaatccgcctctccctcatcctctcagaccaaaatgccgttcaagcgttacgtcgagatcgggagggtggctctggttaactacggcaaggaatatgggagactcgtcgttatcgtcgacgttatcgaccaaaacagggctcttgtggatgcccctgacatggtgagatgccagatgaactttaagaggctttctctcactgacatcaccattgacatcaaaagggccccaaagaagaaaacactgattgctgcaatggaggctgcagatgttaagaacaagtgggagaacagctcctggggcagaaagctgattgtgcataaaagaagggccgctcttaatgattttgataggttcaagctcatgttggcaaaaatcaagaggggtggactgatcagaaaagagcttgcgaagctgaaaaagcagaatgcagcctaggcataacgtttctatgatcatgcccgaattttgttacgatttttcgaaggttgtactgatggctagttttgatttgtttctttctaatttacagtttgagaactgtctgtattctattaagagatcccagaatttggctttttggggttggttatagttttcctgatggcaatgttttgtcaaatgaaccaagaacgtttaatcgtatggattcagaatagttttattcccaaaaatggattcagattcaat

SEQ ID NO: 436 - DNA, 701 bp, Musa acuminata
tctctgtctctctctctctcgccctcgaaatgccgttcaagcgatatgtggagatcggcagggttgcgcttgtgacctacgggaaggaatacggcaggctcgtcgttatcgtcgatgttatcgatcagaacagagctctggtcgattctcctgacatggtacgaggccaaatcaatttcaagaggctctctcttactgatataaagattgacataccacgagtccccaagaagaagacccttgttgatgccatggaagctgctgatgtgaagaacaaatgggagaacagctcatggggaagaaaactaattgttcagaagaggagagcttcactgaatgattttgacaggttcaaggtcatgctggcaaagattaagagaggaggcgccatcaggcaagagctggccaagcttaaaaagacagatgtggcttgagcttctcatcaatggctggtgaattttgtcgaatttatttctggttcctcagccagggttctgttatccatttacatgtccttaaacggattgaatgtactttttgatattttgcaactcagattttgcttttattgataggcccaaaagtgataagaagtgatgcctatatttttgaagtcatgatctgtagttcccagatcacgtttgtatgacagtaaagtacatgactatttttatgatcaggagtacatggtgtgtgtatag

SEQ ID NO: 437 - DNA, 764 bp, Ricinus communis
acgtgttaacttactgtacgctgaagcgcaccggataaccatcatgagaagaaaaccctagcagcagtatttctagtcatcgccaaaacgttatcacgtcgtttgttgcctctgtcgacgattctcagaaaatcgggccaaaaatgccgttcaagaggtacgttgagattgggagagtggctctagtcaactacggcaaggattacgggaagctagttgttatcgtcgatgttatcgatcaaaacagggctctggttgatgctcctgatatggtaaggagccaaatgaacttcaagaggttaacactgacagacataaagattgatatcaaaagggttcctaggaagaaaactcttattgaagccatggaaaacgccgatgtgaagaacaagtgggagaatagttcttggggaaggaagctcattgtgcagaagagaagggcttcccttaacgattttgataggttcaagctcatgttggcaaagatcaagagaggaggattcatcaggcaggagcttgcaaaacttaaaaaggaagctgcttagaatttgcttgcttgttttgaaccttttaaatttttttatgaatctgatacatgctaatcagttgtccaaatcaattttcatggactatcgaagggtattaatgatagctatagacttcctttttttttgtgtgtgatactttgagaaggtggaaatgaaccatgctttagctgtatttgttaatgtgctcagttgtttccacattgagtcttttccacc

SEQ ID NO: 438 - DNA, 623 bp, Castanea mollissima
ctccctcccacagcgtctccactccttcagatcccaggaaaaacaaaatgccgttcaggaggtttgtggagattggaagagtggcgcttgtgaactatgggaaggagtatggaagacttgttgtcattgtcgatgttgtcgaccagaatagggctcttgttgatgcccctgatatggtgaggacccaaatgaacttaaagaggctttcactcactgatattaagattgacatcaagagggttccaaagaagaagactttggttgaggccatggaggctgctgatgtgaagaacaaatgggagagcagttcctggggaaggaagttgattgtgcagaagagaagggcctcacttaatgattttgataggttcaagataatgttagcaaaaatcaagagggctggaattgttaggcaggagcttgcaaaactcaaaaaagaaagtgcagcctaagatggttcaattcaatatggttttgttggatcttgtttgaactagttcttggtttgttttcatctatgctttaattagttgcgggaaccaattagctggtgtttgtgtcatggatattatgagaagtttgacctctagggactattaatggaatatctgcacctttttttt

SEQ ID NO: 439 - DNA, 664 bp, Zingiber officinale
gcacgagggacgcacgctcactcctctcacctgcggcgcgactcctccttcttcagtgctcccaatatgccgttcaagcgatatgtggagatcggcagggttgccctcgtgaactatgggaaggaatatggaaggctcgtcgtcatcgtcgacgttatcgaccagaacagggctttggttgatgctcctgatatgattcgtggccaaattaacttcaaaaggctctctcttactgatataaagattgacataccacgagtccctaagaagaagaccctcattcaagctatggaggctgctgatgttaagaacaagtgggaaaacagctcatggggcaggaagcttattgtgcagaagaggagagctgccctaaatgactttgacaggttcaaggtcatggtggccaagattaagcgaggacgtgccataaggcaagaattggccaaacttaagaaggaaaatgcagcttgagctcggattaacctgtgaaatttgttcctgtttctgattctgtacgggtgttagttgtcttgtcgagagttgctagtcgaagttattgatttcttttccttgttcagaacttggatttcttcaaatattctgaattaagatttgggtaaagtagaaaaaattcctaatcaaaatcacaattttacttgcaaaa

SEQ ID NO: 440 - DNA, 611 bp, Quercus alba
tgcctccctcccacagcgtctccactccttcagatcccaggaaaaacacaatgccgttcaggaggtttgtggagattggaagagtggcgcttgtgaactatgggaaggagtatggaagacttgttgtcattgtcgatgttgtcgaccagaatagggctcttgttgatgcccctgatatggtgaggacacaaatgaacttaaagaggctttcactcactgatattaagattgacatcaagagggttccaaagaagaagactttagttgaggccatggaggctgctgatgtgaagaacaaatgggagagcagttcctggggaaggaagttgattgtgcagaagagaagggcctcacttaatgattttgataggttcaagataatgttagcaaaaatcaagagggctggaattgtcaggcaggagcttgcaaaactcaaaaaagaaagtgcagcctaagatggttcaatttaatatggttttgttggatcttgtttgaactagttcttggtttgttttcatctatgttttaattagttgcgggaaccaattagctggtgtttgtgtcatggatattatgagaagtttgacctctagggactattaatgaaatat

SEQ ID NO: 441 - DNA, 681 bp, Sesamum indicum
cctaaatttattgccctcttccctggctcatactccgcctctccccacacagcacacacactcactaacgtatcgtagaaaatgccgttcaagaggtacgtcgagatcggaagggtggcccttgtcaactacggcaaggaatatggcaagcttgtcgttatcgtcgacgttatcgaccagaacagggctcttgtggatgcccctgacatggtacggagccagatgaacttcaagaggctttctcttacagacatcaagattgacatcaaaagagttccaaagaagaagactctgatagctgctatggaggctgctgatgtcaagggaaaatgggaaaagagctcctggggtaggaagctgattgttcagaagagaagggcctcccttaatgattttgaccggttcaaactgatgctggcaaagatcaagagggctggtgttgttcggcaggagcttgctaagcttaagaaagaaactgctgcctgagtagtatagtttctggattttacaattttggtgtaggtttttggaagttgtattgtttactatgcagacttccttgttcctgaattcattacagaagggaaagtacttcaatttttgcatattaccagttgaacttgtttgagaatcactgtgctctataactgttattaaaattcagtcttagtttggttctaa

SEQ ID NO: 442 - DNA, 610 bp, Sesamum indicum
cttcccactcgcttcttctcctagtccgcattcgcagattgttgccgaaaatgccgttcaagaggtacgtggagatcggaagagtggccctcgtcaattacggcaaggagtatgggaagcttgtcgttatcgttgacgtaatcgaccagaaccgggccctagtcgatgctccagacatggtacggagccagatgaacttcaagaggctctctctcacagacatcaagatcgacatcaagagagttccaaagaagaagactcttatagctgctatggaggctgccgatgtgaagggcaaatgggaaaagagctcctggggaaggaagctgattgttcagaagaggagggcttccctgaatgatttcgaccggttcaaactaatgctggctaagatcaagagggctggtgtcgtccggcaggagcttgcaaaattaaagaaagagagtgcggcctgagcaagtataatttccgatatttaagagtttggcgtacggatatgaaagttgtgttggtttatcatgcggatttactttctattgaattcattgcgaaaagaagaatactccaattttgcctcttatgattcgaacttatttgaaaatcattattc

SEQ ID NO: 443 - DNA, 827 bp, Sesamum indicum
tcactttcacccccgcccttgcttcccactcgcttcttctcctagtccgcattcgcagattgttgccgaaaatgccgttcaagaggtacgtggagatcggaagagtggccctcgtcaattacggcaaggagtatgggaagcttgtcgttatcgttgacgtaatcgaccagaaccgggccctagtcgatgctccagacatggtacggagccagatgaacttcaagaggctctctctcacagacatcaagatcgacatcaagagagttccaaagaagaagactcttatagctgctatggaggctgccgatgtgaagggcaaatgggaaaagagctcctggggaaggaagctgattgttcagaagaggagggcttccctgaatgatttcgaccggttcaaactaatgctggctaagatcaagagggctggtgtcgtccggcaggagcttgcaaaattaaagaaagagagtgcggcctgagcaagtataatttccgatatttaagagtttggcgtagggatatgaaagttgtgttggtttatcatgcggatttactttctattgaattcattgcgaaaagaagaatactccaattttggctcttatgatttgaacttatttgaaaatcattattctctaaaccttttttaagctttgacatagcctccggcatttctcttccataacttctggggcttgctaatgattctcaaattccaagttcaatttgttgcatgttaaatgttctacattctcgctaatgatgtctttttctcttgtcgacattgacgagccattcaaagtatgtgaattagttaagttactgctggg

SEQ ID NO: 444 - DNA, 713 bp, Solanum phureja
taatcccctcattgtaaaccctaacacaatcctctctttcatctcactctttttcgcagcttcacagctccttcagatcagtaaaaatgccgttcaagaggttcgtggagatcggaagagttgcactcgttaactacgggaaggactatgggaggctcgtcgtcatcgttgacgttatcgaccaaaacagggctcttgttgatgctcctgacatggtgaggagccagatgaacttcaagaggctttcactcacagatatcaagatcgacatcaagagaattccaaagaagaagaccctgattgctgctatggaggctgctgatgtgaagaccaagtgggagtccagttcctggggaaggaagttgatcgtgcagaaaaggagggcttcactcaacgattttgataggtttaagctcatgttggcaaagatcaagagggctggtgtggtgagacaggagcttgcaaagcttaaaaaggaggttgcagcttaagaacttttcaagtagtgaaacattgatttaaagcaattttggaagttgtatttacttttgggaatatatttacccgccctgttttttttctgtctttccatttttgcctgttttagacttgctgggaaattatttttctgatcttatgaatggtgtactgtttgtttcacagaatgcttgctcagttttttcatattgtctaccttgcacactttgcagcca

SEQ ID NO: 445 - DNA, 697 bp, Solanum melongena
agcctgctcgcgcttctactccttcagatcgccgaaaatgccgttcaagaggttcgtggagattggaagggtagccctaatcaactatggaaaggattatggaaagcttgttgttatcgtcgacgtcgtcgaccaaaatagggctcttgttgatgctccagacatggtgaggagccagatgaacttcaagaggctttcacttacagatatcaaaattgacatcaaaagaatcccaaagaagaacaccttgattgaggctatggaagctgctgatgtgaagaccaagtgggagaacagttcatggggaaggaagttgatagtgcagaagaggagggctggacttaatgattttgacaggttcaagcttatgttggcaaagattaagagagctggagttgtgagacaggagcttgcaaagctcaagaaggttgctgcttgagaactctctgatcagttcaattgatatataggctttttggatcttgtattttgtttaggtttgagggatgttattagaagaattctgttatatttcatgccttgcgatattttaagacttttgagatcatttttgtctgagattttgcttaattatgatgggaaattgccaacttctgcatcatctccttgtatcctgaaatggtttaatgtctttctatatagtaacaacaaataacaaaatgtctccttttggacc

SEQ ID NO: 446 - DNA, 625 bp, Platanus occidentalis
tctgcacaggcgctctctccctcagattcgacaatgcctttcaagcggtacgtggagatcgggagagtcgctctcgtcaattacgggaaggactatggaaggctcgtcgtcatcgtcgacgttattgaccaaaatcgggctcttgttgatgctcctgacatggtgagaagccaaatgaatttcaagaggctctcactgacagatattaagattgacatcaagaggatcccgaaaaagaaatcactgatcgcagctatggaggctgcagatgttaagaacaaatgggagaacagctcctggggcaggaagctgattgtgcagaagagaagggcctccctcaacgattttgatagattcaaaatcatgttggcaaagatcaagagaggtggagtgatcaggcaagagcttgcaaagctgaaaaagcagagtgcatcctaagttgattttatttgaaactctcaattttgttatacatttatgcaagttgtttttgggtacttcttttatttaactttgttttaagagattaagtgcagttaaacaaattgctggtattgtaggtcatcatgagatctgtcccatcagaaatgattagtttgtattaatttgcttttcagaaaatttt

SEQ ID NO: 447 - DNA, 663 bp, Solanum tuberosum
ttcacagcttcacagctccttcagatcagtaaaaatgccgttcaagaggttcgtggagatcggaagagttgcactcgttaactacgggaaggactatgggaggctcgtcgtcatcgttgacgttatcgaccaaaacagggctcttgttgatgctcctgacatggtgaggagccagatgaacttcaagaggctttcactcacagatatcaagatcgacatcaagagaattccaaagaagaagaccctgattgctgctatggaggctgctgatgtgaagaccaagtgggagtccagttcctggggaaggaagttgatcgtgcagaaaaggagggcctcactcaacgattttgataggtttaagctcatgttggcaaagatcaagagggctggtgtggtgagacaggagcttgcaaagcttaaaaaggaggttgcagcttaagaacttttcaagtagtgaaacattgatttaaagcaattttggaagttgtattacttttgggaatatatttacccgccccgtttttttttatttgtctttccatttttgcctgttttagacttgctgggaaattatttttctgatcttatgaatggtgaactgtttgtttcacagaatgcttgctcagttttttcatattgtcacctgcacactttgcagccaaa

SEQ ID NO: 448 - DNA, 748 bp, Elaeis guineensis
gaaccctagtcctagttcctctttgtctcgccctctctccgccaatctgcgaccatgccgttcaagcgatacgtggagatcgggagggttgccctcgtgaattatgggaaggattacggcagactcgtggtcatcgtcgacgttgttgaccagaaccgagctctggttgatgcccctgacgttgttcgaggacaaatgaattttaagaggctttccttgactgatattaagattgacattcctagacttcctaagaagaagaccttgattgctgccatggaagctgcagatgtgaagaataagtgggaaaatagttcatggggaaggaaattgattgttcagaagaggagagctgccttgaatgactttgacaggttcaaggtcatgttggcaaggatcaagaggggtggtgccatccagcaagagcttgcaaaactgaagaagcagaacgcatcctgaggtgcaagggggataggttttgtggattttgttggatattgcttgtgacgcttcagctattgcaactttacttttgattattgttccaaagccaaaacttgggggatcttttagaagggacgctgtcagagattttgtctagatatttgcatttttaggagaatttttttaccaattgtgttctttcaccatggattgtctacaggtaactaattattttgtttgcaatattatgcttttccctgtttctggaccttcagtctggattgagagtattgtgaggaccaaa

SEQ ID NO: 449 - DNA, 633 bp, Elaeis guineensis
tagctccatctcctccctcgcacgccgcagctcttttctgtcccaaaatgccgttcaagcgttacgtggagatcgggagggtcgcgcttgtcaactatgggaaggactatggcaggcttgtcgtcatcgtcgatgttatcgatcagaatcgagctctggttgatgcccctgacatggtgcgaggacaaatgaatttcaagaggctttccttgactgatataaagattgacattccaagacttcctaaaaagaagtccctaattgctgccatggaagctgctgacgtgaagaacaaatgggagaacagctcatggggaaggaagctcatcgtgcagaagaggagagcttcactaaatgactttgacaggttcaaggtcatgctggcaaggatcaagaggggaggtgctatccagcaagagcttgctaaacttaagaagcaaaatgcgtcttgagctccttattgatgcaatttttccaagtctggttggtctgcgccaattcttttttttttgttgtcattaggtggtccggattggctaatgtttaagatggattttgaatagagagctcttgctggtgttgagttttatgaaactatattatttatttgaagtttttatgaaaaaaaaaaaa

SEQ ID NO: 450 - DNA, 836 bp, Elaeis guineensis
ggaaaaccctctctctcttcatccctcgcgcgccgcaggtccctcccctttcccaagaatgccgttcaagcgttacgtggagatcgggagggttgctctcatcaactatgggaaggactacggcaggctcgtcgtcatcgtcgacgtcgtcgatcagaatcgagctctggttgatgccccagatatggtgcgaggccaaatgaacttcaagcggctttccttgactgacataaagattgacattccaaggcttcctaaaaagaagtccctaattgctgccatggaagctgctgatgtgaagaacaaatgggagaacagctcgtggggaaggaagctgattgtccagaagaggagagcttcactaaatgactttgataggttcaaggtgatgctggcaaggatcaagagaggaggcgctatccagcaagagcttgcaaaactgaagaagcagaatgcatcttgagctcgtcattgataacatcttttgccaagtctgcttgtgatgcatggatcattttttatggtcagtaggcagtccagtttggcagatgtttaaggtaggttttcacatagagaggttcctatgagctttcatgttttgagaattttgtgacgctagattatttgtttgaagtttttatggcaccaatgaaaaaatatgctttcatttctttagtaagcgccttcttatttgaaatactattgtactgcctccgctggcagatcttagatgagaattacgaggaatgcgtagtttgggtaagtagtaggactttaattagaacggaaagatgggcgtggaagtaatcatttttaatttggcgataggttgggta

SEQ ID NO: 451 - DNA, 776 bp, Citrus sinensis
gatctctactcatctccgcctctcgcgctactgtcttcctcacacagccacacaccatcaccaaccagaatccccaaaaatgccgttcaagaggtacgtggagatcgggagggtcgccctcgtcaactacggcaaagaatacggcaggctcgtcgtcatcgtagatgtcttagatcagaacagagctctagttgatgcccctgatatggtgagaggccaaatgaacttcaagaggctttcactgactgatatcaaaattgacattccccgtgtaccgaagaagaagacattgattgatgctatggagaaggctgatgttaagaacaagtgggagagtagctcttggggaagaaagctgattgttcagaagaagagagcatcacttaatgactttgacaggttcaagcttatgttggccaagatcaagaagggaggtttggtcaggcaggagcttgcgaagctgaagaaggagaatgcagcctaatgttatccgatatgtagcttccaattttgttatgatgatggctaagttttcttcaagaatgttttacatttatttttgtgtcagttctgagattaagaccaatttaagaagatgctttttatattatgatactgtagtcagttttacctgcaaatccttcttgtctgcaggcttgttttactttttaagaatttttacatggatgtattatcatcttgtgtttcatttgctactaatttgaaaattaggaatggtggggccaatgatttgtctaatttatacgatatcatga

SEQ ID NO: 452 - DNA, 661 bp, Zingiber officinale
  misc_feature (5)..(5): n is a, c, g, or t
  misc_feature (8)..(8): n is a, c, g, or t
  misc_feature (582)..(582): n is a, c, g, or t
  misc_feature (623)..(623): n is a, c, g, or t
gcacnagngtttgcggcagaactgcttcctcctcgccgccgaaatgccgttcaagcgatatgtggagatcggcagggttgccctcgtcaattacgggaaggagtacggaaggctcgtcgttatcgtcgatgtcatcgatcagaacagggctttggtcgacgctcctgatatgattcgtggccaaattaacttcaagaggctttctcttactgatataaagattgacataccgcgtgttcctaagaagaagaccctgatcaaagccatggaagctgcagatgtgaagaataaatgggagaatagctcatggggcaggaagcttatcgtgcagaagaggagagctgcgctgaatgacttcgacaggtacaaagtcatggtggccaagatcaagagaggacgtgccatcagacaagaattggccaaactgaaaaaggagaacccagcttgagcttgtgaggattagtctttctgatccagtgcaggtgcttcagtcttgttggagttggaggatataccatttccatgtttttcctagaacttgaatttctagagatattctgacttgagatttttgctattatngaccctccaacaatgatggtcgtgaacttttgtttacaagnaaattaagttgtttgcaggtctttagatttccgtcgtc

SEQ ID NO: 453 - DNA, 779 bp, Actinidia deliciosa
cggcgttactcttccagcaggaccagcacttgatagaagctctcgcttttcgccgttctcagatcgccgaaaatgccgttcaagaggtacgtggagatcggaagggttgctctcgtcaactacggcaaggactatgggaggctcgtcgtcattgtcgacgtcatcgatcagaacagggcgcttgttgatgcccctgatatggttcgaacccaaatgaatttcaagcggctgtcactcacagatattacgattgacatcaagagggttccaaagaagaagactttaattgcagccatggaggctgctgacgtcaagaacaaatgggagaacagttcctggggcaggaaactcattgtgcagaagagaagggcttctctgaatgattttgataggttcaagattatgctagcgaaaatcaagaaagctggagtcgtcaggcaggaacttgcgaagctcaagaagcagagcgcagcctagaaccttctctcttcttatctggagattttgatgtagatctttgcaagttgtgttggtatctgcattttgggttcattttcacttgttcttggattaatcacagcaagggaggagcccacaatatttttgcttttcgtaatgccatctgactccatttgaaactattattgttatttgagatatctttgatttagcattgagaacctatgtttgcacattgacaatatgtttggatatccagttgtgtctgcttggagttttgtaattgcatttgattgctaaatttttttaaaaaaaaaaaa

SEQ ID NO: 454 - DNA, 684 bp, Elaeis guineensis
  misc_feature (630)..(630): n is a, c, g, or t
ccctagtcctagttcctctttgtctcgccctctctccgccaatctgcgaccatgccgttcaagcgatacgtggagatcgggagggttgccctcgtgaattatgggaaggattacggcagactcgtggtcatcgtcgacgttgttgaccagaaccgagctctggttgatgcccctgacgttgttcgaggacaaatgaattttaagaggctttccttgactgatattaagattgacattcctagacttcctaagaagaagaccttgattgctgccatggaagctgcagatgtgaagaataagtgggaaaatagttcatggggaaggaaattgattgttcagaagaggagagctgccttgaatgactttgacaggttcaaggtcatgttggcaaggatcaagaggggtggtgccatccagcaagagcttgcaaaactgaagaagcagaacgcatcctgaggtgcaagggggataggttttgtggattttgttggatattgcttgtgacgcttcagctattgcaactttacttttgattattgttccaaagccaaaacttgggggatcttttagaagggacgctgtcagagattttgtctagatatttgcatttttaggagaatttttttaccnattgtgttctttcaccatggattgtctacaggtaactaattattttgtttgcag

SEQ ID NO: 455 - DNA, 651 bp, Elaeis guineensis
attgccgtgaggaaaatcctagctccatctcctccctcgcacgccgcagctcttttctgtcccaaaatgccgttcaagcgttacgtggagatcgggagggtcgcgcttgtcaactatgggaaggactatggcaggcttgtcgtcatcgtcgatgttatcgatcagaatcgagctctggttgatgcccctgacatggtgcgaggacaaatgaatttcaagaggctttccttgactgatataaagattgacattccaagacttcctaaaaagaagtccctaattgctgccatggaagctgctgacgtgaagaacaaatgggagaacagctcatggggaaggaagctcatcgtgcagaagaggagagcttcactaaatgactttgacaggttcaaggtcatgctggcaaggatcaagaggggaggtgctatccagcaagagcttgctaaacttaagaagcaaaatgcgtcttgagctccttattgatgcaatttttccaagtctggttggtctgcgccaatctttttttttttgttgtcattaggtggtccggattggctaatgtttaagatggattttgaatagagagctcttgctggtgttgagttttatgaaactatattatttatttgaagtttttatgatgtcccatgc

SEQ ID NO: 456 - DNA, 768 bp, Elaeis guineensis
  misc_feature (38)..(38): n is a, c, g, or t
tggaaaaccctctctctcttcatccctcgcgcgccgcnggtccctcccctttcccaagaatgccgttcaagcgttacgtggagatcgggagggttgctctcatcaactatgggaaggactacggcaggctcgtcgtcatcgtcgacgtcgtcgatcagaatcgagctctggttgatgccccagatatggtgcgaggccaaatgaacttcaagaggctttccttgactgacataaagattgacattccaaggcttcctaaaaagaagtccctaattgctgccatggaagctgctgatgtgaagaacaaatgggagaacagctcgtggggaaggaagctgattgtccagaagaggagagcttcactaaatgactttgataggttcaaggtgatgctggcaaggatcaagagaggaggcgctatccagcaagagcttgcaaaactgaagaagcagaatgcatcttgagctcgtcattgataacatcttttgccaagtctgcttgtgatgcatggatcattttttatggtcagtaggcagtccagtttggcagatgtttaaggtaggttttcacatagagaggttcctatgagctttcatgttttgagaattttgtgacgctagattatttgtttgaagtttttatggcaccaatgaaaaaatatgctttcatttctttagtaagcgccttcttatttgaaatactattgtactgcctccgctggcagatcttagatgagaattacgaggaatggatgttggatgagcttat

SEQ ID NO: 457 - DNA, 666 bp, Unknown
  Sequence found in Organisms: Euphorbia peplus, Euphorbia esula
aggagttgattctcagttaatccaccgaaaatgccgttcaagaggtacgttgagattgggagagtcgctctggttaattacggcaaagattacggcaagcttgtcgtcatcgtcgatgttgtcgatcaaaacagggcacttgtcgatgctcccgacatggttaggagtcaaatgaacttcaagaggttatcactcactgatatcacaattgatatcaatagggttcctaagaagaaaactctagttgaagccatggagaaagctgatgtgaagaacaagtgggagaacagttcatggggaaggaaacttatcgttcaaaagagaagggcctcacttaatgatttcgaccggttcaagcttatgttggccaagatcaagaggggaggactcgtaaggcaagaactcgcaaagctcaagaaggctgcagcttagaatatcttggtttttgttttagcgaattcgagaagcctttatagtttatttttggatttttccaattttgtgcaaattatttgtgggaaccatatttgcttcggcctgtttgcccggccaagttaatgataggtggtagaccatattttttatcagcagtattgttatttaaatgctactaaaagagtttaagaaaaaaaatatcaatattgaatttaagaactttgaacaatc

SEQ ID NO: 458 - DNA, 783 bp, Solanum lycopersicum
taatcccctcaatgtaaaccctaacacaatcctctctttcatctcactcttttttcgcagcttcacagctccttcagatcagtaaaaatgccgttcaagaggtttgtggagatcggaagagttgcactcgttaactacggggaggactatgggaggctcgtcgtcattgttgacgttatcgaccaaaacagggctcttgttgatgctcctgacatggtgaggagccagatgaacttcaagaggctttcactcacagatatcaagatcgacatcaagagaattccaaagaagaagaccctgattgctgctatggaggctgctgatgtgaagaccaagtgggagtccagctcctggggaaggaagttgatcgtgcagaaaaggagggcctcactcaacgattttgataggtttaagctcatgttggcaaagattaagagggctggtgtggtgagacaggagcttgcaaagcttaaaaaggaggttgcagcttaagaacttcttcaagtagtgaaacattgattcaaagcaattttggaagttgtatttttacttttgggaatatatttatcctttttttttttaattcgtctttccatttttgcttgttttagacttgctgggaaattatttttctgatctatgaatggtgaactgtttgtttcagagaatgcttgtctacctacactatcaaaactctctttcttttgaaattcattgttcagaaatcgtattcacaacaacgtttatatatttcagtataatttatacttcactagtggagtt

SEQ ID NO: 459 - DNA, 633 bp, Chelidonium majus
cgccccctttcctcagctcactagtttctgcaaagatgcctttcaagcgatacgttgagattgggagagttgctctcgtcaattacgggaaagattatggaagacttgttgtgatcgttgatgtcctcgaccaaaacagggctcttgttgatgcacctgatatggtaagaagccaaatgaacttcaagaggctctctttgacagacatcaagattgatatccctagaatccctaagaagaagactttgattgaagccatggcagctgcagatgttaagaacaaatgggagggcagttcctggggaaggaagctgattgttcagaagaagagggcttccctgaatgattttgataggttcaaggtcatgctggcaaagatcaagaggggtggagctatccgacaagagcttgcaaagctgaagaagcagagtgcatgagtcttttgatctcattgtgaagtcaatttgattagagagaattttcagtgccagttgttttttgctacttgttttacttcgttttcgccattttaaagatttaagaatacagttgagtaaagcaggaaactactaggtatttggattatttatgcaagagttagaccttctataccagagttttggtttttgaagc

SEQ ID NO: 460 - DNA, 882 bp, Citrus clementina
taaaaaaaaaaaaaaaccctaaatcgtttggtccaaaaccctttataaaagcagcgtagttaaaaaaccctagcttccgtttgatctctactcatctccgcctctcgcgctactgtcttcctcacacagccacacaccatcaccaaccagaatccccaaaaatgccgttcaagaggtacgtggagatcgggagggtcgccctcgtcaactacggcaaagaatacggcaggctcgtcgtcatcgtagatgtcttagatcagaacagagctctagttgatgcccctgatatggtgagaggccaaatgaacttcaagaggctttcactgactgatatcaaaattgacattccccgtgtaccgaagaagaagacattgattgatgctatggagaaggctgatgttaagaacaagtgggaaagtagctcttggggaagaaagctgattgttcagaagaagagagcatcacttaatgactttgacaggttcaagcttatgttggccaagatcaagaagggaggtttggtcaggcaggagcttgctaagctgaagaaggagaatgcagcctaatgttatccgatgtgtagcttccaattttgttgtgatgatggctaaattttcttcaagaacgttttacatttatttttgtgtcagttctgagattaagaccaatttaaggagatgctttttatattatgatactgtagtcagtgttacctgcaaatccttcttgtctgcaggcttgttttactttttaagaatttttacatggatgtattatcatcttgtgtttcatttgctactaatttgaaaattaggaatggtggggccaatgatttgtctaatttatacgatatcatgataatagtggctataattatgatga

SEQ ID NO: 461 - DNA, 654 bp, Euonymus alatus
gggggggaaaccccagtagtattgtttagacggtagaaaccctaataatttgctctcgtacctcagtacctcactcactatcctccactaagctggtcgcagatcttcgaagatgccgttcaagaggtacgtggagatcggcagggtggctcttgtcaactacgggaaagactacggcaagctggtcgtgatcgtcgatgttctggatcaaaatagggctctagttgatgcccctgacatggtgaggagccagatgaacttcaagagactatcactgactgatatcacgattgacatcaaaagggttcctaaaaagaagaccctgattgaagccacggaaaaagctgatgtgaagaacaaatgggaaaacggttcctggggcaggaagctgattgtgcagaagagaagggcctcactcaatgattttgataggttcaagattatgttggcaaagatcaagagaggtggaattatcaggcaggagcttgccaaactcaaaaaggaggcagcctaaagttggttttcttgtgtttaatcaatccccagaccaagttttagtttttattcttttggtgtatttgtatagtccatagcattaagttgtggcaattgactattaaattcaagtctaaatgattggattatacaaagtta

SEQ ID NO: 462 - DNA, 890 bp, Citrus sinensis
aaaaattaaaaaaaaaaaaaaaaaccctaaatcgtttggtccaaaaccctttataaaagcagcgtagttaaaaaaccctagcttccgtttgatctctactcatctccgcctctcgcgctactgtcttcctcacacagccacacaccatcaccaaccagaatccccaaaaatgccgttcaagaggtacgtggagatcgggagggtcgccctcgtcaactacggcaaagaatacggcaggctcgtcgtcatcgtagatgtcttagatcagaacagagctctagttgatgcccctgatatggtgagaggccaaatgaacttcaagaggctttcactgactgatatcaaaattgacattccccgtgtaccgaagaagaagacattgattgatgctatggagaaggctgatgttaagaacaagtgggagagtagctcttggggaagaaagctgattgttcagaagaagagagcatcacttaacgactttgacaggttcaagcttatgttggccaagatcaagaagggaggtttggtcaggcaggagcttgcgaagctgaagaaggagaatgcagcctaatgttatctgatatgtagcttccaattttgttatgatgatggctaagttttcttcaagaatgttttacatttatttttgtgtcagttctgagattaagaccaatttaagaagatgctttttatattatgatactgtagtcagttttacctgcaaatccttcttgtctgcaggcttgttttactttttaagaatttttacatggatgtattatcatcttgtgtttcatttgctacaaatttgaaaattaggaatggtggggccaatgatttgtctaatttatacgatatcctgataatagtggctataattatgatga

SEQ ID NO: 463 - DNA, 491 bp, Platanus occidentalis
cctttctcctcagcttcaacaatgcctttcaagcggtacgtagagatcgggagagttgctctcgtgaattacggaaaggattatgggaagctcgtcgtgattgttgacgttatcgaccaaaatcgggctcttgttgatgcccctgatatggtgagaagccaaatgaatttcaagaggctctcattgacagatattaagattgacattaagaggatccctaagaagaaatcactgattgctgctatggaggctgcagatgtcaagaacaaatgggagaatagctcttggggcaggaagctgattgtgcagaagagaagggcctctcttaacgactttgataggttcaaaatcatgttggcaaagatcaagaggggtggagtgatcaggcaggagcttgcgaaactgaagaagcagagcacggcctaatttaatttaatttcgaaacctcaattttgttatagattttttcaagttctttttgggtattgtct

SEQ ID NO: 464 - DNA, 632 bp, Tripterygium wilfordii
ccaccaagtcggtcgcagatcttcgaagatgccgttcaagaggtacgtggagattggcagggtggctcttgtcaactacgggaaagactacgggaagctggtcgtgatcgtcgatgttctcgatcaaaacagggctcttgttgatgcccctgacatggtgaggagtcagttgaacttcaagagactatcactgactgatatcacaattgacatcacaagggttcctaaaaagaagaccctgattgaagccatggaaaaagctgatgtgaagaacaaatgggaaaacagttcctggggcaggaagctgattgtgcagaagagaagggcctcgctcaatgattttgataggttcaagattatgttggcaaagatcaagagaggtggaattatcaggcaggagcttgccaagctcaaaaaggaggcagcctaaagttggttttcttttgattaatcaatccccatctcaagttttagcttttatttttttggtgtagtatttggcttgtgggttattcgtcatttgctagttgctcctgaaacaaatatttcttttgtttggttttttcccattagtgtgacaagacttctcaactcgttgtgcatcaaattattgttattagttatttattttt

SEQ ID NO: 465 - DNA, 592 bp, Sesamum indicum
tgccctcttccctggctcatactccgcctctccccacacagcacacacactcactaacgtatcgtagaaaatgccgttcaagaggtacgtcgagatcggaagggtggcccttgtcaactacggcaaggaatatggcaagcttgtcgttatcgtcgacgttatcgaccagaacagggctcttgtggatgccctgacatggtacggagccagatgaacttcaagaggctttctcttacagacatcaagattgacatcaaaagagttccaaagaagaagactctgatagctgctatggaggctgctgatgtcaagggaaaatgggaaaagagctcctggggtaggaagctgattgtccagaagagaagggcctccctcaatgatttcgaccggttcaaactgatgctggcaaagatcaagagggctggtgttgttcggcaggagcttgctaagcttaagaaagaaactgctgcctgagtagtatagtttctggattttacaattttggtgtacgtttttggaagttgtattgtttactatgcagacttccttgttcctgaattcattacagaagggaaagtacttcaatttttgc

SEQ ID NO: 466 - DNA, 686 bp, Vaccinium corymbosum
ggcgccttcttcatttcccctctctcctcaatccgcctctccctcatcctctcagacctgaaaatgccgttcaagcgttacgtcgagatcgggagggtggctctggttaactacggcaaggaatatgggagactcgtcgttatcgtcgacgttatcgatcaaaacagggctcttgtggatgcccctgacatggtgagatgccaaatgaactttaagaggctttctctcactgacatcaccattgacatcaaaagggccccaaagaagaaaacactgattgctgcaatggaggctgcagatgttaagaacaagtgggagaacagctcctggggcagaaagctgattgtgcataaaagaagggccgctcttaatgattttgataggttcaagctcatgttggcaaaaatcaagagggtggactgatcagaaaagagcttgcgaagctgaaaaagcagaatgcagcctaggcataacgtttctatgatcatgcccgaattttgttatgatttttcgaaggttgtactgatggctagttttgatttgtttctgtctaatttacagtttgagaaccgtctgtattctattaagagatcccagaatttggtctttttggggttggttatagttttcctgatggcaatgttttgtcaaatgaaccaagaacgtttaatcgtatggattcagaa

SEQ ID NO: 467 - DNA, 554 bp, Sorghum bicolor
agccgttcaagaggttcgtggagatcgggcgcgtggccctggtgaactacggcaaggactatggccgcctcgtcgtcatcgtcgatgtggtcgaccagaacagggtaaggacaggcacttgtggacgcccctgatatgatcaggtgccagataaacttcaagcgtctttcacttactgacatcaagattgacatcaaacgtgtccccaagaagacaaccctgatcaaggcgatggaggaagagacgtgaagaccaagtgggagaacagttcatggggcaagaagctgatcgttcagaagaggagggcagcgctcaatgactttgacaggttcaaggtcatgctggcaaagatcaaggtcaggaacagaggggtggtgctatcaggcaagagctcgccaagctgaagaaggcatccacggcttagtctccttcagtggatggcatgttacagtttttggttctgagttgtatcagcaattcgatcgagtgttgtcaaagccagaattagtaatatgtttcctgtgaacccatttcaaactttgtcaagcatgggt

SEQ ID NO: 468 - DNA, 612 bp, Fagus grandifolia
tcgagagctcacccttttgcctcccacttcgtctccacacgaatccttcagatctcaccaaaaaaacaaaatgccgttcaggaggttcgtggagattggaagagtggcacttgtgaactatggaaaggagtatggaagacttgtggtgattgtggacgttctcgaccaaaacagggctcttattgatgcccctgatatggtgaggacccaaatgaacttaaagaggctttcactcactgatattaagattgacatcaagaggattcccaagaagaagactttggttgaggccatggaggctgctgatgtgaagaacaaatgggagaacagttcctggggaaggaagttgattgtgcagaagagaagggctgcacttagtgattttgataggttcaagctaatgttagcaaaaatcaagaggggtggaattatcaggcaggagcttgcgaaactcaaaaaggagagtgcagcctaagatgtttgaatttatactgtttggatcttgtttgaattagttcttggtttgttttcatttatgttttaattagtatcaggaaccaattatctggtgtttctgtttcatcaatattatgagaagtttgacctttatga

SEQ ID NO: 469 - DNA, 663 bp, Eschscholzia californica
acaatctctcagatttctcaaaaatgcctttcaagcggtatgtggagattgggagagttgctcttgtcaattacggaaaagattatgggagactagtagtgattgtcgacgttgttgatcagaacagggctcttgtcgatgcaccagatatggttagaagccaaatgaacttcaagaggctgtcgttgacagacattaagattgacataggcagaatccccaaaaagaaagccttaattgaagccatggaagctgcagatgttaagaacaagtgggagaacagctcttggggtagaaaattgattgtccagaagagaagggctgccctaactgactttgacaggttcaagcttatgttggcaaagattaagagaggtggagctatcaggcaagaactttcaaagctaaagaagcagagcgcgtgagacctccgattggaaatcaagattggttatgaggtttataaacttatttgttttatttagctacttgtttagattgtggtattttaccaattttgggattaaaagcagttcaagtcagacctagttacattgatcatctcatttgtggagttggaaaattcactattagttattaatgttattactgtttttataatgtttttgctctgttatattgattccagtggtgaaacacttt

SEQ ID NO: 470 - DNA, 687 bp, Eschscholzia californica
ttaactccatctctttctcttctctaccgccaccactcagatttttcaacaatgcctttcaagcgttatgtggagattgggagagttgctctcgtcaattacggaaaagattatggcagacttgtagtcattgttgatgttgttgatcaaaacagggctcttgttgatgcccctgacatggtgagaagccaaatgaacttcaagaggctcacattgacagacatcaagattgacattggaagaatcccaaagaagaaggctttgattgaggccatggaagctgctgatgtcaagaacaaatgggagaacagttcttggggcaggaaactgattgttcagaagaggagagctgctctgaatgactttgaccgcttcaaggttatgttggcaaagatcaagagaggtggagtaatcaggcaagagctctcgaagctgaaaaaggcgactgcttgagagttggatcctacctattgggatagtcgtgagttttgattagatctttttgaatttggttgtggttttagcttcttgttttcacaaatttagagattaagaacggttgagtgatacctttatgtattttggcatattatctatgcaatcagatgattcaggacgaagcattagttgtatttttttatcggtgttttttctttaatctcgtcattttaagctacatgtttgtgt

SEQ ID NO: 471 - DNA, 752 bp, Tropaeolum majus
ctaactcaactttacctacaaattcatcgtctctctcgtcaagactcttctacagatcctcgaaaatgccgttcaagaggtacgtcgagattggaagagtggcgctagtgaactatggaaaggattacggaaggcttgttgtaatcgtcgatgttctcgatcaaaacagggcccttgttgatgcacccgacatggtcaggagccaaattaacttcaagaggctttctctgactgatattaagattgaaattaacagggttcctaaaaagaagactttgattgaggcaatggaaaaagctgatgtgaagaacaaatgggagaatagttcatggggcaggaagcttattgtgcagaaacgaagaacctcacttaatgattttgataggtttaagctcatgttggccaaaatcaagagaggtggacttataagacaagagcttgcaaaactcaagaaagagaccactgcctgaagttccatgctttgctcttcaaactttccagttttgtctttaattacagtgtacttgatttggtttctcaatctcataggtgtcctattctccattaacattgatggacatatttagaaatgtaactggttttctttttgttccataatttgccattcggtgtagttattctctttgatgatttatgttgccaatccttattgattatgccaaatcattagtagttacaataagaagtccagagtagtgtgtttctctaaggtagccagatgttggatgaca

SEQ ID NO: 472 - DNA, 691 bp, Papaver somniferum
acttgtgttggaacgtactgtccacttatcttgacatttaaaaggagagaacaaaaccctaatttatcttccaaacaaactcaagcgacctcctctatcctccgtttcttcgttcccaccgccagaaatctcaaaatgcctttcaagcgttatgttgagattgggagagttgctctcgttaactacggtgaagattatggtagacttgtggtcattgttgatgtcatcgaccaaaacagggcacttgttgatgctcctgatatggagagaagccaaatgaacttcaagaggctctctttaacagatatcaagattgacattggcagaatccccaagaagaaagttttgatcgacgccatggaggctgcagatgttaagaagaaatgggaaagcagctcttggggaagaaagttgattgttcagaagaaaagagcatccttgaatgactttgacaggttcaaggtcatgttggcaaagatcaagagagggggagccattcgtcaggagcttgcaaagctgaagaaacaggctgcataagttttgaacatcacttgtgaaatcgaaccttgttaggaaagaaagaggattttgtagttgatttttggctacttattttggttctcatcctaccattttggagattttagaactactgttgtgtgtaatctacttggtatctggattttttatg

SEQ ID NO: 473 - DNA, 689 bp, Gossypium hirsutum
gtggtcttcagaaaccctaacttcagctattgcccttcttccccagtctctcaaaaatgccgttcaagaggtacgtggagattggaagagtagctctggttaactacggaaaggactacggcaagcttgttgtcattgtcgatgtcgttgatcaaaacagggctcttgttgatgcacctgatacggtaagaagccaaatgaactttaaaagactgactctcactgatatcaagattgatattaatagggttcctaagaagaagaccttgattgatgctatggaaaaagctgatgtgaagagcaagtgggagaacagttcatggggcaggaagctgatcgtccagaaaagacgggcatcgcttaatgattttgataggttcaagctcatgttggcaaagattaagaaggctggaatcgttaggcaggagctagctaaacttaaaaaggagacggcagcctaaacttttttctatttaagccttgccttgttatacatttcagtttgagatattgtaaacttctaccgactttttttctcataattgttgcttatgactcctgctatcaaacctctatctgaaattatggttgactttttaatctgaccctcatttccttttgaactgaaagttaatttttttgtatataatacattattgtttgaaataaagaagttaatgcatattaac

SEQ ID NO: 474 - DNA, 643 bp, Actinidia deliciosa
  misc_feature (13)..(13): n is a, c, g, or t
  misc_feature (16)..(16): n is a, c, g, or t
  misc_feature (19)..(20): n is a, c, g, or t
  misc_feature (56)..(57): n is a, c, g, or t
  misc_feature (60)..(60): n is a, c, g, or t
  misc_feature (108)..(108): n is a, c, g, or t
  misc_feature (111)..(111): n is a, c, g, or t
  misc_feature (128)..(128): n is a, c, g, or t
  misc_feature (132)..(132): n is a, c, g, or t
  misc_feature (156)..(156): n is a, c, g, or t
  misc_feature (180)..(180): n is a, c, g, or t
  misc_feature (624)..(625): n is a, c, g, or t
gccttcgtttccnctntcnntccgcctcctggtctttcgaggcaaaaaccctagannaanatgccgttcaagcgttacgtcgagatcgggagggtcgcgcttgtgaantanggcaaagactatgggcngctngtagtcatcgtcgacgttatcgancagaacagagctcttgtggatgcnccggacatggtgagatgccaaatgaacttcaagaggctctctctcactgacatcacaatcgacatcaaaagagtcccaacgaagaagacactgattgcagcaatggaggccgcagatgttaagaacaagtgggagaatagctcttggggcagaaagctaattgtgcaaaaaagaagagcctctcttaatgattttgataggttcaagctaatgttggcaaaaatcaagaggggtggactggtcagacaagagcttgcaaagctgaaaaagcagaactcatcctaagcttttatttttctattgagttccaattttgttatgaactttcacaagtttgtactgttgagtagttttcattttttccgtatttgcagtttaagatccagcctgagtaacttttttttatttataaaataaataaattatgacagaccttgcattcanngttagtttttttttggaa

SEQ ID NO: 475 - DNA, 696 bp, Liriodendron tulipifera
ggaagaagaaaccctaaaccctctctacagtcatgccgttcaagcgatatgtggagatcgggagggttgcccttgtgaattacgggaaggattatgggaagctcgtcgtcatcgtagatctcatcgatcagaaccgggctctcattgatgctcctgatatggttagaggtcaaatgaatttcaagaggctctcactgacagatatcaagattgacattcctagaatcccaaaaaagaagtctctgattgctgctatggaagctgcagatgtgaagaacaagtgggagaacagctcctggggccgaaagctgattgtgcagaagaagagagcttctctcaacgactttgataggttcaaggtcatgttggccaagatcaagagaggtggtgcaatcaggcaagagctcgcaaagctgaaaaagcaggctgcatcttaaattatatctgggactcccctgatttttgttacagatctgtctgtagttgtgattttggtactgttatttccgtttagttgttgttttaatatagattgggtaagtgcgatttggtgcgtcaccttcttctgactaacggtattttaagtaatctttgagatcccattaaaaatgctgagacttgcattttaaggtctagtgcaatgaactgtttctatttataaaatgccaaatgtcctttagggcccgttaggatatc

SEQ ID NO: 476 - DNA, 788 bp, Carica papaya
attgctctctcttccagcttcttgccgcatcctcctctctcctcttcgtaccagagctctccccagatcctcagagatgccgttcaagagatacgtggagattggaagagtggcgctggtgaactacggcaaggaatatgggaggctcgttgttatcgttgatgttatcgatcaaaacagggctcttgttgatgcccctgatatggtgagaagccaaatgaacttcaaaaggctatcactcactgatattaagattgacattaacagggttccaaaaaagaaggctctaattgaagccatgcagaaggctgatgttcagggtaaatgggagaaaagttcctggggcaggaaactgattgtgcagaaaagaagggcctcactcactgattttgataggttcaaggtcatgttggcaaagatcaagaggggtggaattatcaggcaggagcttgccaaactcaaaaaggagagcacagcctagaatttggttttttttttttttttttgtctcttataattctcctttcctactttagcaatttagcaattcggggacaaaaaaatcagctatttagcactttggtttttatgtctgttactgtgattaaatagagggagtcagatattctgcatcgttattagaaagtgggtagaaggttctcttcttgtttgtcttattttctcatgggtttgtttctgaaccagagaattgagatatggagtcacattggatttgaaattacttatttttagttgcgtgtttaatacaagcatcttattctggttta

SEQ ID NO: 477 - DNA, 594 bp, Petunia hybrida
ggtctactgcagcacatcgcccaaaatgcctttcaaaaggttcgtggagataggaagggtagctttaatcaactacggaaaagactacggaaggctcgttgttatcgtcgatgtcatcgaccaaaatagggcccttgttgatgctcctgacatggttaggagtcagatgaacttcaagaggctttcactcacagacatcaaaatcgacatcaaaaggatcccaaagaagaagaccctgattgatgctatggaagctgccgatgtgaagaccaagtgggagagcagttcatggggtagaaagttgatagtgcagaagaagagggcctcacttaacgatttcgacaggttcaagcttatgctggctaagattaagagggctggagtcgtgagacaggagcttgcaaagcttaaaaagaccgcagcctgagaagtttcagattagtgcaattgatatataggattttttgatcttgtgttttgtttagctttgacagatgttattaacaggaggctgttatgtttcttgcttatctatatttaagacgttttaaaatcatgtctgagattttgcttgtttaaaattgtgtaactcgc

SEQ ID NO: 478 - DNA, 612 bp, Solanum tuberosum
ccgaaaatgccgttcaagaggtttgtggagattggaagggtagccctaatcaactatggaaaggattatggaaggctcgttgttatcgtcgacgtcatcgaccaaaatagggctcttgttgatgctccagacatggtgaggagccagatgaacttcaagaggctttcacttacagatatcaaaattgacatcaaaagaattccaaagaagaagaccctggttgaggctatggaagctgctgatgtgaagaccaagtgggagaacagttcatggggaaggaagttgatagtgcagaagaggagggctgcacttaacgattttgacaggttcaagcttatgctggcaaagattaagagagctggagttgtgagacaggagctggcaaaacttaagaaggctgctgcttgagaactatctgatcagtgaaattgatatataggatttttggatcttgtattttgtttagctttgagggatgttatattagaacaagtctgttatatttcatgccttgcaatatttaagactttttgagatcatttttgtctgagattttttgcttaattaagatgggaagctaccaacttctttgtcaaaaaaaaaaaaaaaaaa

SEQ ID NO: 479 - DNA, 816 bp, Solanum lycopersicum
aaagcttctccatttgtaatctgctagcgcttctaatccttcagatcgccgaaaatgccgttcaagaggttcgtggagattggaagggtagccctaatcaactatggaaaggattatggaaggctcgttgttatcgtcgacgtcatcgaccaaaatagggctcttgttgatgctccagacatggtgagaagccagatgaacttcaagaggctttcacttacagatatcaaaattgacatcaaaagaattccaaagaagaagaccctggttgaggctatggaagctgctgatgtgaagaccaagtgggagaacagttcatggggaaggaagttgatagtgcagaagaggagagctgcacttaacgattttgacaggttcaagcttatgctggcaaagattaagagagctggagttgtgagacaggagcttgctaagctcaagaagattgctgcttgagaactttcttatcagtgtcattgatatataggatttttggatcttgtattttgtttagctttgagggatgttatttagaacaagtctgttatatttcatgccttgctgcaatattaagactttttgagatcatttttgtctgagattttttgtttaattatgatgggaagctaccaacttctgctcatctgctccatatttcctgaaattgcttgatgtcctacgtcgtaaaaaactcttcattgtcactctgatgaggtcttggacaggctcttggtgtgtaaattcaagaatttctcttggtgatgaagaaaattaaacaattattgcgtatggttcaaatataagaaatctttttgt

SEQ ID NO: 480 - DNA, 640 bp, Heritiera littoralis
tcttccacgccactccagttcttccttttccagatcgctcaaaatgccgttcaagaggtacgtggagattggaagagtggctctggttaactacggcaaggactatggcaagctcgttgtcattgtggacgtcgttgatcaaaacagggctcttgttgatgcacctgatatggtgagaagccaaatgaactttaaaaggctaactctcactgatatcaagattgatatcaatagggttcctaagaagaaaactttgattgatgcaatggagaaagctgatgtgaagaacaagtgggataacagttcatggggcaggaagctgatcgtgcagaaaagaagggcatcgcttaatgattttgataggttcaagcttatgttggcaaagattaagagggccggaattgttaggcaggagctggcgaaacttaaaaaggagagtgcagcctaatctttcttctatttaagactttcaatctcgttatacacttttcagtttttactctagtcattggatcctcgttttgattttagcaatgtaataattgcaaacatacagacttggctctttgcatccttattgttgtgactgttgctctagttgatttttccagtggctatttacatctagtaattatcgtgc

SEQ ID NO: 481 - DNA, 677 bp, Solanum phureja
agcttctccattggtagtctgctagcgcttctactccttcagatcgccgaaaatgccgttcaagaggtttgtggagattggaagggtagccctaatcaactatggaaaggattatggaaggctcgttgttatcgtcgacgtcatcgaccaaaatagggctcttgttgatgctccagacatggtgaggagccagatgaacttcaagaggctttcacttacagatatcaaaattgacatcaaaagaattccaaagaagaagaccctggttgaggctatggaagctgctgatgtgaagaccaagtgggagaacagttcatggggaaggaagttgatagtgcagaagaggagggctgcacttaacgattttgacaggttcaagcttatgctggcaaagattaagagagctggagttgtgagacaggagctggcaaaacttaagaaggctgctgcttgagaactatctgatcagtgaaattgatatataggatttttggatcttgtattttgtttagctttgagggatgttatattagaacaagtctgttatatttcatgccttgcaatatttaagactttttgagatcatttttgtctgagattttttgcttaattaagatgggaagctaccaacttctttgtcatctgctccttattagctgaaattgcttgatgtccta

SEQ ID NO: 482 - DNA, 700 bp, Euonymus alatus
acctcactcactatcctccactaagctggtcgcagatcttcgaagatgccgttcaagaggtacgtggagatcggcagggtggctcttgtcaactacgggaaagactatgggaagctggtcgtgatcgtcgatgttctggatcaaaatagggctcttgttgatgcccctgatatggtgaggagccagatgaacttcaagagactatcactgactgatatcacgattgacatcaaaagggttcctaaaaagaagaccctgattgaagccctggaaaaagctgatgtgaagaacaaatgggaaaacggttcctggggcaggaagctgattgtgcagaagagaagggcctcactcaatgattttgataggttcaagattatgttggcaaagatcaagagaggtggaattatcaggcaggagcttgccaaactcaaaaaggaggcagtctaaagttgattttcttgtgtttaatcaatccccagaccaagttttagatggtattcttttggtgtatttgtatagtccatagcattaagttatggcaattgactattaaattcaagtctaaatgattggattatacaaagttacaaacttggagctctggtactctacaaacaatggtggggaaattttcttctacaaaattagattgtgtgaggaagtttttatccttattgagtgatgcaaatttagtagacgc

SEQ ID NO: 483 - DNA, 628 bp, Fraxinus spp
gatcacaaatcctaaattaaactgtaaactaaaccccttccacactctacatctacctgcacacagttcatgcagtgattccacgaaaatgccattcaagaggtatgtcgagatcggaagagtggcccttgtcaactacggcaaagaatatggccagcttgtcgtcatcgttgatgtcatcgaccagaaccgggctctagtggatgcacccgacatggttaggagccaaatgaactttaagaggctttctcttaccgacataaagattgacatcaaaagggttccgaagaaaaagactcttattgccgctatggaagctgctgatgtcaagaataaatgggaaaacagttcctgggggaggaagttgattgtgcagaagagaagggcctctctaaatgatttggacaggttcaagctgatgttggcaaaaatcaagaaggctggcattgtgaggcaggagcttgcaaagctaaataaagagaccgcagcataagagtttttcccacccaagttacggatattaagattttgtagtaggattttggaaggctttttgtttcattatcaagtaggttttacttgttaatgaatttgtcatgagaaccaccaaattttaatgtcatcttac

SEQ ID NO: 484 - DNA, 724 bp, Tropaeolum majus
aactcaactttacctacaaattcatcgtctctctcgtcaagactcttctacagatcctcgaaaatgccgttcaagaggtacgtcgagattggaagagtggcgctagtgaactatggaaaggattacggaaggcttgttgtaatcgtcgatgttctcgatcaaaacagggcccttgttgatgcacccgacatggtcaggagccaaattaacttcaagaggctttctctgactgatattaagattgaaattaacagggttcctaaaaagaagactttgattgaggcaatggaaaaagctgatgtgaagaacaaatgggagaatagttcatggggcaggaagcttattgtgcagaaacgaagaacctcacttaatgattttgataggtttaagctcatgttggccaaaatcaagagaggtggacttataagacaagagcttgcaaaactcaagaaagagaccactgcctgaagttccatgctttgctcttcaaactttccagttttgtctttaattacagtgtacttgatttggtttctcaatctcataggtgtcctattctccattaacattgatggacatatttagaaatgtaactggttttcttttttgttccataatttgccattcggtgtagttattctctttgatgatttatgttgccaatccttattgattatgccaaatcattagtagttacaataaaaaaaaaaacaaaaaaaggccg

SEQ ID NO: 485 - DNA, 728 bp, Olea europaea
caataataatgtttattttataaaggcccagtcataatcaaaaccctagtcctcgaaaccctaaatcgtattcccctctcttacgcaccctctcctctggcgcgctctctcatagatcgccgaaaatgccgttcaagaggttcgtagagatcggaagggtggctcttgttaactacggcaaggactatgggaagcttgtcgttatcgttgacgtcatcgatcagaatcgggctcttgttgatgccccagacatggtgcggagccaaatgaatttcaagaggctgcaacttaccgacatcaagattgacatcaaaagggttccaaagaagaagactcttattgctgcaatggaggctgctgatgtgaaaaacaagtgggaaaacagttcatggggaaggaagctgattgtgcagaagagaagggcctcactgaacgattttgataggttcaagctaatgttggctaaaatcaagaaagctggtgttgttaggcaggagcttgcaaagcttaaaaaggagatcacagcctgagaaattttaatcttttgatgttaaggttttcacttggtatttaaaaagttgttttggtttattatgcaagatttcttctacttattgatgactttatgggcacatgaaaaacagtgttatctttaattgtgggatcaattcgaaaatcttggtgatttttagttcgaaggaacaacatgagctctaaattttggtata

SEQ ID NO: 486 - DNA, 632 bp, Platanus occidentalis
cctctcttccttacacgcgctctctctcttacgaaccacaatgcctttcaagcgttacgtggagattgggagagttgctctcgtgaattacgggaaggattatgggaaacttgtcgtgatcgtcgacgttattgaccagaatcgggcccttgttgatgcccctgacatggtgagaagccaaatgaatttcaagaggctttcactgacagatattaagattgatatcaagaggatccccaaaaagaagtcactgattgctgccatggaggctgcagatgtcaagaacaaatgggaaaacagctcctggggcaggaagctgattgtgcagaagcgaagggcctctcttaatgactttgataggttcaaaatcatgctggcaaagatcaagaagggtggagtgatcaggcaagagcttgcgaagctgaaaaagcagagtgcctcttaagttgattttatttggcaatcttgattttgttagtttttttgcagcttgtattttgggtactttcttgttttctcccatgtttgctacttttagagattaaaacaattgagcaaaacaccagtactgtggctaaaatttgagctccctgcatcagatatgattagtttttgtgtgatattttcgtctc

SEQ ID NO: 487 - DNA, 1017 bp, Sarracenia psittacina
actgaacccattcgatttcagccctgaacacgagaaccctatttcctcctcgcattcccctgatttcgcccgcgtcttccatatcgctattgcttcccggagtattcaggtcgccgaaaatgccgttcaagagatacgtggagatcggaagagttgcgctcgtcaactatgggaaggactatgggaagctcgtcgtgattgtcgatgtcattgatcaaaacagggcccttgttgatgcacccgatatggtgcggacccaaatgaatttcaagaggctttcactcacagatattacaattgacatcaaaagggttccaaagaagaagactttaattgcagccatggaggctgctgatgtcaagaacaaatgggagaacagctcttggggtaggaagcttattgtgcagaagaggagggcttctcttaatgattttgataggttcaagcttatgctagctaaaatcaagagagctggagttgtgaggcaggaactagcaaagcttaagaagcagagcacagcttagtgtttattctcttcttatctagagattattaaaagtgggcgtttggaagttgttgtttgcctgctttttctgggttttagtttcattcaattgtggattaatcgcaggaagaaaatggtattataggaattttgttttcagcaaggttaacagacttgaaataattcttgttattggaggagaccttgcgatcttctgagtatcgagatcctatgtttgcacattgatgctcatacttttttccccccctcttgagagagttttgaaattagttttgatgatttgtatcgttttattgcccaattatgtgcacctaaaggcatttatcaaacataatttgataatggtcaaaaaaaagaaatcatgaacatatatatatatagaaacttagaaaggttcaatgccttatcattatgatggaatgaactgaactgaactagaactgaattgcctagccatctgttatttccatagaacatacaactctatgtac

SEQ ID NO: 488 - DNA, 804 bp, Tabernaemontana elegans
agctctttgctgccgagaatgccttttaagcgatttgttgaaatcgggagggtagctctcatcaactatggaaaggactacggcaagcttgttgtcatcgttgatgtcatcgaccagaatcgagctcttgtggatgcccctgacatggtaagatgccaaatgaactttaagaggcttgcactgactgatatcaaaattgatatcaaaaggattcccaagaagaggaccctgattgaggcaatggaggctgcagatgttaagaacaagtgggaaaatagctcctgggggagaaagctaattgttcagcaaaggagggcctctctaaatgattttgacaggttcaagctcatgttggctaagatcaagagggctggagtggccagacaagaacttgctaagttgaagaagcaaagtgctgcctgaacataaattttctatggctaattttttcaattttgtagcagatgtcaagctagatgtgtttgagatcacttcccttagttaccatttctctctataagtttcaaatattgtgtgctgtcgcagatcctactctggttagctctttcctatatcagttcacgcttttaaggtgtattctggagtttatttttgttctttcagtccgtgctgctttgctattgaagcaaatatactagtttcaaacttgcaactttcccttgttctacaagagtttagttggcaactactgttagattgcttgccatttcctttctctattatcttctcttaccgattgctgtacaatgttctttgggtttctgctaacatttggtgactgag

SEQ ID NO: 489 - DNA, 721 bp, Musa acuminata
ttctgatggatgctgcagccgttcaagcgatatgtggagatcggcagggttgcgcttgtgacctacgggaaggaatacggcaggctcgtcgttatcgtcgatgttatcgatcagaacagagctctggtcgattctcctgacatggtacgaggccaaatcaatttcaagaggctctctcttactgatataaagattgacataccacgggtccccaagaagaagacccttcttgatgccatggaagctgctgatgtgaagaacaaatgggagaacagctcatggggaagaaaactaattgttcagaagaggagagcttcactgaatgattttgacaggttcaaggtcatgctggcaaagattaagagaggaggcgccatcaggcaagagctggccaagcttaaaaaggcagatgtggcttgagcttcatatatttctggttcctcagccagggttctgttatccatttacatgtccttaaacagattgaatgtactttttgatattttgcaactcagattttgcttttattgataggcccgaaagtgataagaagtgatgcctatatttttgaagtcatgatctgtagttcccagatcacgtttgtatgacagtaaaggtacatgactatattatgatcaggagtacatgggtgtgtatatatatgaagagaaaaatttgctgacaggggcaaacaaaaaaattaattttatttaccacagac

SEQ ID NO: 490 - DNA, 632 bp, Gossypium hirsutum
ttaatggttttggtggtcttcagaaaccctaacttcagctattgcccttcttccccagtctctcaaaaatgccgttcaagaggtacgtggagattggaagagtagctctggttaactacggaaaggactacggcaagcttgttgtcattgtcgatgtcgttgatcaaaacagggctcttgttgatgcacctgatacggtaagaagccaaatgaactttaaaagactgactctcactgatatcaagattgatattaatagggttcctaagaagaagaccttgattgatgctatggaaaaagctgatgtgaagagcaagtgggagaacagttcatggggcaggaagctgatcgtccagaaaagacgggcatcgcttaatgattttgataggttcaagctcatgttggcaaagattaagaaggctggaatcgttaggcaggagctagctaaacttaaaaaggagacggcaacctaaacttttttctatttaagccttgccttgttatacatttcagtttgagatattgtaaacttctaccgactttttttctcataattgttgcttatgactcctgctatcaaacctctatctgaaattatggttgactttttaatctgaccctcatttcctttt

SEQ ID NO: 491 - DNA, 711 bp, Gossypium raimondii
ttaatggttttggtggtcttcagaaaccctaacttcagctattgcccttcttccccagtctctcaaaaatgccgttcaagaggtacgtggagattggaagagtagctctggttaactacggaaaggactacggcaagcttgttgtcattgtcgatgtcgttgatcaaaacagggctcttgttgatgcacctgatacggtaagaagccaaatgaactttaaaagactgactctcactgatatcaagattgatattaatagggttcctaagaagaagaccttgattgatgctatggaaaaagctgatgtgaagaacaagtgggagaacagttcatggggcaggaagctgatcgtccagaaaagacgggcatcgcttaatgattttgataggttcaagctcatgttggcaaagattaagaaggctggaatcgttaggcaggagctagctaaacttaaaaaggagacggcagcctaaacttttttctatttaagccttgccttgttatacatttcagtttgagatattgtaaacttctaccgactttttttctcataattgttgcttatgactcctgctatcaaacctctatctgaaattatggttgactttttaatctgaccctcatttccttttgaactgaaagttaatttttttgtatataatacattattgtttgaaataaagaagttaatgcatattaactaaatatttc

SEQ ID NO: 492 - DNA, 670 bp, Tropaeolum majus
gcggccggggcttctcttcccctgcggccggttgttcgtcagagctaacattcgaatacacgcttcaaccaaagatgcctttcaagaggtacgttgagatcgggagagtcgctctggttaattacgggaaggactatggccagctagtcgttatcgtcgatgttctcgaccagaacagggccctagttgatgcccctgatatggtaagaagccaaataaacttcaagaggctgtcattgactgatatcaagattgatattaaccgagtaccaaaaaagaagacactcattgaagctatggagaaggctgatgtcaagaacaaatgggaaaatagctcatggggcagaaagcttattgttcaaaagagaagggcagctcttaacgactttgacaggttcaagcttatgttggcaaagatcaagagaggtggtttgatcagacaagaactatcaaagctgaagaaagagagtgcatcttcatagattagttttcagttttgttgtcggattccttcaagattttattctgttgaattcattatattcagtagacatgttatgttttcttgaatttttgtttgatttggtgtttgtttttaatgagacagagttagataatggtgcatactgcatatagtatatgtgtttcttggttctaatcctcttaactc

SEQ ID NO: 493 - DNA, 713 bp, Catharanthus roseus
  misc_feature (669)..(669): n is a, c, g, or t
  misc_feature (680)..(680): n is a, c, g, or t
ccaaagaattcggcacgaggctcaaccctagagttagcattacccctccgccttccctacatcactcggattcactcccctctctgcagccgacgcagatcgacgaaaatgccgttcaagagatacgtggagatcggaagggttgccctcgtcaactatggaaaggattacggaaagcttgtcgtaattgtcgacgttatcgaccaaaacagggccctggttgatgcgcctgacatggtgagaagtcaaatgaacttcaagcggcttgcacttacggatatcaagattgacattaaaagggtcccaaagaagaagactttgattgctgctatggaggctgctgatgtgaagaacaaatgggagagcagttcctggggtaggaagctgatcgtgcaaaagaagagggcctcacttaatgactttgaccgattcaagctcatgctagccaaaatcaagagggctggagtagcgaggcaagagcttgcaaagctaaaaaagcaggcagcataaggcaggaagcatctcttttgatatttaaaattttgatatagttttggactcggtaaaattgtattggtgtactgaagcagattttattttcctagtggaacaatgaagagatacaacgtgcttttattttattgcttcttaatagacctttggtttctntgctttggtcntccaaaaaaaaacctcgtgccgaattctttgga

SEQ ID NO: 494 - DNA, 640 bp, Papaver somniferum
ttcccaccaccagatatctgaaaatgcctttcaagcgttatgttgagattgggagagttgctctcgttaactacggtgaagattatggtaaacttgtagtcatcgttgatgtcatcgatcaaaacagggctttggttgatgcccctgatatggagagaagccaaatgaacttcaaaaggctctccttgacagatatcaagattgacattggcagaatccctaaaaagaaggctttgatcgatgccatggaggctgcagatgttaagaagaaatgggagagcagctcttggggaaggaagttaattgttcagaagaaaagagcatccttgaatgactttgacaggttcaaggtcatgttggcaaagatcaagagaggtggagctatccgtcaggagctcgcgaagctgaagaagcaagcagcttaagtttgggatatcacttgtgaagtcgaacattgttagggaaacaaaaatcatctagtcagttggttttggttataaagttaagcgttcttatggctgtttaagatatttatgaacttgttacagttggagtaaaattctactacaggtttcttggattcattttattgaattttttgcccaagatattttattctatacggtgcactgttttatta

SEQ ID NO: 495 - DNA, 830 bp, Populus trichocarpa
ccccttgtcatttctgcatcttccttagctcgctctttgctttcacggtcacacacaccgcacgaacccaccatgcctttcaagagatacgtggagatcgggagggtagctcttgtcaactatggaaaagaatacggcaggctcgttgtcatcgtcgatgtcatcgaccagaaccgcgctctagttgatgccccggatatggtgaggagccaaatgaacttcaagaggctttcacttaccgatatcaagattgagatcaaccgggttccaaagaagaaggctttgattgaagctatggagaaggctgatgttaagaacaagtgggagaaaagctcctggggcagaaggctgattgtccagcagagaagggcagctctcaatgactttgataggttcaagttgatgttggctaagatcaagaggggtggattgatcaggcaagaacttgcaaagttgaagaaagaaaatgctgcttaagtgttacctgtttagagacttccaattttgttatcaatatgatgccaggttttactgggatgtttttcagttggttttctgttgactcccagattaagagcagtttcaatacatttaagattttgtggtcaatttcatcttgctaccttatttttattttgtgatcttgttgcttgcgttgaaaattgtgggttctcctcaagtcactcttacctggccagcattaagtgtcactatttacttgcattctgccttgttctgctacttagtggatcaaaaaacacattatgccgggacccttcatcgatcaaaaacatccgtgctccatttatttgttattaaatatgatttct

SEQ ID NO: 496 - DNA, 678 bp, Aquilegia formosa
cctagccttctttctctgaaactcagaagctttcgaaaatgcctttcaagagatatgttgagatcgggcgagtcgcacttgtgaattacgggaaagattatggaaagcttgttgtgattgttgatgttatcgatcaaaacagagctcttgtagatgcacctgatatggtgaggagccagatgaatttcaagaggctctcactcacagatatcaagattgacatcaacagggtcccaaagaagaagtctttaattgaggcgatggaggctgcagatgtgaagaacaaatgggaaaacagttcgtggggaaggaagttaattgtccagaagagaagagctagccttaatgactttgataggttcaagctcatgttggcaaagattaagaaagctggtgcagttaggcaggaactctcaaagttgaagaagcagagtgcagcctgagacatttgtctgcgatttacttctattggatttttgaagttgtgttctaggtacttgtaatagtttactttttatcgaaattagtagaggttaagcaagacttcattttgagacccatctggcaaaactagttcatggatttggtgaagttctacaacattcagtgtagtggccttttgttggttgtttgtttttatgactttcttaatttccttgcttcaaattaagccctagt

SEQ ID NO: 497 - DNA, 712 bp, Persea americana
ggaggctcttcccgaaagaagttgaagaaagagaacccaaaaccttagcagctttatccttctcgcagatctgcaaccatgcctttcaagcgatacgtggagatcgggagagtcgctctcgttaattacgggaaggagtatggaaagctcgttgtgatcgtcgatgtgatcgatcagaaccgggcactcattgatgcccctgatatggtgagaggccaaatgaatatgaagagactttcactgactgatattaagattgacattcccagaataccaaagaagaaatcactcattgctgctatggaagctgcagatgttaagaacaagtgggagaacagctcatggggcaggaagttaatagtgcagaagagaagagcctccctcaatgactttgataggttcaaggtcatgttggccaagatcaagagggctggtgtaatcaggcaagagctcgccaaactgaaaaatcaggctgcttcttgagatagcaactgaaaatccaattttgttgcaaatctttgacgtctgtgtctgaatcctgttatttccatctgaatttcttttggcgtactaggtgcaaaaatttggcattgcctattttccaccttaaatttattgtctgcttagatttgtgttaaatttttcactgaaccatgctttgaaaatctgtgtgacatgaatgatctctctttcctacctttttaaagagttc

SEQ ID NO: 498 - DNA, 721 bp, Persea americana
gggaacctaaaacccctctctttccctcacacacgcacacacagatctgcgacaatgcctttcaagcgatatgtggagattgggagagtcgctctcgtaaactatggaaaggactacggaaagctcgtcgtcatcgtcgatgtcatcgatcagaaccgggcactcgtagatgctcctgatatggtaagaggtcaaatgaatatgaagagactttccttgacggatattaagattgaaattcctaggattcccaaaaagaagtccttgattgctgcaatggaagcagcagatgttaagaacaagtgggagaacagctcatggggcaggaagctaattgtgcaaaagaaaagagcttccctcaatgacttcgataggttcaaggtcatgttggcaaagataaagagggcgggtgtgatcaggcaagagctcgcaaaactaaaaaagcaggctgctgcttgagacctcagtttgttttatagattagtcttgtttgtgactggggattgttatttccatcttttcatttcctttgtctattgctacctggtcttccttttgtcacacatgcttaatcgttgagtcatcttttgaggcgcatcatagattcagtttcttattggatttgtgttaaagtcttaaatcacctccaaactttatgattgcacttgccacacggcgactatctttttccttccattgctataaatcaaacctttattgt

SEQ ID NO: 499 - DNA, 1395 bp, Theobroma cacao
ataactaaaaattagtaagacaacgtgttttactcaaattattttatcactcactgggctttagagtcgccatcattttctaaggactgaagcccaataaacccgtattggctctctaaaacgctagaaagtagaaagtcaaaggtacatatattggacaggcgttcgtcagaaaccctacctcgcccttcctctttgcctcttccgcgccaaagcccttccccagttctctcaaaatgccgttcaagaggtatgtagagattggaagagtggctctggttaactacggcaaggactatggcaagctggttgtcattgtcgacgtcgttgatcaaaacagggctctagttgatgctcctgatatggtaagaagccaaatgaactttaaaaggctaactctgaccgatattaagattgatatcaatagggttcctaagaagaagactttgattgatgcaatggagaaagctgatgtgaagaacaagtgggagaagagttcatggggcaggaagctgatcgtgcagaaaagacgggcatcccttaatgactttgataggttcaagctcatgttggcaaagattaagagggccggcattctcagacaggagatggcgaaacttaaaaaggagactgcggcctaaactttcttctatttaagcctttcaatcttgttatacttttccagtttttattagattgcatcaatgcaccaattgcaaacctaccaagttgattttttgcgttattgttatcatgactgttgctttattaaatgtctctcctgactggatgttgccttttttttttttgacctttttgatcaaagccccatgcccatagaatattacttactaacgtttgttggactgatgacaaagatttaactcgaattataattatctcaatcattagcttacccgactgttgtgtaccatgttttgggttaagaaaaagatgggtgctttgaaaacctactaacaaaccgatggcttccagcgaacctcttcgatgagacccttcaacccttcccaacccctctgtaagttgatatgtaaaaatttaagtgaaatattttttcaagtcctgaaagccagtggaagaaaaacctgatcattttcacatggtgatgaatgaaagaatataggatttcagtatccttcctgcaatgttgaaatttcagtgctttactgtgtttttttccccctcccttctcccactatgaatctaaaaaagaacaagtaccttatgggtagggaaggggggaggttctgtctagccgcgaataggcccacaacacgttaactaggcaagcatgctatccacctctccatccggggctcaaaggcaacgataaaagcaaatggctgtcttaaccaattaacaaaacgactttta

SEQ ID NO: 500 - DNA, 713 bp, Manihot esculenta
tccctgctctccgcctctcccttcttccagcttcgacacttaccacacctcacccgttcaagatgccgtttaagagatacgtggagatcggaagggtagctctcgtcaactatggcaaagactatggaaagctcgttgtcatcgtcgacgtcattgaccagaaccgagctctagttgatgctcctgatatggtcaggagccagatgaatttcaaaaggctttcactcactgatatcaagatagacattaatcgggtccccaaaaagaaaaatttgattgaggctatggagaaggctgatgtgaagaacaagtgggagaatagctcatggggcagaaagcttattgtccagaagagaaggggtgctttgaatgactttgatagattcaagttgatgttggctaagatcaagaggggtggattgatcaggcaagagcttgcgaagttgaagaaagagaatccagcctgaagttctcatttttgttatcaaaattctgcaagttgttttggaatattatccatttggtttccttttcacatagagatcgagaacagttttttaggtttctttctatatatgacagttttgtagtgattgtgcaacctaaacatgacaaaattcttgtgcttcctttttttcttatgttgatttcatcgagtatttacaatccttggttgcttctggtatctgcaatgcatagtattttagcttgtc

SEQ ID NO: 501 - DNA, 896 bp, Ricinus communis
tttcgctaagcaacttccttgtccaagcactacgcaacatggcccgacccattaaaattaagaacagcaaaaaagaaaagaaaaaccctagatccgacggtccaaaaccctctatataaaaacacggcatataaaaataaaccctaaccccttctcatttctcttcctcttccattactctccgcctctctcaatactttctgcttccacactcgcacaccaccacacaattccaaaatgccgttcaagagatacgtagagatcggaagggtagcacttgtcaactacggcaaggactatggaaagctcgtcgttatcgtcgatgtcattgaccagaaccgagctcttgttgatgctccagatatggtgaggagccaaatgaatttcaagaggcttcaactcactgatatcaagattgacattaacagggtcccaaagaagaagaatctcattgaagctatggagaaagctgatgtcaagaacaagtgggagagtagctcatggggaagaaagctgattgtccagaagagaagggcagctctcaatgactttgacaggttcaagttgatgttggctaagatcaagaggggtggattgatcaggcaagagcttgcaaagctgaagaaagagactgcagcctaaaaaagttttctttttaagtagttctcaattttgttatcaatatcctcaagttgttcttttgggattctatcttttgtttattttcctatttacttagagattgagaagaaatttaaggaaaactttcattatttcacagattttgtagtgagctccattgtgcaacctttgctttgacagcgtgttcttgatactttatgttcattcttatgtggtatttcatggattgtctattttcttgggttacattaaaa

SEQ ID NO: 502 - DNA, 732 bp, Gossypium hirsutum
aatggttttggtggtcttcagaaaccctaacttcagctattgcccttcttccccaatatctcaaaaatgccgttcaagaggtacgtggagattggaagagtagctctggttaactacggaaaggactacggcaagcttgttgtcattgtcgatgtcgttgatcaaaacagggctcttgttgatgcacctgatacggtgagaagccaaatgaactttaaaagactaactctcactgatatcaagattgatattaatagggttcctaagaagaagaccttgattgatgctatggaaaaagctgatgtgaagaacaagtgggagaacagttcatggggcaggaagctgatcgtccagaaaagacgggcatcgcttaatgattttgataggttcaagctcatgttggcaaagattaagaaagctggaatcgttaggcaggagctagctaaacttaaaaaggagacggcagcctaaacttatttctatttaagcctttccttgttatacatttcagtttgagatcttgtaaacttttaccgactttttttctcataattgttacttatggctcctgctatcaaacctctctatctgaaattgatggttgactttttaatctgacccttatttccttttgaactgaaagttaatttttttgtatataatacattattgtttgaaataaagaagttaatgcatattaactaaaaaaaacaagcgacacccacaaggagg

SEQ ID NO: 503 - DNA, 810 bp, Eucalyptus grandis
ccctagcgccgggggcactctcttctcgttcatctttcctctcccggtctctctccgccgatctctgctcgcacaccagcacacactcctcacgccccggcaaagatgccgttcaagaggtacatagagatcggcagggttgcgctgatcaactacggcaaggattacggcagactcgtcgtcatcgtcgatgtggtcgaccagaacagagctcttgtcgatgcacctgacatggtcaggtcgcagatgaactttaagaggctctcgctcactgatatcaagatcgatatcaagagggtcccgaggaagagcactctcattaaggctatgcaggaggctgatgtccagggtaagtgggataagagttcttgggggaggaaacttattgttcagaagaaaagggcatcccttaatgattttgacagatttaagctcatgttggccaaaattaagagaggtggattgatcaggcaagaactggcaaagctcaagaaggagagcgcatcctaagcatgagtttcttgcgtcttgcgggccaagagtttttggaagatgtagcattgctttaaacggattgttacctgttgcttttactagagtttagaagcatctgatggtctattgtatttcataactttatcgagtgcacttaatggaagattatgtgttttgggacatgtttattctctatcaacatcatatgaaatgtcacaggtctcttgtttttcttgttttcttttagtgttttgttatgacagaaatgagcttttgcttcattaattgcaagtaatgtttttcccttaaggaaaa

SEQ ID NO: 504 - DNA, 691 bp, Actinidia deliciosa
ttacccagaacgaggctctcttccatctctcagatcgttgaaaatgccgttcaaaagatacgtggagatcgggagagttgctctcgtcaactacgggaaagactatgggaagctcgtcgtcattgtcgacgtcatcgatcagaacagggctcttgttgatgcccctgatatggtgcggacccaaatgaatttcaagaggctttcactcactgatatcacaattgatatcaaaagggttcctaagaagaagacattgattgcagccatggaagctgctgatgtcaagaacaagtgggagaacagttcttggggcaggaagcttattgtgcagaagagaagggcttctctgaatgatttcgataggttcaagctaatgctggctaaaatcaagagagctggacttgtcaagcaggaacttgctaagctgaagaagcagaccacagcctaatacctattctctttgtatctggagattttgttgtagggttttgcaagttgtgttggcacttgcattttgggttcatttcattagttaaacaagaagagagagcctacagtgtatttggtttttatctaatattatctggctgcatttgaaactataattgtatttttgagacctggcctcgtgcgatctttgactaggcattgagaacctatgttcgccaattgatgctgatgcgatttcaac

SEQ ID NO: 505 - DNA, 586 bp, Carica papaya
gcacacacgcaccaacaaaaatgcctttcaagaggtacgttgagatcgggagagttgctcttgtaaactacggcaaagactatggcaggctcgtcgttatcgtcgatgtcatcgaccagaacagagctcttgttgatgcccctgatatggtgagaagccaaatgaatttcaagagactttcattgactgacatcaagattgatataaaccgtgttcctagaaagaagcaacttatcgaagcaatggataaggctgatgtcaagaacaagtgggagaaaagctcatggggtagaaagttgattgttcagaagaaaagggcatctctaaatgacttcgacaggttcaaggttatgttggccaagatcaagagaggtggattgatcaggcaagaacttgctaagctgaagaaagagaatgcatcttaagtgcaagttgcctatggagtttgccagttttgttatcaaaattctggaagttctttttgattgtttcatgtcttttattttgtcagctcagattaaaaacttataatttgtatcccagtatctttagcaagttttatcaattttacaaggatttatcttag

SEQ ID NO: 506 - DNA, 660 bp, Capsicum annuum
tcagcatagtagtgacgacaagacttactacttttacctaagcctgctcgcacgcacgcacttggccgaaaatgccgttcaagaggttcgtggagataggaagggtagccttaatcaactacggaaaggactatggcaagctcgttgttatcgtcgacgtcatcgaccaaaatagggctcttgttgatgctccggacatggtgagaagccagatgaacttcaagaggctttcacttacagatatcaagattgacatcaaaagaatcccgaagaagaagaccctggttgaggctatggaagctgctgatgtgaagaccaagtgggagaacagttcatggggaaggaagttgatagtgcagaagaggagggctgcactcaacgattttgacaggttcaagcttatgttggcaaagatcaagagagctggagtagtgagacaggagcttgcaaagctcaagaagactgctgcttgaaaactctctgatcagtgcgtgcaattgatatataggatttttggatcttgtattttgtttagttttgagggatgttgttagaacaagtctgttatatttcatgccatgcaatgtttaatactttttgagatcgcttttgtcttgagattttgcttaattatgatgggaaaaccgctggcttctctag

SEQ ID NO: 507 - DNA, 558 bp, Capsicum annuum
aaaaatgccgttcaagagatttgtggagattggaagagttgcacttgttaactatggcaaggattatggaaaactcgtcgtcatcgttgacgtcattgaccaaaacagggctctcgttgatgctcctgacatggtgaggagccagatgaacttcaagaggctttcactgacagatatcaaaatcgacatcaaaaggattccaaagaagaagacactggttgctgccatggaagcttccgatgtgaagaccaagtgggagtccagttcctggggaaggaagttgatcgtgcagaagaggagggcctcactcaacgattttgacaggtttaagctcatgttggcaaaaatcaagagggctggtgtggtgagacaggagcttgcaaagcttaagaaggaagttgcagcttaagaacctttctaagtagtgacacacattgatttaaaagcaattttggaacttgtaattttacttttgaggattatatctaccttttttgtttgctttagatgtgctgggagattatttttctgatctatgatgaactgtttgtttttttt

SEQ ID NO: 508 - DNA, 590 bp, Capsicum annuum
gcacgaggcgcagcttcacatcactcaaaaatgccgttcaagagatttgtggagattggaagagttgcacttgttaactatggcaaggattatggaaaactcgtcgtcatcgttgacgtcattgaccaaaacagggctctcgttgatgctcctgacatggtgaggagccagatgaacttcaagaggctttcactgacagatatcaaaatcgacatcaaaaggattccaaagaagaagacactggttgctgccatggaagcttccgatgtgaagaccaagtgggagtccagttcctggggaaggaagttgatcgtgcagaagaggagggcctcactcaacgattttgacaggtttaagctcatgttggcaaaaatcaagagggctggtgtggtgagacaggagcttgcaaagcttaagaaggaagttgcagcttaagaacctttctaagtagtgacacacattgatttaaaagcaattttggaacttgtaattttacttttgaggattatatctaccttttttgtttgctttagatgtgctgggagattatttttctgatctatgatgaactgtttgttttttttattaac

SEQ ID NO: 509 - DNA, 658 bp, Capsicum annuum
gccgatagctgctcctcagatcgccgaaaatgccgttcaagaggtttgtggagatcggaagagtcgcccttgtcaactacgggaaggattacggaaagcttgttgttatcgtcgatgttattgaccaaaacagggctcttgttgatgctccggacatggtgaggagccagatgaattttaagagactttcactcacagatatcaaaattgacattagtagaattccaaagaagaagactctcattgctgctatggaagctgctgatgtgaagaacaaatgggagagcagttcctggggaagaaagttgatagttcagaagaggagggcctcacttaatgattttgacaggttcaagcttatgctggcaaagataaagagggctggagtcgtgagacaggaacttgctaagctgaagaaagagactgcttgagaactcattgattagtgaaaattgaaaatttagatttttgaaagttgtacttgttttgacttttgagagtttgatacatagcatattctggtttttacttccatagtctttcaatacatttaagggaacaactcagcttattatctttttgttgcatggaaggaattatctttttgttgcaaggattacctgctgtgtcatttaatgtaatagcctactgaacaaac

SEQ ID NO: 510 - DNA, 669 bp, Capsicum annuum
gcacgagggtcgccgatagctgctcctcagatcgccgaaaatgccgttcaagaggtttgtggagatcggaagagtcgcccttgtcaactacgggaaggattacggaaagcttgttgttatcgtcgatgttattgaccaaaacagggctcttgttgatgctccggacatggtgaggagccagatgaattttaagagactttcactcacagatatcaaaattgacattagtagaattccaaagaagaagactctcattgctgctatggaagctgctgatgtgaagaacaaatgggagagcagttcctggggaagaaagttgatagttcagaagaggagggcctcacttaatgattttgacaggttcaagcttatgctggcaaagataaagagggctggagtcgtgagacaggaacttgctaagctgaagaaagagactgcttgagaactcattgattagtgaaaattgaaaatttagatttttgaaagttgtacttgttttgacttttgagagtttgatacatagcatattctggtttttacttccatagtctttcaatacatttaagggaacaactcagcttattatctttttgttgcatggaaggaattatctttttgttgcaaggattacctgctgtgtcatttaatgtaatagcctactgaacaaac

SEQ ID NO: 511 - DNA, 706 bp, Papaver somniferum
  misc_feature (67)..(67): n is a, c, g, or t
  misc_feature (75)..(75): n is a, c, g, or t
  misc_feature (79)..(79): n is a, c, g, or t
  misc_feature (85)..(85): n is a, c, g, or t
  misc_feature (87)..(88): n is a, c, g, or t
ctagtgcggaatgcacgtacaccccgtggaatccctaatccatgatccagacaaactcgccgacctnctctatcnttcnttcccncnnccagatatctgaaaatgcctttcaagcgttatgttgagatagggagagttgctctcgttaactacggtgaagattatggtaaacttgtagtcatcgttgatgtcatcgatcaaaacagggctttggttgatgcccctgatatggagagaagccaaatgaacttcaaaaggctctccttgacagatatcaagattgacattggcagaatccctaaaaagaaggctttgatcgatgccatggaggctgcagatgttaagaagaaatgggagagcagctcttggggaaggaagttaattgttcagaagaaaagagcatccttgaatgactttgacaggttcaaggtcatgttggcaaagatcaagagaggtggagctatccgtcaggagctcgcgaagctgaagaagcaagcagcttaagttttgggatatcacttgtgaagtcgaacattgttagggaaacaaaaatcatctagtcagttggttttggttataaagttaagcgttcttatggctgtttaagatatttatgaacttgttacagttggagtaaaattctactacaggtttcttggattcattttattgaattttttgcccaagatattttattctattgaag

SEQ ID NO: 512 - DNA, 604 bp, Euphorbia esula
ggcacgaggcctccctcaagcttcacaatcacacactacacgatttcaagatgcctttcaagaggttcgtggagatcggacgggtagctcttgtcaactacggaaaggactatggaaagctcgtcgtcatcgtcgatgtcgtcgaccagaaccgtgctctagttgatgcccctgatatggtaaggagccaaatgaacttcaagaggctctctctcactgatatcaagattgacattaacagggtgccaaagaagaagaatttgattgaagctatggagaaggctgatgttaaaaacaagtgggagagcagttcttggggcagaaagttgattgtccagaagaaaagagcatctcttaatgattttgacaggttcaagcttatgattgctaagatcaagagggctggattggtcaggcaagagcttgccaagttgaagaagagtgcagcataaattggtgtttaagttgtcaattttgttatcattattgtgcaagttattttgggtatgttttccatttggattttgatctacttaggtatcgagaaccatttaaaggaaccttcaaatgacagatattttgtagcttgagtgttttcttgcaa

SEQ ID NO: 513 - DNA, 675 bp, Euphorbia esula
  misc_feature (268)..(268): n is a, c, g, or t
acgatttcaagatgcctttcaagaggttcgtggagatcggacgggtagctcttgtcaactacggaaaggactatggaaagctcgtcgtcatcgtcgatgtcgtcgaccagaaccgagctctagttgatgcccctgatatggtaaggagccaaatgaacttcaagaggctctctcttactgatatcaagattgacattaacagggtgccaaagaagaagaatttgattgaagccatggagaaggctgatgttaaaaacaagtgggagancagttcatggggcagaaagttgattgtccagaagaaaagagcatctcttaatgattttgacaggttcaagcttatgatagctaagatcaagagagctggattggtcaggcaagagcttgccaagttgaagaagagtgcagcctagatttgctttaagttggcaattttgttgtcattatttcgaaagttatttttggtatgttatctatttggattttgatctacttagaaaccgagaaccgtttaaaggaaccttcaaatgacagatattttgtagctgagtgttatcttgcaatattttcttttacatgaaatgtgggttatttattagctttgattggaatgtgtgatattaatgtgtttaccataattattattattattattattattatcacagttgcatt

SEQ ID NO: 514 - DNA, 679 bp, Nicotiana tabacum
gtcagtagccacattggaaaaccctagcactatattactccttccagctcctctcttcatagcctgctcgcgcgtctactccttcagatcgccgaaaatgccgttcaagaggttcgtggagattggaagggtagccttaatcaactacggaaaggaatatggcaagctggtcgttatagtcgatgtcatcgaccaaaatagggctcttgttgatgctccagacatggtgaggagccagattaacttcaagagactttcactcacagatatcaaaattgacatcaaaagaatcccaaagaagaagaccttggtcgaggctatggaagctgctgatgtgaagaccaagtgggagaacagttcatggggaaggaagttgatagtgcagaagaggagggctgcacttaacgattttgacaggttcaagcttatgttggcaaagattaagagggccggagttgtgagacaggagcttgcaaagcttaagaagaccgctgcttaagaactttctgattagtgcaattgatatataggatttatggatcttgtattttgtttagctttgagagatgttataaaggaagtttctttttattggcatgcaatatttaagacgttttcagatagttatcgtttgagattttactgatttatcatgggaaaccatcacttatatattacc

SEQ ID NO: 515 - DNA, 684 bp, Nicotiana tabacum
gctcgcgcgtctactccttcagatcgccgaaaatgccgttcaagaggttcgtggagattggaagggtagccttaatcaactacggaaaggaatatggcaagctggtcgttatagtcgacgtcatcgaccaaaacagggctcttgttgatgctcccgacatggtgaggagccaaattaacttcaagagactttccctcacagatatcaaaattgacatcaaaagaatcccaaagaagaagaccttggttgaggctatggaagctgctgatgtgaagaccaagtgggagaacagttcttggggaaggaagttgatagtgcagaagaggagggctgcacttaatgattttgacaggttcaagcttatgttggcaaagattaagagggccggagttgtgagacaagagcttgcaaagcttaagaagactgctgcttaagaactctctgattagtgcaattgatatataggccttttggatattgtattttctttagctttgagagattataacagaagtctgttctgtttattgccatgcaatatttaagtcagttttgagataattttcgtctgaggttttgcggatttacgactggaaaccaccacttctatattacctgctccttatttcctcaaattgtgtgatttctttctttttgtaacataaaatgtctttcattttaact

SEQ ID NO: 516 - DNA, 703 bp, Solanum lycopersicum
gaaaaccctagtactcacttgacaatccacaccagtagcctcactcttcgcgcctgatagcatctccatcagatcgccgaaaatgccgttcaagaggttcgtagagatcggaagagttgccctcgtcaactacgggaaggattacgggaaacttgttgtcatcgtcgatgtcattgaccaaaatagggctcttgttgatgccccagacatggtgaggagccagatgaactttaagagactttcactcacagatatcaaaattgacattagtagaatcccgaagaagaagaccctcattgctgctatggaggctgctgatgtgaagaacaaatgggagagcagttcctggggaagaaagttgatagttcagaagaggagggcctcacttaatgattttgacaggttcaagcttatgttggcaaagataaagagggctggagtcgtgagacaggagcttgctaagctcaagaaggaagtcgcttgagaactttttgattagtcaaattggaatattagattttcaaaagttgtacttgtttagagctttgagattttgttgcattaagggaagaaaaaacatatttttgtttttacttccaacgtcttttaatagtttttctgatctatgatgatgaatggtctctttcaagaattatctgctgtcatttatattgtaatggcttaatatcttttggttgtgtgc

SEQ ID NO: 517 - DNA, 702 bp, Solanum melongena
attgtaaaccctaacacaatcctctcttttgtctctctcttttttcgcagcttcacagctccttcaaatcagtaaaaatgccgttcaagaggttcgtggagatcggaagagttgcactcgttaactacgggaaggactatgggaagctcgttgtcatcgttgacgttatcgaccaaaacagggctcttgttgatgctcctgacatggtgaggagccagatgaacttcaagaggctttcgctcacagatatcaagatcgatatcaagaggattccaaagaagaagaccctgattgctgctatggaggctgctgatgtgaagaacaagtgggagtccagttcctggggaaggaaattgatcgtgcagaagaagagggcctcagtcaacgattttgacaggtttaagctcatgttggcaaagatcaagagggctggtgtggtgagacaggagcttgcaaagcttaaaaaggaggttgcagcctaagtagtgacacattgatttaaagcaattttggaagttgtatttttgacctttgggaatatatctaccccgttttatttttattctctcttccatttttcttgttttagacgttctgggaaattatttttctgatctatgatggtgaactgtttgtttcaaagaatgctcagttatttcatattgtcctctttttttaatgtcgaaaattgtattcgcagcg

SEQ ID NO: 518 - DNA, 664 bp, Solanum melongena
aaaaaccctaatactcactcgatagcctcactcttcgcgcccgatagcagctccatcagatcgtcgaaaatgccgttcaagaggttcgtagagatcggaagagtcgccctcgtcaactacgggaaggattacgggaagcttgttgttatcgtcgatgtcattgaccaaaacagggctcttgttgatgctccagacatggtgaggagccagatgaactttaagagactttcactcacagatatcaaaatcgacattagcagaattccaaagaagaagaccctcattgctgctatggaggctgctgacgtgaagaacaaatgggagaacagttcctggggaagaaaattgatggtccagaagaggagggcctcacttaatgattttgacaggttcaagcttatgctggcgaagataaagagggctggagtcgtgagacaggagcttgctaagctcaagaaagcgactgcttgagaactctttgattagtcaaattggaatattagagtttgggaagttgtacttgtttagcttttgagattttgttggattaatggaagaaaaacatattttggtttttacttccaacatctttcaatagtttttgtgatgaatctctgccaagaattgtctgctgtcattttatgtaatgtctttttgttatgtg

SEQ ID NO: 519 - DNA, 638 bp, Euphorbia peplus
ggcacgaggcctccctcaagcttcacaatcacacactacacgatttcaagatgcctttcaagaggttcgtggagatcggacgggtagctcttgtcaactacggaaaggactatggaaagctcgtcgtcatcgtcgatgtcgtcgaccagaaccgtgctctagttgatgcccctgatatggtaaggagccaaatgaacttcaagaggctctctctcactgatatcaagattgacattaacagggtgccaaagaagaagaatttgattgaagctatggagaaggctgatgttaaaaacaagtgggagagcagttcttggggcagaaagttgattgtccagaagaaaagagcatctcttaatgattttgacaggttcaagcttatgattgctaagatcaagagggctggattggtcaggcaagagcttgccaagttgaagaagagtgcagcataaattggtgtttaagttgtcaattttgttatcattattgtgcaagttattttgggtatgttttccatttggattttgatctacttaggtatcgagaaccatttaaaggaaccttcaaatgacagatattttgtagctgagtgttatcttgcaaccttttcttttacatgaaatgtgccatgtttatca

SEQ ID NO: 520 - DNA, 779 bp, Tropaeolum majus
cggccattacggccggggcctgcggccggttgttcgtcagagctaacattcgaatacacgcttcaaccaaagatgcctttcaagaggtacgttgagatcgggagagtcgctctggttaattacgggaaggactatggccagctagtcgttatcgtcgatgttctcgaccagaacagggccctagttgatgcccctgatatggtaagaagccaaataaacttcaagaggctgtcattgactgatatcaagattgatattaaccgagtaccaaaaaagaagacactcattgaagctatggagaaggctgatgtcaagaacaaatgggaaaatagctcatggggcagaaagcttattgttcaaaagagaagggcagctcttaacgactttgacaggttcaagcttatgttggcaaagatcaagagaggtggtttgatcagacaagaactatcaaagctgaagaaagagagtgcatcttcatagattagttttcagttttgttgtcggattccttcaagattttattctgttgaattcattatattcagtagacatgttatgttttcttgaatttttgtttgatttggtgtttgtttttaatgagacagagttagataatggtgcatactgcatatagtatatgtgtttcttggttctaatcctcttaactcatatcgacctctccgatcgagttaagaatatccaattttgttaagggcaatgcatgagttggttctgttcgattggtattaaaatcgatgcatattataaggtttggttcg

SEQ ID NO: 521 - DNA, 652 bp, Olea europaea
cccttggagctctcgcacagatcgtaaaaaatgccgttcaagagattcgttgagattggaagggtggctctcgtcaactacggcaaggactacgggaagcttgtcgtcatcgttgatgtcatcgaccagaaccgggctcttgtggatgcccctgacatggtgcggagccaaatgaattttaaaaggctgcaacttactgacatcaagattgacatcaaaagggttccaaaaaaaaagactcttattgctgcaatggaggctgctgatgtgaaaaacaagtgggaaaacagttcatggggaaggaagctgattgtgcagaggagaagggcctcactgaacgattttgataggttcaagctaatgttggctaaaatcaagaaagccggcgttgtcaggcaggagcttgcaaagcttaagaaggagatcacagcctgagaagttattatttcttgatgttatgattttcacttaggtttataaaaaagttagtatcggtttattatgcaagttttcttctacttacgatgacttcatgaccatatgggaaatagtgcttccttttttgttattattgtgggatcaatttgaaaatcttggcgattttataaaggacaacatgagcttaaatttggtactattttattttgtgaat

SEQ ID NO: 522 - DNA, 649 bp, Sarracenia psittacina
ttcatttctcgtctcttcgcccgccttcctggttttttcagacgaaaccctagaccacaatgccgttcaagcgttacgtcgagatcgggagggtcgcccttgtgaactacggcaaggactatgggaagctcgtcgtcatcgtcgacgttattgaccagaaccgagctcttgtggatgcccctgacatggtgagatgccaaatgaactttaagaggctttctctgaccgacattacaattgacatcaaaagagtccccaataagaagacactggttgcagcaatggaggccggagacgttaagaacaagtgggagaacagctcatggggcagaaaactgattgtgcaaaaaagaagggcctctcttaacgactttgatagattcaagctcatgttggcaaaaattaagaggggtggactgatcagacaagagcttgcaaagctgaagaagcagaactcatcctaagcaacgttattatttctatggatttccatttttatgttgtgaacttccaaaatttgtattgttcccttggtttttcaaaattttcttgcattttcggagtttagatccagcctaaggataaattctttttgtatttctgtgagagatcccggaatcagtgttggtgtttttgggtaatttattac

SEQ ID NO: 523 - DNA, 809 bp, Tabernaemontana elegans
catcctacctaagacatccagagtccagacgctaaaaccctagtactatatcttcacttctcaaccctagagttagcattacccctccgccttccctccatcgctcggatatacttccctctctcccgcagatcgacgaaaatgccgttcaagaggtacgtggagatcggaagggttgctctcgtcaactatggaaaggactacgggaagctcgttgtcatcgtcgatgtcatcgaccaaaatagggctctagttgatgcccctgacatggtgaggagtcaaatgaacttcaagagacttgcactgacagatatcaagattgacattaaaaggattccaaagaagaagactttgattgctgctatggaggctgctgatgtcaagaacaagtgggagaacagttcctggggtaggaagttgattgtgcaaaagaaaagggcctcactcaatgattttgaccgattcaaactcatgctggccaaaatcaagagggctggagtagtcaggcaggagcttgcaaagctaaaaaagcaggcagcataaggcggcgtttcttctgatatttgaaattttttatatagtttggatttggtaaaattgtatcagtgtactgcagcaggcctaattttgctagttgatattggaacattgaagagaacaggcttttattttactcatttcgggatacatctagttgtttccttttttggacaattttttccgctcatggctgcatcagattggaaaaaatttgcctattttcccttctccacgttagcacgtgggactgctttttgcggattttctaa

SEQ ID NO: 524 - DNA, 619 bp, Tripterygium wilfordii
aactctccgcctctgctctcgttacacacttccacacacttcacaagatccaaaatgcctttcaagaggtacgtggagatcgggcgggtggcactcgtcaactacgggaaagactacggcaggctcgttgtcatcgttgatgtcctcgatcagaacagagccctggttgatgctccagatatggttagaacccaaatgaatttcaagaggttgtctctaactgacatcaagattgagattaaccgggtgcccaagaagaagaacctgattgatgctatggagaaggctgatgttaagagcaagtgggagaacagctcttggggtaggaagctcattgttcagaagagaagggcatctcttaatgactttgatagatttaaaattatgttggccaagatcaagaggtctggattggtgaagcaagaacttgcgaaactgaaaaaggaaaatgcatcctagtcgacatttataagaacttcccagttttgtttgcggtgttccttgagatgatgtttttgtatcttactcatttttcttgtttaatttagagagaccatcaatctgagaatttagcaaaaatgagattttgcaacctgtttaatgtgacctattctgtcat

SEQ ID NO: 525 - DNA, 754 bp, Catharanthus roseus
aaccctagagttagcattacccctccgccttccctacatcactcggattcactcccctctctgcagccgacgcagatcgacgaaaatgccgttcaagagatacgtggagatcggaagggttgccctcgtcaactatggaaaggattacggaaagcttgtcgtaattgtcgacgttatcgaccaaaacagggccctggttgatgcgcctgacatggtgagaagtcaaatgaacttcaagcggcttgcacttacggatatcaagattgacattaaaagggtcccaaagaagaagactttgattgctgctatggaggctgctgatgtgaagaacaaatgggagagcagttcctggggtaggaagctgatcgtgcaaaagaagagggcctcacttaatgactttgaccgattcaagctcatgctagccaaaatcaagagggctggagtagcgaggcaagagcttgcaaagctaaaaaagcaggcagcataaggcaggaagcatctcttttgatatttaaaattttgatatagttttggactcggtaaaattgtattggtgtactgaagcagattttattttcctagtggaacaatgaagagatacaacgtgcttttattttattgcttcttaatagacctttggtttctttgctttggtcttccatgcacggtagcataagatttcggtcaaatttgcctttagtatttgaggcaggattgttatatgttctcgattcatatgctttagcgttgcttc

SEQ ID NO: 526 - DNA, 462 bp, Fraxinus spp
cgggcccgggggcgacacagcggcacgacagtacaccgagcaattacccgaaaatgccgttcaagaggtacgtcgagatcggaagagtggcccttgtcaactacggaaaagaatatggccagcttgtcgtcattgttgacgttatcgaccagaaccgggctctcgtggattcccctgagatggtgaggagccaaatgaactttaagaggctttctcttaccgacataaagattgacatcaaaagggttccaaagaaaaagactcttattgctgctatggaagctgctgatgtcaagaacaagtgggaaaacagttcctggggaagaagctgattgtgcagaagagaagagcatctctaaacgatttcgatagattcaaactaatgttggcaaaaatcaagaaagctggcgttgtgaggcaggagcttgcaaagctcaagaaagatacagtggcataagagtt

SEQ ID NO: 527 - DNA, 634 bp, Papaver somniferum
cactacctcataaacctgaatcgccccctttcctcagctcagtttctgcaaagatgcctttcaagcgatacgttgagattgggagagttgctctcctcaattacgggaaagattatggaagacttgttgtgatcgttgatgtcctcgaccaaaacagggctcttgttgatgcacctgatatggtgagaagccaaatgaacttcaagaggctctctttgacagacatcaagattgacatccctagaatccctaagaagaagactttgattgaagccatggcggctgcagatgtaaagaacaaatgggagagcagttcctggggaaggaagctgattgttctgaagaagagggcttccctgaatgattttgataggttcaaggtcatgttggcaagatcaagaggggtggagctatccgacaggagcttgcaaagctgaagaagcagagtgcatgagacttttgatctcattgtgaagtccatttgattagagagaattttcagtgccagctgttttttgctacttgtttacttcaattttgccattttagagatttaagaatacagtcgagtaaaacaggaaactactaggtattttgattatttatgcaatagttagatcttctataccagagt

SEQ ID NO: 528 - DNA, 541 bp, Euphorbia peplus
ttcaagatgcctttcaagaggttcgtggagatctgacgggtagctcttgtcaactacggaaaggactatggaaagctcgtcgtcatcgtcgatgtcgtcgaccagaaccgagctctagttgatgcccctgatatggtaaggagccaaatgaacttcaagaggctctctcttactgatatcaagattgacattaacagggtgccaaagaagaagaatttgattgaagccatggagaaggctgatgttaaaaacaagtgggagagcagttcatggggcagaaagttgattgtccagaagaaaagagcatctcttaatgattttgacaggttcaagcttatgatagctaagatcaagagagctggattggtcaggcaagagcttgccaagttgaagaagagtgcagcctagatttgctttaagttggcaattttgttgtcattatttcgaaagttatttttggtatgttatctatttggattttgatctacttagaaaccgagaaccgtttaaaggaaccttcaaatgacagatattttgtagc

SEQ ID NO: 529 - DNA, 610 bp, Thalictrum flavum
agactttactttacaagaatacttacgaaaaatagacctttacaaggcggtatgtcgagatagggagagttgctcttgttaactacgggaaagattatggaagacttgttgttatcgttgatgttatcgatcagaatcgggctcttgttgatgctccggatatggttaggagccaaatgaattttaagagactctcattgacagacatcaagatcaacattggtagggttcccaaaaagaagtctttgatagaggccatggaagctgcagatgtcaagaacaaatgggagagcagctcctggggcaggaagctgattgtgcagaagaggagggcttctctcaatgactttgataggttcaaactcatgttagctaagatcaagagaggtggcgcaatcaggcaagaacttgcgaaactgaagaaacaagcagcttgagatttagtcttggaaagtcttaattttgttagtctggcaggttgtgattttaattttgctatcttctgttactttttagtgatacctcagaaaacaattttagttatatgttagtttttggacctgattcagctaaagacagttatttgagatgtattgcatacaatgttgat

SEQ ID NO: 530 - DNA, 635 bp, Utricularia gibba
cgtaggttcccgttggttgaaatttctcttggtttccaattttcagccgttcaagaggtacgtcgagatcgggcgcgttgccctcgttaactacgggaaggagtatgggcggctggtggtcattgttgatgtcattgatcagaacagggcacttgtggatgctcctgacatggtaaggagccaaatgaacttcaagaggctttccctaaccgacatcaagattgacataaaaagggttccaaaaaagaaggctcttgtcgatgccatggaagctgctgatgtgaaggggaagtgggaaaacagttcatggggcaggaagctcattgtgcagaagaggagagcttccctgaatgattttgaccggttcaagctaatgcttgcaaagatcaagaaggctggagctgttaggcttcagcttgctaagctcaagaaagcatcagcttgagtaacgcattctttgatggttgctgatttcacatccccatctgtgtgatctttttttctcaagcaaatggaattttgagtttgagctgttacatgaagtaggtgtaaagactgatatctcgacttgatttacaccttccattgcactcaactgtattagcaaacacgctttatgttacatgtaccagcag

SEQ ID NO: 531 - DNA, 713 bp, Vaccinium corymbosum
actgagaaaccctacgtcctcctcacttcgcaaaccctaacccccattgcctgccgcctcattctcccacagccgatcttgctttctagctcagctgaaaatgccgttcaagcgatacgtggagatcggaagggttgctctggtcaactacgggaaggactatggacagctcgtcgtcattgtcgacgtcatcgatcagaacagggcacttgttgatgcccctgatatggtgcggactcagatgaatttcaagaggctttcgctcacagatatcaagattgacatcaaaagggttccaaagaagaagactctaatcgcggccatggaggctgctgatgtcaagaacaagtgggagaacagctcttggggcaggaagcttattgtgcaaaagagaagggctgctcttaatgattttgataggttcaagcttatgctagcaaaaatcaagaaagctggagttgtgaggcgggaacttgcaaagcttaagaagcagagcacagcctaatatctatacctggtgattttgatgcggggttctgctagttgtgtttgtacctgttttttggatcagttttcatcaacttatgaattagtcacaggaagagagaagcctccggtatttttgtttttgttaatgttgtcagactccattcgtagtttctggttcatcgaatattgtttagacttgatttgaatcaatgattgtcatttga

SEQ ID NO: 532 - DNA, 797 bp, Gossypium hirsutum
aattaacccaaaataaaataaaaacctagatccaacagttacaaagcaccctactattaatccatcatagagaaaccctaattcctaccctccgcctctccttaagctacgaacactcatagagaacgaaaatgccgttcaagaggtacgttgagatcgggagagtggctctcgttaactacggcaaagattacggcaagttggttgtcatcgtcgatgtcgttgaccaaaacagagcacttgtcgatgctccagatatggtcagaggccaaatgaacttcaagaggcttacattgacagatatcacaatcgacattccccgtgttccaaagaagaagacattgattgaagctatggagaaggccgatgttaagaacaagtgggagaatagctcatggggtagaaagttgattgttcagaagagaagagcatctctcaacgactttgatcggttcaagcttatgttagctaagatcaagagggctggggttgtcaggcaagaactcgcgaagttgaaaaaggagaattcatcttgaaatgatacctgaatcacgaggatttgctagttttgtcattcaacattctgcaatgtgttctttcggaatggttttttttttttgtttcaattaagatcagttgagtgcagtttcattggtctaagacagattttgtagtgaatttattgctagatttttgtttgtgaaaacttgtggtaatttatattggctgcatgagaggcataataatagtctccataaaaacagcgttgtatttgtccttcctctgatggccacaaa

SEQ ID NO: 533 - DNA, 572 bp, Gossypium hirsutum
ccatataataaaaccctaacttactcaaaaccctcatcacatttcttcttccgccgctcaatctctccttttggttcacaacgctcttcacgcacggtaaaaatgccgttcaaaaggtacgttgagatcgggagagtcgctctcgttaactacggcaaagactatggcaagctagtcgtcatcgtcgatgttgttgaccagaacagagctctagttgatgccccagatatggtgaggggccaaatgaactttaagaggcttcaattgactgatttcaaaattgacattcctcgtgttccaaagaagaagacactgattgaagcaatggaaaaagctgatgttaaaaacaagtgggagaatagctcatggggtaaaaagctgattgttcaaaagaagagagcatctctcaatgacttcgaccgattcaagatcatgttggccaagatcaagaaagctggagttgtgaggcaagagcttgctaagttgaaaaaggagaatgcatcttgaagtgattcagaagattttgggtattttgctaattttgccttcaaatattctgcattttgtttttt

SEQ ID NO: 534 - DNA, 824 bp, Gossypium raimondii
gaccaacgtttaagaatcctctattaaatcaccctatactatatataaaccctaactcctctattttaattccctctccgccactctcttccatctccaacactatcacacacacacaaacaccaaaaatgccgtttaagagatacgtcgagatcgggagagtggctctcgttaactacggcaaagactacggcaagttggtcgtcatcgttgatgtcgtcgaccagaacagggcacttgttgatgccccggatatggtaagaggccaaatgaacttcaagaggcttacattgacagatatcacaattgacattccccgtgttcctaagaagaagacattgatcgaagctatggagaaggctgatgttaagaacaaatgggaaagtagctcgtggggtagaaagttgattgtccagaagagaagagcatctctcaacgacttcgacaggttcaagcttatgttggctaagatcaagaggtccggagtcatcaagcaagaacttgctaagctgaaaaaggagaatgcatcttgaatttgatattgaatcatggatttttgttagtttttgtcatcaaacattctgcaggttgttcttttttgtaattttttcttttatttacaaatgattaaaaagattaagatcagttgagagatctttgtttgctatattacatattttatagtgagtttaatagcaggatattgctttgcttgctgcaatttttcttatcaaaacttctggtatttctttatattccctttatagcataatgaaaaataagacacgtaagctgtttaagcttataagcttcaaaataaaaag

SEQ ID NO: 535 - DNA, 1043 bp, Gossypium raimondii
atcactagtagaatgaatagatccaacggttatcaacattccgtaaaagtaccatataataaaaccctaacttctcaaaaccctcatcacatttcttcttccgccgctcaatctctccttttggttcacaacgctcttcacgcacagtaaaaatgccgttcaaaaggtacgttgagatcgggagagtcgctctcgttaactacggcaaagactacggcaagctagtcgtcatcgtcgatgttgttgaccagaacagagctctagttgatgccccagatatggtgaggggccaaatgaactttaagaggcttcaattgactgatttcaaaattgacattcctcgtgttccaaagaagaagacactgattgaagcaatggaaaaagctgatgttaaaaacaagtgggagaatagctcatggggtaaaaagctgattgttcaaaagaagagagcatctctcaatgacttcgaccgattcaagatcatgttggccaagatcaagaaagctggagttgtgaggcaagagcttgctaagttgaaaaaggagaatgcatcttgaagtgattcagaagattttgggtattttgctaattttgtcttcaagtattctgcattttgtttttttatttttatttttattttgtatgttttggtctaagaaaggattaaaaagaatcaattgagggcactatctttagtacatgcaacatttgattttggaggttaagcctgtcacggtttttagttcaattagttgaaccagtcgaatcatataacacgggccaattgattaaattgatggatttgatctgataatttaaaccatggtacgaagtatggtggcctcaatgcatctggtaatcgaggtacctccaatggcggaagttgtgctaagtgacgctgttgttctctcatatgttattttcatcttcgtcaaaacacagtatttttattgctcacattaaaacagttctttttaattagtatatcattactcccatccacataatatatcaaactctaataacttaaaagaacaaagagt

SEQ ID NO: 536 - DNA, 902 bp, Gossypium raimondii
aattaatccaaaataaaataaaaacctagatccaacagtgacaaagcaccctactaataatccatcatagagaaaccctaattcctaccctccgcctctccttaagctacgaacactcatagagaacgaaaatgccgttcaagaggtacgttgagatcgggagagtggctctcgttaactacggcaaagattacggcaagttggttgtcatcgtcgatgtcgttgaccaaaacagagcacttgtcgatgctccagatatggtcagaggccaaatgaacttcaagaggcttacattgacagatatcacaatcgacattccccgtgttccaaagaagaagacattgattgaagctatggagaaggccgatgttaagaacaagtgggagaatagctcatggggtagaaagttgattgttcagaagagaagagcatctctcaacgactttgatcggttcaagcttatgttagctaagatcaagagggctggggttgtcaggcaagaactcgcgaagttgaaaaaggagaaatcatcttgaaatgatacctgaatcacgaggatttgctagttttgtcattcaacattctgcaatgtgttctttcggaatggttttttttttttttgtttcaattaagatcagttgagtgcagtttcattggtctaagacagattttgtagtgaatttattgctagatttttgtttgtgaaaacttgtggtaatttatattggctgcatgagaggcataataatagtctctataagaacagcggtgtatttgtccttcctctgatggccacaaatgctttgaaaatttcttcaaaaaattccttaaaaattatatgtgcttagtgttcattttctaatattaatttgaaaaaagaagaattcaattagattctttaa

SEQ ID NO: 537 - DNA, 731 bp, Tropaeolum majus
cggccgggggttttagtacttcctttaaaataaataaaaccctaaatcacaaacgttcttcttcttcttcttctgcgcctcttgaacctccgttcttccacacagtcacacacccacaccgtcaaaatgcctttcaagaggtacgttgagatcggaagagttgccttagtcaactacgggaaggattacggcaggcttgtcgttatcgtcgatgtcctcgatcagaacagggctctagttgatgcccctgatatggtaaggagccaaattaacttcaaaaggctctcattgaccgacatcaagattgaaatcaaccgtgtcccgaagaagaagacattggttgaagccatggagaaggctgacgttaagaacaagtgggagaacagctcatggggaaggaagttgattgttcagaagagaagagcagctctcaatgactttgataggttcaagctcatgttggccaaaatcaagagaggtggattgatcaggcaagaattatctaagttgaagaaagagacatccgcttaatttattgatagcttaatattgaattgccagttttgtcattgaatatttttaagtgtttgcggattcgttatctattatcaaaagaccaaatttcaaatatttggtttaattactgttattgttctggaatggtagtagtccatgtagcgaagtttttacttctttgttattaaagtaaatggactacaaccatttttatc

SEQ ID NO: 538 - DNA, 729 bp, Tropaeolum majus
cggccgggggacccggttcagtcggagtccgaaaaacctactggtatttattttaagcaagaaaaccctagtttatccatagctacaaattcgatcgtcttctccagtctttagccactagggactttgcgcagatcgtcgaaaatgccgttcaagagatacgtggagataggaagggttgcacttgtaaactacggaaaggattatggtcagcttgttgtcatcgttgatgttctcgatcagaacagggctcttgttgatgcaccagatatggtgaggagtcaaattaacttcaagaggctttcccttactgatattaagattgacatcaacagagttcctaagaagaagactttggttgaggcaatggagaaagctgatgtgaagaacaaatgggagaacagttcatggggcaggaaactgattgtgcagaaacgaagagccgcattgactgattttgataggtttaagctcatgttggccaagatcaagaggggtggacttatcagacaggaacttgcgaaactcaaaaaggagagcactgcttgaatgaatttgttgcatgctaaaccattccatctttttttcataatctcaagttttgtctgtaagccgttagcacactttggcagtttatcgaaagtgggaagtttgtattttcattaagcattaatatcaatggacatgtttagaaaccagagctttttgatattttccatatcaattgtc

SEQ ID NO: 539 - DNA, 566 bp, Helianthus annuus
gccacagcctcctcaagtttcatcggcgcttgaaaacaaaaatgccgttcaagaggtatgttgagatcggaagaattgctctcgttaactacggaaaggattatggaaagctcgtagtcattgttgatgtcatcgatcaaaacagagctcttgttgatgctcctgacatggtgagaggtcaaatgaactttaagaggctcactctcacagacatcaaaatcgacatcaaaagagttccaaacaagaaaactcttattgctgctatggaggccgctgatgtcaagagcaagtgggaaaacagctcatggggaagaaaactcattgttcaaaagaagagagcctcacttaatgattttgaccgcttcaaggttatgttggcaaagattaagaaagcgggagtcgttaggcaagagctagccaagctaaagaaggaaaccgcttgatttgcacaagttttgagatttgagtgcagtttttttttttaaattgttgttgagtagattattgttggtttttttaaaacttcatgtttgaccttttacaaggtattaaagtgatgtttagag

SEQ ID NO: 540 - DNA, 596 bp, Ocimum basilicum
cccttcacacacactcacatctctgccagaaaatgccgttcaagaggtacgttgagatcggtagggtggccctcgtcaactacggcaaggattatggcaagctcgtcgtcatcgttgacgtcatcgaccagaacagggcacttgttgattcccctgacatggtacggagccagatgaacttcaagaggctttctctcaccgacatcaagattgacatcaagagggttcccaagaagaaagctcttattgccgctatggaggctgctgatgttaaggggaaatgggaaagcagctcttggggcagaaagctgattgttcagaagaggagggctgccctcaacgattttgaccgttttaagcttatgttggcaaaaatcaagaaagctggtgttgtccgacaagaacttgcgaagcttaagaaagaagctgctgcttgagtagtacgaattttggtctagggtttcagacatgtatttctttctcatgctgcctctctattcaaagcactgagaattttttaaatttgtatgtcatttttccttgcttcaaaagtatctttcacttaacttatataagttttggctgtttatttgagc

SEQ ID NO: 541 - DNA, 635 bp, Bruguiera gymnorhiza
ggccccttacatccatttagctgcagccgccctcctctctctctctctctctctctctttgtgacattgtcactcacctcacctcgcggacttcaaagatgcctttcaagagatacgtggagatcgggagggtggctctcatcaactacggcaaggagtacggcaagcttgttgtcatcgtcgatgtcgtcgaccagaaccgggctttagttgatgccccggatatggtgaggagccaaatgaacttgaagaggcttacactcactgatatcaagattgatattaacagggttccaaagaaaaagaatttggttgaagccatggagaaagctgatgttaaaagcaagtgggaaaacagttcatggggcagaaagctgattgttcagaagagaagggcagctctcaatgattttgacaggttcaagttgatgttggctaaaatcaagagggctggattggtaaggcaggagcttgcaaaactgaagaaagagaatgcagcttgagagttttcttttatatggagttcccaattttgctattggaaatttctcaagtttcttttggattactgtccttttgttttctgatttgtctttccagattaaaaacagttttaatgaagctttttatttatg

SEQ ID NO: 542 - DNA, 977 bp, Theobroma cacao
acctcctttacaacttaaagcccaacccattactaaaacccagcaagcccatcctccccaaaataatacataaagaataaaagataacctagatcgaacggctatcaacagcctataaaaccaccagataatgaaaccctaattctgagaccctctttcatttcctcctccgcctgcctctctttgttagccccgacacactcacacactgacagcaaacatgccgttcaagaggtacgttgagatcgggagagtggcactcgttaactacggtaaagactatggcaagctcgttgtcatcgtcgacgtcgttgaccagaacagagctctagttgatgcaccagatatggtcaggggccaaatgaacttcaagaggcttacgttgactgatatcacgattgacattcctcgcgttccaaagaagaagacattaattgaagcaatggagaaagctgatgttaaaaacaagtgggagaatagctcatggggtagaaaactgattgtccagaagaggagggcatctctgaatgactttgatcggttcaagcttatgttggctaagatcaagagggctggagtcatcaggcaagagtttgctaagctgaaaaaggagaattaatcttgaagtgatactgaattatggatttttgctagttttgtcatcaatattttgcaagttgttcttttggaatggtattttgtctgtttatctattatgtcagtattactatcagttgaggcactttctttgctatatgacaggtttttgtagtgagtttattgcgagatattgcttgtgaaatgtggttgcttgtttcagttttcttttcaaacttctggtacctatattggctgcagtagaagtaagtctatggctagcaaaatgcttgtttcgactaagacccaaagagaagataggacattgtacttgaccaatgttactctaacccccagaaaaacaaagtcattttcattat

SEQ ID NO: 543 - DNA, 663 bp, Manihot esculenta
aacgctctataaaaaaacaccctagtcatatatgtgaaaaaaaccctaaccccttccatcttctctgcctctttctgcttccccagctcacacacctccagagttcaagatgccgttcaagagatacgtggagatcgggagggtcgctctcgttaactatggcaaagactacggaaagctcgttgtcattgtcgatgttatcgaccagaaccgagctctagttgatgccccagatatggtgaggagccaaatgaactttaagaggctttcactcactgatatcaagatcgacattaacagggttccaaaaaagaaaaatttaattgaagctatggagaaggctgatgttaagaacaagtgggagaatagctcatggggtagaaagcttatcgtccagaagaaaagggcagctctcaacgacttcgatagattcaagttgatgttagccaagatcaagaggggtggattgattaggcaagagctggccaagctgaagaaagagaatccagtctaaaagttcttatttttaagttatcaattttgttatcaacattgtgcaagttattttttgaatgttatccagttggtttcgtattcactttgatattgacaacagttccaaggaaaactttctttatggcagttttggctgtgagtttgtgc

SEQ ID NO: 544 - DNA, 762 bp, Citrus sinensis
  misc_feature (719)..(719): n is a, c, g, or t
gggaaaccctaaatcgaagcctcttgcctcattcattcatctcctcgctcctccggcagagccttgaatatcttcgaaaatgccgttcaagaggtacgtggagataggaagagttgctctcgttaattacggcaaggactatgggaagcttgtggtcatcgtcgatgtccttgatcaaaacagggctcttgttgatgcccctgatatggtgaggagccaaatgaacttcaagaggctttctctcacggatattaagattgacatcaatcgagttcccaggaagaagtctttgattgaagccatggagaaggctgatgtgaagaacaaatgggaaaacagctcctggggcaggaagctgattgtccagaaaaggagagcggcactgaatgattttgataggttcaagctcatgttggcaaagatcaagaagggtggacttgttcgacaggagcttgcaaaactcaagaaggagaatgcagcatagaatttctctcttgtgttcccctttctggtttttagttcttacagcttcaatttgattctattaatgtattgattaatatgagaaaacatcagcttggcgtttttgggttaattgttatttggacagaatttttagatattttcgtaatgtcctttctgttataatctgatctcaagctttgttgttcggtaacctttaatatctgtgaatcttgtatatcgagctttgccaaaangatacactcttcactcctgtatcaaccaactcgatgattatta

SEQ ID NO: 545 - DNA, 924 bp, Gossypium hirsutum
ccgcgcaggtgtatcaacgcagagtacatggggatcacatttcttcttccgccgctcaatctctccttttagctcagaacgctcttcacgcactgtaaaaatgccgttcaaaaggtacgttgagatcgggagagtcgctctcgttaactacggcaaagactacggcaagctagtcgtcatcgtcgatgttgttgaccagaacagagctctagttgatgccccagatatggtgaggggccaaatgaactttaagaggcttcaattgactgatttcaaaattgacattcctcgtgttccaaagaagaagacactgattgaagcaatggaaaaagctgatgttaaaaacaagtgggagaatagctcatggggtaaaaagctgattgttcaaaagaagagagcatctctcaatgacttcgacagattcaagatcatgttggccaagatcaagaaagctggagttgtgaggcaagagcttgctaagttgaaaaaggaaaatgcatcttgaagtgattcagaagattttgagtattttgctaattttgtcttcaagtattctgcatttttttttgtatgtttttatctaagaaaggattaaaaagaatcaattgggggcactttctttagtagatgcaacatttgatttcggaggttaagcctgtcacagtttttagttcaattagttgaaccagtcgaatcatataacagggccaattgactaaattgatggatttgatctgataatttaaaccatggtacgaagtatggtggcctcaatgcatctggtaatcgaggtacctccaatggcggaagttgtgctaagtgacgctgttgttctctcatatgttattttcatcttcgtcaaaacacagtatttttattgctcacattaaaacagttctttttaattagtatatcattcctccc

SEQ ID NO: 546 - DNA, 864 bp, Gossypium hirsutum
tagatccaacagttacaaagcaccctactattaatccatcatagagaaaccctaattcctaccctccgcctctccttaagctacgaacactcatagagaacgaaaatgccgttcaagaggtacgttgagatcgggagagtggctctcgttaactacggcaaagattacggcaagttggttgtcatcgtcgatgtcgttgaccaaaacagagcacttgtcgatgctccagatatggtcagaggccaaatgaacttcaagaggcttacattgacagatatcacaatcgacattccccgtgttccaaagaagaagacattgattgaagctatggagaaggccgatgttaagaacaagtgggagaatagctcatggggtagaaagttgattgttcagaagagaagagcatctctcaacgactttgatcggttcaagcttatgttagctaagatcaagagggctggggttgtcaggcaagaactcgcgaagttgaaaaaggagaaatcatcttgaaatgatacctgaatcacgaggatttgctagttttgtcattcaacattctgcaatgtgttctttcggaatttttttttttgtgtttcaattaagatcagttgagtgcagtttcattggtctaagacagattttgtagtgaatttattgctagatttttgtttgtgaaaacttgtggtaatttatattggctgcatgagaggcataataatagtctctataagaacagcggtgtatttgtccttcctctgatggccacaaatgctttgaaaatttcttcaaaaaattccttaaaaattatatgtgcttagtgttcattttctaatattaatttgaaaaaagaagaattcaatatga

SEQ ID NO: 547 - DNA, 751 bp, Lotus japonicus
aattccttcttgcctctcccttccttccgctctctgtgtttcaccagtcatatcataggcgaaaatgcctttcaagaggttcgttgagattggaagggttgctctggttaactatggcaaggagtatgggaggctcgtcgtcatcgtcgatatcattgaccagaacagagctcttgttgatgcccctgatatggtgagatcccaaatgaatctcaagaggctttccctcactgacattaaggttgatattaagagggtccctaagaagaaggatctgattcaagcaatggaggctgctgatgttaagaacaagtgggagaatagctcatggggccgaaaactgattgtgaagaagagacgggcagctctgaatgattttgataggtttaagataatgttgacaaagatcaagagggcaactgctgtaaggcaagagcttgctaagctgaagaagagtgctgcttaggcatgacttcatgtgcaatttttgaattctattacaatattccttcaattagtacaccttggttgttatatgagttttatatatcattgaggacttcctatgaagtttattttgagatttttcatgttagtggattgatgtcagtttttccaatctcattgttaaaatatctagtcctattttttacttttgtttgctttcagatgtttgggtgttgatttaatttatgacgttctcaagttaacaaatatattaagatgcaactggagcaggatctgctttttt

SEQ ID NO: 548 - DNA, 640 bp, Capsicum annuum
ctcgcagcttctcttttcctagcctgctcgcacgcacgcacttggccgaaaatgccgttcaagaggttcgtggagataggaagggtacccttaatcaactacggaaaggactatggcaagctcgttgttatcgtcgacgtcatcgaccaaaatagggctcttgttgatgctccggacatggtgagaagccagatgaacttcaagaggctttcacttacagatatcaagattgacatcaaaagaatcccgaagaagaagaccctggttgaggctatggaagctgctgatgtgaagaccaagtgggagaacagttcatggggaaggaagttgatagtgcagaagaggagggctgcactcaacgattttgacaggttcaagcttatgttggcaaagatcaagagagctggagtagtgagacaggagcttgcaaagctcaagaagactgctgcttgaaaactctctgatcagtgcgtgcaattgatatataggatttttggatcttgtattttgtttagttttgagggatgttgttagaacaagtctgttatatttcatgccatgcaatgtttaatactttttgagatcgcttttgtcttgagattttgcttaattatgatgggaaaaccgctggcttctctga

SEQ ID NO: 549 - DNA, 819 bp, Populus trichocarpa
ccctaaccccttgtcatttctgcgtcttccttagctgtccgcctccacccttgctttcacggtgacgcacacctcaagaacccagcatgcctttcaagagatacgtggagatcgggagggtaggtctcgtcaactatggaaaagaatacggcaggatcgttgttatcgttgatgtcatcgaccagaaccgcgctctggttgatgccccagatatggtgaggagccaaatgaacttcaagagaatctcactcaccgatatcaagattgatatcaaccgggttccaaagaagaaggctttgattgaagccatggagaaggctgatgttaagaacaagtgggagaatagctcttggggcagaaggctgattgttcagaagagaagggcagctctcaatgacttcgatcggttcaagttgatgttggctaagatcaagaggggtggattgatcaggcaagaacttgcgaagttgaagaaagaaagtgttgcttaagagtaatctgtacaaggacgtccaattttgttatcaacatgaagcaagttgttttgggatgttttttcagttggttttctatggactcccagattatgagaagtttaagaagattttccatatatttaagatttcgaggtcaatcttcctgtgctacgtgcactagttactttttatggagtggaaatttgtgtgtttctcatatatagaattcgcttatgctgctacccttcagggaaaaaaaacgtccatttccaacaatgtgttgttaaatatgagaggcgacgctacaaccaagtgcattgataatttgccccttgctttacta

SEQ ID NO: 550 - DNA, 738 bp, Prunus persica
gctcatcttaaacaaaaccctatttcttcacatctcaaaccctagattggcctctttcctcactcatcttctccgactcctctgcccgacctttttcagaggatccgaaaaatgccgttcaagagatacgttgagatcggacgagtggctctcgtcaactacgggaaagactacggcaggctcgtcgtgatcgtcgatgtcctcgaccaaaacagggctcttgttgatgcccctgacatggtgaggacccaattgaatttcaagaggcttacactcactgatattaccattgacatcaaaagggttcctaagaagaagactctgcttgctgccatggaggctgctgacgtaaagaacaaatgggaaaacagctcgtggggcaggaagctgatagtgcagaagagaagagctgcactaaatgattttgataggtttaagctcatgttggcaaagatcaagagggcgggaatcatcaggcaggagctaacgaaactcaaaaaggagagtgcagcctgagtcttgaatctgtactcttttagtttttgcagccttgttgcaatatttttgagttgtctctttatgttttgattcgtagtggtggcagtaacttgatatttggttaggtcatagttattatgagtgggaaccagccacaagtgattatctctataaaccttgtatggattttctttgaaatgaaatggagccaaggaactttccttctcaattttatcaata

SEQ ID NO: 551 - DNA, 638 bp, Tamarix hispida
  misc_feature (131)..(131): n is a, c, g, or t
  misc_feature (151)..(151): n is a, c, g, or t
  misc_feature (472)..(473): n is a, c, g, or t
  misc_feature (493)..(493): n is a, c, g, or t
  misc_feature (600)..(600): n is a, c, g, or t
gggggaatttatcttctccggctctctcgcctgttcaccatattgaacttcggcgatccctagccagatcagcgaaaatgccgttcaagaggtacgttgagatcggaagagtggccctcgtcaactacggnaaggattatgggaggctcgntgtcatcgtcgacgtcattgaccagaatagagctcttgttgatgcccctgatatggtgaggtgccagatgaactttaagaggcttacactcacagatcttaaggttgatatcaaaagggtcccaaagaagaagacattgattgaagccatggaagcagctgatgttaaaaacaagtgggagaagagttcttggggcagaaagctcatcgtccagaagaaaagagcctcacttaatgactttgacaggttcaagatcatgttggccaagatcaagagggctggattagtcagacaggagcttgccaagttgaaaaaggaganngcagcataaggggatgatcntgggtcgtcatttttgctatgtacttgaattttatatgttctttctataatttagtttaaaagtttcggagaacttttgatttatgatgtagaacagcagttctgtngttgtttcttctgcagaatggtatccattgtgtttctg

SEQ ID NO: 552 - DNA, 665 bp, Nicotiana tabacum
  misc_feature (42)..(42): n is a, c, g, or t
  misc_feature (585)..(585): n is a, c, g, or t
cactttctccttttacctctctctcccctccgcagcttcacnactccttcagatcactgaaaatgccgttcaagaggttcgttgagatcggaagagttgcgctcgttaactacgggaaagactatgggaagcttgtcgtcatcgttgacgtcatcgaccaaaatagggctcttgttgatgctcccgacatggtgaggagccagataaacttcaagaggctttcactcacagatatcaaaatcgacatcaaaaggattccaaagaagaagaccctggttgctgctatggaggctgccgatgtgaagaacaagtgggagtccagttcatggggaaggaagttgatagtgcagaagaggagggcctcactcaacgattttgacaggtttaagcttatgttggcaaagatcaagagggccggtgtcgtgagacaggagcttgcaaagcttaaaaaggagactgtggcttaagaactttctgagtagccacattggtttagaacaattttggaagttgtatttttttttaccttggggaatgtattctcaatgaaagaacccctgttctgtttttctttttccttgtttnttcgattgcttcgaaattatctttctaatctatgatgatgaactgaggatttcttgctgagttatttcataatgtttgtc

SEQ ID NO: 553 - DNA, 532 bp, Cleome gynandra
tcttcttcctttacttagctgcccgtcgtccgctttcctctctgagcttcgagcgatctgccaatttgatcaaatggcgttcaagaggtatgttgagataggaagagtggctcttgtcaactacggcaaggattacggaaggcttgtcgtgatcgtcgacgtcgtcgaccaaaacagggctctggtggatgccccagatatggtgaggacccaaatgaatttgaagaggttgtctctgactgatatcaagattgatatcaacagggtgcctaagaagaagagtttggttgaggcaatggaaaaagctgatgtgaagaacaaatgggagaacagttcctggggaaggaaattgattgtgcagaagagaagggcttcgcttaacgattttgacaggttcaagatcatgttggctaaaattaagagggcgggtgttgttagacaggaacttgctaagctcaagaaagagacttctgcctgattattatcttttgggttttctgtttgtgtgattactttttaaattttgtaaact

SEQ ID NO: 554 - DNA, 670 bp, Orobanche aegyptiaca
tactacacagcctctcctcacgtagatagacgcatttgtagatcgccgccgaacatgccgttcaagaggtacgtggagatcgggagggtggccctagtcaattacgggaaggactatggcaagcttgtcgtcatcgttgacgtcatcgaccagaaccgggctctagtggattcccccgacatggtacgtggccagatgaacttcaagagactatctcttacagatatcaagattgatattaagagggtgccgaagaagaagacccttatagccgcaatggaggctgctgacgtgaagggcaaatgggaaaagagctcatggggaaggaagcttattgttcagaagagaagggctgccctgaatgattttgataggttcaaggtgatgctggctaaaatcaagaaggctggtgttgtccgacaggagcttgcaaaacttaagaaagagagtgcagtgtaagaaagttcaaaatttccagttattgagaaattggtgtagggttgtgaaagctgtatcagttttatcctgcatatttgtttacttatcttttgattttgtactcgttcttgaattcattatgaaatgaaggatactccaatttttgtcttgatatttgtttggattgtgcctgggatcacaattatctaaacaatgttttacttttaggttt

SEQ ID NO: 555 - DNA, 643 bp, Solanum tuberosum
ggtaagcctcactcttcgcgcctgatagcagctccatcagatcgccgaaaatgccgttcaagaggttcgtagagatcggaagagttgccctcgtcaactacgggaaggattacgggaagcttgttgttatcgtcgatgtcattgaccaaaatagggctcttgttgattccccggacatggtgaggagccagatgaactttaagagactttcactcacagatatcaaaatcgacattagtagaatcccaaagaagaagaccctcattgctgctatggaggctgctgacgtgaaaaacaaatgggagagcagttcctggggaaggaagttgatagttcagaagaggagggcctcacttaatgattttgacaggttcaagcttatgctggcaaagataaagagggctggagtcgtgagacaggagcttgctaagctcaaaaaggaagttgcttgaaaactttttgattagtcaaatttgaatattagattttcaaaaggtgtacttgtttagctttgagattttgttgcattaagggaagaaaaacatatttttgtttttacttccaacgtctttctatagtttttctgatctatgatgatgaatgatcttttccaagaattacctgctccgtcatttaatgtaat

SEQ ID NO: 556 - DNA, 695 bp, Solanum phureja
gacaatccacaccagtagcctcactcttggcgcctgatagcaactccattagatcgccgaaaatgccgttcaagaggttcgtagagatcggaagagttgccctcgtcaactacgggaaggattacgggaagcttgttgttatcgtcgatgtcattgaccaaaatagggctcttgttgattccccggacatggtgaggagccagatgaactttaagagactttcactcacagatatcaaaatcgacattagtagaatcccaaagaagaagaccctcattgctgctatggaggctgctgacgtgaaaaacaaatgggagagcagttcctggggaaggaagttgatagttcagaagaggagggcctcacttaatgattttgacaggttcaagcttatgctggcaaagataaagagggctggagtcgtgagacaggagcttgctaagctcaagaaggaagttgcttgaaaactttttgattagtcaaatttgaatattagattttcaaaaggtgtacttgtttagctttgagattttgttgcattaagggaagaaaaacatatttttgtttttactgccaacgtctttctatagtttttctgatctatgatgatgaatgatcttttccaagaattacctgctccgtcatttaatgtaatggcttttttcattttgttgtgtgcaatcaattaactatga

SEQ ID NO: 557 - DNA, 596 bp, Ipomoea nil
tcagctcaacctgcatcgccccgttctgctcattcggattgccaaaaatgccgttcaagaggtacgtggagatcgggagggttgcccttgtcaactacggaaaggactatggcaagcttgtcgtcattgtcgatgttatcgatcagaacagggcccttgttgatgctccagacatggttaggagccaaatgaactttaagaggcttacactcacagacatcaccattgacattaaaagagtgccgaaaaagaagactttgatcgctgctatggaggctgctgatgtgaagagcaagtgggagaacagctcatgggggaggaagttgatcgtgcaaaagaggagggctggcctcaatgactttgacaggtttaagattatgctggcaaaaatcaagaaagctggagttgtgagacaggagcttgccaagcttaagaaggagagcactgcctgataacccagacttttgatagagagagatcttagctacactaagctttgagtttgtgttgtttatttggaaattttaatttttgtccctaaagcaaagacttcgcctttttcattacctgaatagaagtttgagattttaccaccc

SEQ ID NO: 558 - DNA, 694 bp, Glycyrrhiza uralensis
ctactgactggctaatcgttaactaccccgccttctctgcactccatagccgaaaatgcctttcaagaggttcgttgagatcgggagggttgctctggtcaactacggcaaagagtatggcaggctcgtggtcatcgtggacatcatcgaccagaacagagcacttgtcgatgcccctgatatggtgaggtccccaatgaatttcaagaggctttccctcacagacatcaaagttgacattaagagagttcccaagaagaaagacctcatcaaggccatggaagctgcagatgttaagaacaagtgggagaacagctcatggggcagaaaactcattgtcagaaaaagaagggcgtccctcaacgattttgataggttcaagatcatgttggctaagatcaagagggcggctattgttaggcaagagcttgctcagctgaaaaagaccgcatcttaggctttacttcctgatacaattttcaaattttgttatcaatttcctttccatttagtacaacttggatgttacgagtttttaatgtatcattgagacacgtgctaaaaagtttaatcttcagatattcatgttacgagagagtcaaatgccttttttcatgtaattttatttttattaggttggccttgtcattggattcgttccgttcttgattactatctgtttgtttcaattgcc

SEQ ID NO: 559 - DNA, 751 bp, Amsonia hubrichtii
tgttagcagtacccctccgccttccctccaacattccatactctttcacccgttccgcagttcgacgaaaatgccgttcaagaggttcgtggagatcggaagggtcgccctcgtcaactatgggaaggactacgggaagctcgttgtcatcgtcgacgtcatagaccagaacagagctctagttgatgcccctgacatggtgaggagtcaaatgaattttaaacggcttcaactaactgatatcaaaattgacattaaaaggactccaaaaaagaagactttggttgctgctatggaggctgctgatgtcaagaataagtgggagaacagttcctggggtaggaagctgattgtgcaaaagaaaagggcctcactcaatgattttgaccgattcaaactcatgttggcgaaaatcaagaaagctggagtagtcaggcaggagcttgcaaagctaaagaagcaggcagcataatttggaacatctctccagatattttcaaattttgatatagttttgcatttggtaaaattgtattggtgtactccagcgggctctaattttattggttaatggatattgggacacctaaagagaaacatgcctttcttttactcacttttgtaatgcattttaaatctttagatgtttttttcttttggatcattttattgctcagagtttagaacaaagttgccttattggtttctttccagtagtactaatgtgtgagatttatgtccatggaaattg

SEQ ID NO: 560 - DNA, 640 bp, Amsonia hubrichtii
aaaatgccttttaagcgatttgttgagatcgggagggtagccctcatcaactatggcaaggactacggcaagcttgttgtcatcgttgacgttatcgaccagaatcgagctcttgttgatgcccctgacatggtaagatgccaaattaactttaagcggcttcaactgactgatatcaaaattgacatcaaaaggattcccaagaagaggaccctgattgaggcaatggaggctgcagatgttaagaacaagtgggaaaatagctcctggggaagaaagctaattgttcaggaaagaagggcttctctaaatgattttgacaggttcaagctcatgttggctaagatcaagaaggctggagtggtcagacaagaacttgctaagttgaagaagcaaagtgctgcctgaacattaattttctatggaaattttaattttgtagccagacgtcaagctagaattgcttcagatcactttctttgttcactatttctctatagaagatctagatattgtatgctatagcagatcctactctggagtagctcattctaatttctgttcaggcgattaagccagatctctttctggagtttatctttgttatttcagaatgccctttgctacagaatcaattttt

SEQ ID NO: 561 - DNA, 666 bp, Cyamopsis tetragonoloba
ctttcaagaggttcgttgagatcgggagggtagctctcatcaactacggtaaggagtacggtagactcgtcgtcatcgtcgatgtcatcgaccagaacagagccctcgtcgatgctcctgacatggtgaggtcctctgtgaatttcaagaggctttccctcactgacattaaggttgacattaagagagttcccaagaagaaggatctcattaaagcaatggaagctgctgatgttaaaaacaagtgggagaacagctcatggggtaggaagctcattgttcagaagagaagagcttcccttaatgattttgataggttcaagataatgttggcgaagatcaagagggctgctgttgttaggcaagagcttgctaagttgaaaaagagcgcagcttaggcattaattcgtgatacattattcaaattttgctatgaatttgcttccctttagtactacctggttgttgtgagcttttatgtatcattcagaaacttggaaatgttttatcatcttagggtttatgtcagtactatatacttctctcccattttattttttgcttgcagacttttgaatattggtttaaaagatagaaacattctcatactgcgagtgagagcgcctactattatttttatttgcaaaatttattcttctttggctg

SEQ ID NO: 562 - DNA, 695 bp, Euonymus alatus
cggccgggggatctctacactcacccccgcccccgtctctagtcttagacgcttacagaaacttcacaagatccaaaatgcctttcaagaggttcgtggagatcgggcgggtggcactcgtcaactacgggaaagactacggcaggattgttgtcatcgtcgatgtcctcgatcagaacagagcccttgttgatgctccggatatggttagaacccaaatgaatttcaagaggttgtctctaactgacatcaagattgagattaaccgggtgcccaagaagaagaatctgattgaggctatggagaaggctgatgttaagaacaagtgggagaacagctcttggggtaggaagcttattgttcagaagagaagggcatctcttaatgattttgatagatttaaaattatgttggccaagatcaagaggtctggattggtgaagcaagagcttgcaaaactgaaaaaggaaaatgcatcctaggcgattatttataagaacttcccagttttgtttgctgtgttccttgagattatgtttttggatcttacacatttttcttgttcaatgtgagaccttgtcaaaaatgaaattctgtaacttgcttaatgtgacccattctgtcatgtgggttttgtgcttcaagtttatgtggttgtgatggcctttttagcatttatgtctgaaaatcttatt

SEQ ID NO: 563 - DNA, 765 bp, Tropaeolum majus
ataaaaccctaaatcacaaacgttcttcttcttcttcttctgcgcctcttgaacctccgttcttccacacagtcacacacccacaccgtcaaaatgcctttcaagaggtacgttgagatcggaagagttgccttagtcaactacgggaaggattacggcaggcttgtcgttatcgtcgatgtcctcgatcagaacagggctctagttgatgcccctgatatggtaaggagccaaattaacttcaaaaggctctcattgaccgacatcaagattgaaatcaaccgtgtcccgaagaagaagacattggttgaagccatggagaaggctgacgttaagaacaagtgggagaacagctcatggggaaggaagttgattgttcagaagagaagagcagctctcaatgactttgataggttcaagctcatgttggccaaaatcaagagaggtggattgatcaggcaagaattatctaagttgaagaaagagacatccgcttaatttattgatagcttaatattgaattgccagttttgtcattgaatatttttaagtgtttgcggattcgttatctattatcaaaagaccaaatttcaaatatttggtttaattactgttattgttctggaatggtagtagtccatgtagcgaagtttttacttctttgttattaaagtaaatggactacaaccatttttatcaagtcaggtgttgttgagtttttgcaaataggataggttaacaaaattacatttccaattacatggt

SEQ ID NO: 564 - DNA, 688 bp, Tropaeolum majus
ttacggccggggagctacaaattcgatcgtcttctccagtctttagccactagggactttgcgcagatcgtcgaaaatgccgttcaagagatacgtggagataggaagggttgcacttgtaaactacggaaaggattatggtcagcttgttgtcatcgttgatgttctcgatcagaacagggctcttgttgatgcaccagatatggtgaggagtcaaattaacttcaagaggctttcccttactgatattaagattgacatcaacagagttcctaagaagaagactttggttgaggcaatggagaaagctgatgtgaagaacaaatgggagaacagttcatggggcaggaaactgattgtgcagaaacgaagagccgcattgactgattttgataggtttaagctcatgttggccaagatcaagaggggtggacttatcagacaggaacttgcgaaactcaaaaaggagagcactgcttgaatgaatttgttgcatgctaaaccattccatctttttttcataatctcaagttttgtctgtaagccgttagcacactttggcagtttatcgaaagtgggaagtttgtattttcattaagcattaatatcaatggacatgtttagaaaccagagctttttgatattttccatatcaattgtcatttagaaggaaattactatgaaattt

SEQ ID NO: 565 - DNA, 578 bp, Lippia dulcis
cgcacattcactcacatttctgcaaaaatgccgttcaagaggtacgtcgagatcggaagggtggccctcgtcaactacggaaaggactacggcaggcttgttgtcatcgtcgacgttatcgaccagaacagggctcttgtggatgcccctgacatggtaaggagccagatgaacttcaagaggctttctcttaccgacattaagattgatattaagaggtgcccaaagaagaaggctcttattgaagctatggaggctgctgatgttaagggcaaatgggaaaagagctcttggggtaggaagcttattgtccagaagagaagggccgccctcaacgattttgaccggttcaagctaatgcttgcaaagattaagagggctggtgttgtcaggcaggagcttgctaagcttaagaaagagactgcatgaatagcccgagttcttgttattgagattttgccttaggattttgagacgtgtatcgctttattatgttatgcagacgattgatctttgttcttgaattcattacagaagggaaagtacttaagttttgcacattatcatttgaacttctc

SEQ ID NO: 566 - DNA, 634 bp, Lippia dulcis
ctcaacaccagcctcttttcctcctcccgcagatcgccgctcatcatgccgttcaagaggttcgtggagatcggaagggtagccctcgtcaattacggcgaggactacggaaagcttgttgtcattgttgatgtcatcgatcagaaccgggcccttgttgattcccctgacatggtacgtagccagatgaacttcaagagactttctctcacagatattaagattgacatcaaaagagttcctaagaagaaaactcttgttgctgctatggaggctgctgatgttaaaggcaagtgggaaaatagctcatggggaagaaagctaattgttcagaagagaagagcgtctctcaatgactttgaccgcttcaagctgatgctcgccaaaatcaagaaggctggtgttgtcaggcaggagcttgctaaacttaagaaagagactgcatcttagaaagtatacttctgtggtttgccagaatttggcttaggatttttgaaattgatcttgaatacttgttgtatcagtaaggatgctccaattttgcctatttatgtctgaacttgaaagttttatatttttgtttgtcacaaattttatgattctagacaattgctggactaattaatgataaatt

SEQ ID NO: 567 - DNA, 805 bp, Gossypium hirsutum
ccaacgtttaagaatcctctattaaacaccctataatatataaccctaactcctctattttaattccctctccgccactctcttccatatccaacactatctcacacacacaaacaccaaaaatgccgtttaagagatacgtcgagatcgggagagtggctctcgttaactacggcaaagactacggcaagttggtcgtcatcgttgatgtcgtcgaccagaacagggcacttgttgatgccccggatatggtaagaggccaaatgaacttcaagaggcttacattgacagatatcacaattgacattccccgtgttcctaagaagaagacattgatcgaagctatggagaaggctgatgttaagaacaaatgggaaagtagctcgtggggtagaaagttgattgtccagaagagaagagcatctctcaacgacttcgacaggttcaagcttatgttggctaagatcaagaggtctggagtcatcaagcaagaacttgctaagctgaaaaaggagaatgcatcttcaatttgatattgaatcatggatttttgttagtttttgtcatcaaacattctgcaggtttttcttttatgtaattttttattttatttacaaatgattaaaaagattaaagatcagttgagagatctttgtttgctatattacatattttatagtgagtttaatagcaggatattgctttgtttgctgcaatttttcttatcaaaacttctggtatttctttatattccctttatagcataatgaaaaataagacacgtaagctgtttaagcttataagc

SEQ ID NO: 568 - DNA, 615 bp, Vaccinium corymbosum
ggccacaatcttgcagagtcagttttgctgccggtcgaactcagatcgccgaaaatgccgttcaaaagatacgtggagatcggaagggtcgctctcgtcaactacggcaaagattatggaaagcttgtcgtcattgtcgacgtcctcgatcaaaacagggctctagttgattcccctgatatggtgcggacccaaatgaatttcaagaggctttcactcactgatatcacgattgacatcaaaagggttccaaagaagaagactttaattgcagcaatggaagccgctgatgttaagaacaagtgggagaacagttcttggggcaggaaacttattgtgcagaagaggagggcttcactcaatgattttgaccggttcaagctaatgttggcaaaaatcaagagagctgcagttgtgaggaaggaacttgcaaagcttaagaagcagagcacggcataatgcctcttctcttcttatcttgagttcttttttctgcaagtttcgttggaacttttagggttcattttctctagtttatggattaaatttgaattttgttaagatgatcatttgactcgatttgaaatccctatggttattggaggactcatctta

SEQ ID NO: 569 - DNA, 474 bp, Eschscholzia californica
aaccatgcctttcaagcgttatgttgagattgggcgagttgctcttgttaactacgggaaagattatggtcgacttgtcgtgatcgttgatgttctcgatcaaaacagggctcttgttgatgcacctgatatggtgagaagccaaatgaacttcaagaggctctctttgactgatatcaagattgaaatccccagagtccctaataagaagactttgatttcggccatggaggctggagatgtaaagaacaaatgggagaacagttcatggggaagaaactgattgtcagaagagaagggctgccctgaacgactttgataggttcaaggtcatgtggcaaagatcaagaggggtgagctatcaagcaagagcttgcaaaagctgaagaagcagagcgcctaagattttacgctcttttgcgaagtcagttttatagagaattttgagacgcagttgttttgctctgttatttg

SEQ ID NO: 570 - DNA, 711 bp, Allium cepa
tcctcacacctcgttcctgcgcaagaaaccctaaacctaaatcttccttcattgtagccgcctgcttcagccatgccgttcaagagatatgtcgagatcgggcgcgttgcacttgtcaactatggaaaggattatggcaaacttgttgttattgtcgatgtcgttgatcagaacagagctttggttgatgctccagacatgatcagaggccagatgaacttcaaaaggcttagtctcacagacttcaaaattgacattccaagaacccccaagaagaaagtattgatcgaggctatggaaaaagctgatgtgaagaatagatgggaaaatagttcatggggaaggaagctgatcgtgcagaagaggagagcttccttgaccgacttcgacaggttcaaagtcatgttggcgaagatcaagagaggtactgctgtcaggcaagagctcaacaagttgaagaaacagagtgttgcagcttaaaggattatccatcttgtttgtattgttttaattggattcataatgtttttggatctgcggtttttgcttaatatgtacttaagttgtattgggagattctgaacttcaaatggtctgttatttatgttcttggttatagaacttttaggtcatgttttatttgtgtttgttggaggagaactgatattttaaaagaaaaatcagtatggtgcatggaggtatgtcatcttt

SEQ ID NO: 571 - DNA, 808 bp, Malus domestica
cagcggatccccgctcagcttcaacaaaaccctatttcgtcacatctcaaaccctagctatcccctcttgcctctctcactcatcttctccgactcctctgccccgatttgtccgatcgtctgagaaaatgccgttcaagagatacgtggagattggacgagttgctctcgtcaactacggcaaagactacggcaagctcgtcgttatcgtcgatgtcatcgaccaaaacagggctctggttgatgcacctgacatggtgaggacccaattgaacttcaaaaggctatcgctcaccgatatcaaaatcgacatcaaaagggttccgaacaagaagactctgattgctgcaatggaggctgctgacgtaaagaacaaatgggagaagagctcgtggggcaggaagctgatagtgcagaagagaagagctgcactcaacgattttgataggttcaagcttatgttggcaaagatcaagagggctggaatcatcaggcaggagctaacgaagctcaaaaaggagagtgcagtctgaacgcagtcctgttaacacatctctggcgagtttatgttttgattcgtagttacaggtggaaattagccgcaattcgttaaaccttgtatggatttctttgaaatgaaacacatccgacgaattttcgatcgcaaattaatcctctgttatgttaaaccatagttttgattttctaagacttgtttgatctcgtatttagatggtggtgcacaattggtgccatgtttcccctgctttgtttccttttaaaagacctatctatgaatttgccctca

SEQ ID NO: 572 - DNA, 630 bp, Centaurea maculosa
ggggaccctcagaaccagcatgcctttcagagatacgtggagatcgggagggtaggtctcgtcaactatggaaaagaatacggcaggatcgttgttatcgttgatgtcatcgaccagaaccgcgctctggttgatgccccagatatggtgaggagccaaatgaacttcaagagaatctcactcaccgatatcaagattgatatcaaccgggttccgaagaagaaggctttgattgaagccatggagaaggctgatgttaagaacaagtgggagaatagctcttggggcagaaggctgattgttcagaagagaagggcagctctcaatgacttcgatcggttcaagttgatgttggctaagatcaagaggggtggattgatcaggcaagaacttgcgaagttgaagaaagaaagtgttgcttaagagtaatctgtacaaggacgtccaattttgttatcaacatgaagcaagttgttttgggatgttttttcagttggttttctatggactcccagattatgagaagtttaagaagattttccatatatttaagatttcgaggtcaatcttcctgtgctacgtgcactagttactttttatggagtggaaatttgtgtgtttctcataaag

SEQ ID NO: 573 - DNA, 832 bp, Gossypium hirsutum
tgccatttcttcttcggccgctcaatctctccttttagctcagaacgctcttcacgctgtgtagaaatgccgttcaaaaggtacgttgagatcgggagagtcgctctcgttaactacagcaaagactacggcaagctcgtcgtcatcgtcgatgttgttgaccagaacagagctctagttgatgccccagatatggtgaggggccaaatgaactttaagaggcttcaattgactgatttcaaaattgacattcctcgtgttccaaagaagaagacactgattgaagcaatggaaaaagctgatgttaaaaacaagtgggagaatagctcatggggtaaaaagctgattgttcaaaagaagagagcatctctcaatgacttcgacagattcaagatcatgttggccaagatcaagaaagctggagttgtgaggcaagagcttgctaagttgaaaaaggaaaatgcatcttgaagtgattcagaagattttgagtattttgctaattttgtcttcaagtattctgcatttttttttttgtatgtttttatctaagaaaggattaaaaagaatcaattgggggcactttctttagtagatgcaacatttgatttcggaggttaagcctgtcacagtttttagttcaattagttgaaccggccaattgattaaatcgattaatcgatggatttgatccgataatttaaaccatgctacaaagtaaaactatgagatgacagaaaccctgagctccccctatcacctctggtgatacgggtatcagcatcaacaaaggtaaacatcgaattacccgctccccgtattacatggtggc

SEQ ID NO: 574 - DNA, 724 bp, Vigna unguiculata
catcacttcggcagtcacagaatcctcgtagccgaaaatgcctttcaagaggtacgttgagattggaagggttgctcagatcaactacggcaaagagtatgggaggctagtggtcattgtcgacgtcattgaccagaacagagctcttgtggacgctcccgatatggtgaggtcccaagtgaacttcaagaggctgtcactcactgacattaagattgatatcaagagggtcccaaagaagaaggatctcattcaagccatggaggctgctgatgttaagaacaggtgggagaaaagttcatggggcagaaaactgattgtgcagaagagaagagcatccctcaatgactttgacaggtttaagattatgttggcaaagatcaagagggcaggagttgttaggcaagagcttgctaagctgaaaaagactgcttaggcctctaatttcatgtgcaatttccaaattttgttatgaatttctttcgattagtttacttttgttacatgagtttttattatgtatcattgacagatttcctagaaatgtttattttgagatcttgtgttactagtggattgatgccagttctcccaatctcattgttacaatatttggtttgcctcttttggccttttgtttgcactttgattattggttttctgacaattgattaaaaaatcttttggctacaatgcaaatatgagcaagaattgctttttaaaa

SEQ ID NO: 575 - DNA, 735 bp, Vigna unguiculata
gcttctcctctcatcacttcggcagtcacagaatcctcgtagccgaaaatgcctttcaagaggtacgttgagattggaagggttgctcagatcaactacggcaaagagtatgggaggctagtggtcattgtcgacgtcattgaccagaacagagctcttgtggacgctcccgatatggtgaggtcccaagtgaacttcaagaggctgtcactcactgacattaagattgatatcaagagggtcccaaagaagaaggatctcattcaagccatggaggctgctgatgttaagaacaggtgggagaaaagttcatggggcagaaaactgattgtgcagaagagaagagcatccctcaatgactttgacaggtttaagattatgttggcaaagatcaagagggcaggagttgttaggcaagagcttgctaagctgaaaaagactgcttaggcctctaatttcatgtgcaatttccaaattttgttatgaatttctttcgattagtttacttttgttacatgagtttttattatgtatcattgacagatttcctagaaatgtttattttgagatcttgtgttactagtggattgatgccagttctcccaatctcattgttacaatatttggtttgcctcttttggccttttgtttgcactttgattattggttttctgacaattgattaaaaaatcttttggctacaatgcaaatatgagcaagaattgctttttaaaa

SEQ ID NO: 576 - DNA, 724 bp, Ananas comosus
atcctcatcccttctcctaccccgccactgttcgtgcggcgccgatcccctcctcccccgcggcgatggttttcaagcgctacgtggagattggaagggtcgccctcgtcaactatggcaaggactacgggaggctcgttgttatcgtcgatgttatcgatcagaaccgagctttggtcgatgcccctgacatggtgcgatgccaaatgaacttcaagaggctttcactgaccgacattaaaatcgacattccacgaattccaaagaagaagtcattgattgctgcaatggaagctgccgatgtcaagaacacatgggagaagagctcgtgggggaggaagctgattgtccagaaaaagagagctttgctaaacgactttgataggttcaaggtcatgttggcaaaaattaagagagcagggaccatcaaccaagagcttgcgaaacttaaaaagcagaatgccgcttgaactccttgcggtagagataggaaattttgagaaatttgaatctgttgcatcaatcttttttctttttggtttcttattgaacttactttgtgagccttgtttcagatattttagattcggtcgcatcttctgttgacacctgctggtaatctgtgatgcgtctttttctcttctattgtgtctttgtttctagtagttattttgtggattggaattgctttgtggttacaggtttcgaccgtttgttttgcagt

SEQ ID NO: 577 - DNA, 741 bp, Nicotiana tabacum
gggaatcacgcacaattagcctcactcttcgcccctggtcagctgcttcctcaaatcgtcgaaaatgccgttcaagaggttcgtggaaatcggaagagtcgcccttgtcaactacggggaggactatgggaatctcgttgttatcgtcgatgtcattgaccaaaatagggcgcttgttgatgctcctggcatggtgaggagccagattaactttaagaggctttcactcacagatatcaaaattgacatcaaaaggattccaaagaagaagaccctcgttgctgctatggaggctgctgacgtgaagagcaaatgggagagcagttcctggggaagaaagttgatagttcagaagaggagggcatcgcttaatgattttgacaggttcaagctcatgctggcaaagataaagaaggctggagttgtaaggcaggagcttgctaagcttaagaaggaggctgcttaggaactctttgattagtgagatttgtatgataggagttttgaaagttgtttgtgttttgcttttagattttggttcattactggtaagtcttttggttttatttgaattatgatggtgaacatcctcttcccaaagtttcaaggattaccttcgcagacactttcatattgtcactcagtatgttttggtttcatgctagtgatctcactcgagtgatgaatcattttaggtaatgagaatttgctcaaaaattttattactaacattttgcttgg

SEQ ID NO: 578 - DNA, 669 bp, Triphysaria pusilla
ctcatctccgcctcctcctcacacagcacctgctcacacacgcatctctaaaaatgccgttcaagaggtatgttgagatcggaagggtggcacttgttaactacggagaggactatggcaagcttgtagtcattgtcgatgttatcgatcagaacagggctcttgtcgattcacctgacatggtaaggagccaaatgaacttcaagagactttctcttacagacatcaagatcgacataaagagagtccctaagaagaagactcttattgctgctatggaggctgctgatgtcaagggaaaatgggaaaagagttcgtggggcaggaagcttattgttcagaagcgaagggcagcgctcaatgattttgacaggttcaagctgatgctggctaagatcaagaaagctggtgttgttaggcaagagcttgctaagcttaagaaagacactgctgcttaagttagtatagttttggatatttggattttttgcttagattttgaaacttgtaaacccttttatcatgcttttttctgaattcattacagaagaaaaagttcttgaattttgcgtattatcatttgaacctgtttggaatttaatttactagtcttgttgggatcagagatggttctaagctaagtttgttagtttttctttttacccacct

SEQ ID NO: 579 - DNA, 614 bp, Triphysaria pusilla
acactttattatatccttcttttcactcatctccgcctcttcctcacacagcacctgctcacacacgcatctccaaaaatgccgttcaagaggtatgttgagatcggaagggtggcccttgttaactacggagaggactatggcaagcttgtagtcattgtcgatgttatcgatcagaacagggctcttgtcgattcacctgacatggtaaggagccaaatgaacttcaagaggctttctcttacggacatcaagatcgacataaagagggtccctaagaagaagactcttattgctgctatggaggctgctgatgtcaagggaaaatgggaaaagagttcgtggggcaggaagcttattgttcagaagcgaagggcagctctcaatgattttgacaggttcaagctgatgttggctaagatcaagaaagctggtgttgttaggcaagagcttgctaagcttaagaaagagactgctgcttaagttagtatagttttggatattgggattttttggttagatttttaaacttgtaaccctttattatgcttttttccgaattcataacagaaggaaaagttcttgaattttgcttattatcatttgaacctgtt

SEQ ID NO: 580 - DNA, 492 bp, Jatropha curcas
attcctttctttccttcatctttctgcttccgcagctcacaagctcacacaacgtcactagttcaagatgccattcaagagatacgtcgagatcgggcgggtagcactcgtcaactatggaaaagactacggaaggcttgtcgtcatcgtcgatgttatcgaccagaaccgagccctagttgatgccccagatatggtgaggagccaaatgaacttcaagaggctttctctcactgatatcaagattgacatcaacagagttcccaagaagaagaatttgattgaggctatggagaaggctgatgttaagaacaagtgggagaatagctcttggggcagaaagctgattgtccaaaagagaagggcatctctcaatgacttcgataggttcaagttgatgttggctaagatcaagaggggtggattgatcaggcaagagcttgcttagctgaagaaagagaatgcggcataaaagtattagttttgagttgt

SEQ ID NO: 581 - DNA, 876 bp, Malus domestica
atgggagcgaagaaagcgcaggaatattataggaaaggaagaaagtctggcatccatttttgcttcaacgaggatgaggatgaggacgatgacgaggaagagcaggataagggcacgaaaaagctctccactcttgcctctcactcatcttctccgactcctctgccggattttgtcagatcctctggaaaaatgccgttcaagagatacgtggagatcggacgagttgctctcgtcaactacggcaaagactacggcaggctcgtcgtcatcgtcgatgtcatcgaccaaaacagggctctggttgatgcacctgacatggtgaggacacaattgaacttcaaaaggctttcactgaccgatatcaaaatcgacatcaaaagggttccgaacaagaagactctgattgctgcaatggaggctgctgacgtaaagaacaaatgggagaagagctcatggggcaggaagctggttgtgcagaagagaagagctgcacttaacgatttcgataggtttaagctcatgttggcaaagatcaagagggccggaatcatcaggcaggagctgacgaagctcaaaaaggagagtgcattctgaacgcagtcctgttaacatatttcggcgagtttatgttttgattcgtagaggcgacggtagcttggtgttttggttagtcacagtcacgagtggaaaccacccgcaaaacattatctttgtaaaccttgtggggatttttgttgaaatgaaacaccttgtggggatttttgatatgttaaatcatagttttgattttgcaaggcttgcttgatctgtgaaattgccgctgatctgaatgtgcaatttccaaatcagtggattctacttcgtcgatggatt

SEQ ID NO: 582 - DNA, 697 bp, Glycyrrhiza uralensis
gagttcctgcctctcaccttttcattctttgtgctacagcagcagtcactgaatctccatacccgaaaatgcctttcaagaggtacgttgagattggtagggttgctcttgtcaactatggcaaagagtatggtaggctcgtcgtcatcgttgatgtcatcgaccagaacagagctcttgttgatgcacctgatatggtgaggtcccagatgaatttcaagaggctctcactcactgacattaaggttgacattaagaggatccccaagaagaaggatctcatcaatgccatggaggctgctgatgttaagaacaagtgggagaagagctcatggggaagaaaactgattgttcagaagagaagggcagccctcaacgactttgataggttcaagataatgttggcaaagatcaagagggcagctgttgttaggcaagagcttgctaagctgaagaagaccgcatcttagagacatgatttaatctgcaattttcaagttttgttatgaatttccttcaattagtacaccttggtggttatatgagtttttatgtatcattgagtggtgacttcctagaaatgtttattttgaggactcatgttagtggattgatgtcatttcttccgtttagattatttttggtgccaatttttgcttttgcttgctgatgtttgaacattgtttttaagaaaagg

SEQ ID NO: 583 - DNA, 926 bp, Mimulus guttatus
aaccttcatcgttttcactctccatttttctcagtctccaaatcagcctctcatcgcgcacgcagacgcaagaatcatctgaagatgccgttcaagaggtacgtggagatcgggagggtggccctcgtcaactacggaaaggactatggcaggcttgtcgtcattgttgacgtcattgaccagaaccgggctctagtggattctcccgacatggtaaggggtcagatgaatttcaagagactctctcttacggatatcaagattgatatcaaaagggttccaaacaagaagactcttatagctgccatggaagctgctgatgttaagggcaaatgggagaagagctcatggggaaggaagctgattgttcagaagagaagggctgccctcaacgattttgaccgattcaagctcatgctagcaaagatcaagaaagctggtgtcgtccgacaggagcttgcaaaacttaagaaagagattgcagtctgagaaagtacaattttttaagaatttggagtacggatttcaaactatttattacgcgcatatttacttgtcctcgggatattcacaaaaggaaagatactcgaattttgcctctgttgtgtttgccttcgtttggaaatcgttgtctcagaccttattcttcttttggtagttggattggcccctggcattttccctttctgcagtaattagtttctgattttcttataatgctgtttctatgctttgaatttagtgacgagtgttgtttgcttttcatgtggtcatgtgtttgagccacattgttggtgcaaacatgtttttgtgccagagagttgcaaattggttagatttttatatattataatgcatatttctgaaaataaacacactaatattattgagttattttgactaattttggatcttcctagtgcttg

SEQ ID NO: 584 - DNA, 464 bp, Salvia sclarea
ctctgctctaacatcacagcacacacattcacttctctgcagcagaaaatgccgttcaagaggtacgtcgagatcgggagggtggccctcgtcaactacggaaaagactacggaaagcttgtcgtcatcgtcgatgttatcgaccagaacagggctcttgttgactcacctgacatggtaagaagccagatgaatttcaagaggctttctcttacagacatcaaaattgacatcaagagggtgccgaagaagaagactcttgttgctgctatggaggctgctgatgttaagggaaaatgggaaagcagctcttggggcagaaagttgattgttcagaagagaagggctgcgctcaacgattttgaccggtttaagcttatgttggccaagatcaagaaagcgggagttgttcgacaagagctggctaagcttaagaaagagactgctgcatgagtagtatagat

SEQ ID NO: 585 - DNA, 643 bp, Ipomoea batatas
ctcagctcaacctgcatcgccccgttctgctcattcggtttcccaaaaatgccgttcaagaggtacgtggagatcgggagggttgcccttgtcaactacggaaaggactatggaaagcttgtcgtcatcgtcgatgttattgatcagaacagagcacttgttgatgctccagacatggttaggagccagatgaacttcaagaggcttacactcacagacatcacaattgacattaaaagagtgccaaaaaagaagactttggtagctgctatggaggctgctgatgtgaagaacaagtgggagaacagctcatgggggaggaagttgatcgtgcaaaagaggagggcttgcctcaatgactttgacaggtttaagattatgctggcaaaaatcaagagagctggagttgtgagacaggagcttgccaagcttaagaaggagagcactgcctgataacccagacttttgatatagagagatcttagctacactaagctttgagtttgtgttgtttatttggaaatttcaatttttgtccttaaagcaaagacgtgtgcttttttgtctttttcaattacctgaatagcagtttgagattttaacaccctgatatctttattatggttaatttgccctcgtgccg

SEQ ID NO: 586 - DNA, 611 bp, Ipomoea nil
aacattggactactgccctccggcctaagctcacgttcccctgctctttcagaccgccgaaaatgccgttcaagaggtacgtggagatcggcagggtcgcgctcgttaactatggcaaggactacggcaagttagtcgtcatcgtcgatgtcatcgatcagaacagggctcttgttgatgctcctgacatggtgaggagccaaatgaacttcaagagacttacactcactgacataaccattgacatcaaaagggttcccaagaagaagactttgattgcagcaatggaagcagctgatgtaaagaataaatgggagaacagttcctggggaaggaagttgatagtgcagaagaggagagcctctctgaatgattttgacaggtttaagattatgttggcaaaaatcaagaaggctggcattgtaaggcaggagctttcaaagcttaagaaggagagcacagcctgagagaacaatagtgtactcagatactgtgattttattataaactagtttttggtgttgtattttttagctttcaaggattattttttcttctggttttgttgcagctagagaacatacatactattatcatgtctcaagtgtttt

SEQ ID NO: 587 - DNA, 618 bp, Ambrosia trifida
actaccgccccaacctttgttctaggcgctgcacatccaacactccaacaatgccgttcaagaggtacgtcgagatcgggagaatcgctcttgtcaattacggcaaagattatggaaagctggttgtcatcgttgacgtcattgatcaaaatagggctcttgttgatgcgccggacatggtgaggggccaaatgaatttcaaaaggctaacgctcactgatatcaagattgacatcaaaagagtcccaaataagaaaacgttgatcgctgcaatggaggctgctgatgtcaagaacaagtgggagaacagttcttggggaagaaagttaatcgtgcagaagaagagagcatcacttaatgattttgacaggttcaaaatcatgttggctaagatcaagaaggctggagttgtaaggcaagagcttgcaaagcttaagaaggaagccacagcctaataatggcaatttgtttttgttattaaagatttttgtcaactgttgaggaagcccttctttgtgttttacctgtttttcttctctcttaatgtaccaaaggaaacctaatgacaagttttaaacttatgttttggttacatttgttatgaaaatggttttagtt

SEQ ID NO: 588 - DNA, 778 bp, Citrus clementina
aatttgacctgggaaaccctaaatcgaagcctcttgcctcattcattcatctcctcgctcctccggcagagccttgaatatcttcgaaaatgccgttcaagaggtacgtggagataggaagagttgctctcgttaattacggcaaggactatgggaagcttgtggtcatcgtcgatgtccttgatcaaaacagggctcttgttgatgcccctgatatggtgaggagccaaatgaacttcaagaggctttctctcacggatattaagattgacatcaatcgagttcccaggaagaagtctttgattgaagccatggagaaggctgatgtgaataacaaatgggaaaacagctcctggggcaggaagctgattgtccagaaaaggagagcggcactgaatgattttgataggttcaagctcatgttggcaaagatcaagaagggtggacttgttcgacaggagcttgcaaaactcaagaaggagaatgcagcatagaatttctctcttgtgttcccctttctggtttttagttcttacagcttcaatttgattctattaatgtattgattaatatgagaaaacatcagcttggcgtttttgggttaattgttatttggacagaatttttagatattttcgtaatgtcctttctgttataatctgatctcaagctttgttgttcggtaacctttaatatctgtgaatcttgtatatcgagctttgccaaaagatacactcttcactcctgtatcaaccaactcgatgattattattggctc

SEQ ID NO: 589 - DNA, 1120 bp, Cyamopsis tetragonoloba
cacgagggtttccgagatcgccaatttcgcggtgaccgagtacaacaagcaatctggggccaagctgaagctagtgaaggtcgttaagggcgagactcaggtggtggccggcactaactaccgcctcgttctggcagccaaggatggatccgccactaacaattacgaagccctcgtttgggagaaaccctggcagcatttcagaaacctcacttccttcaaaccccttcattgattaatacattacccccttttctcttatactttataaaccctattaatcaattggtattatgtattgttattttctctctctctgtttgctttgtgtatcgagttgagacatgcctatagagctagaattatgaattatggagtaataataaatcgatgtatttctaaaaaatcgttcagagcttcagagtgagagagactccatagccgaaaatgcctttcaagaggtacgttgagattggtagggttgctcagatcaactatggcaaagagtatgggaggctcgtcgtcattgttgacgtcatcgaccagaacagagcccttgttgatgcacctgatatggttagatcgcaagtgaatttcaagaggctctccctcactgaccttaaggttgacattaagagggtccctaaaaagaaggatcttattaaagccatggaggctgcagatgtgaagaacaagtgggagaacagctcgtggggcaggaagcttattgtgcagaagagaagggcatcgcttaatgattttgataggttcaagataatgttggcaaagatcaagagggcagccgttgttaggcaagagcttgccaagcttaagaagagcgcatcttaaggagacttcaatctgcaattttcaatttttgttatgaatttccttcaattaatacactttggtttttgtgagtttttagaaaggtttattttgagatctttcatgttagtggattgatattgatatcacttcctatctcgcccatttttactattgcgaacttgaaatctagaatattgtttttctttttttttagcatgaattattttgcattcatggcaaccaagaaatccacatctctacaccctctcatttatcccagagcaaaatt

SEQ ID NO: 590 - DNA, 718 bp, Euonymus alatus
gaggcacgatggtacaaaaccctaatttcttctcaccatttcttctcaacaaattctccgcctctgtctcgtctggcacccttcttcgcgcctcacaagatccaaaatgccattcaagaggttcgtggagatcgggcggttggcactcgtcaactacgggaaagactacggcaggctcgttgtcatcgtcgatgtcctcgatcagaacagagcccttgttgatgctccagatatggttagaacccaaatgaatttcaagaggttgtctctaactgacatcacgatcgagattaaccgggtgcccaagaagaagaatctgattgaagctatggagaaggctgatgtgaagaacaagtgggagaacagctcttggggtaggaagctgattgttcagaagagaagggcatctcttaacgacttcgatagatttaaaattatgttggccaagatcaagaggtctggattggtgaagcaagaacttgcaaaactgaagaaggaaaatgcatcctaggcaattatttataagaacttctcggttttgtttgcagtgtttgagatgatgtttttttttctcttactcatttttcttgtttaatttagagaccgtcagtctgagaatttagcaaaaatgagatttggtaacctgtttagtgttgatctattctgtcatgtagttcctgcacgtcaatcttatttggtggtgatggcattttagctt

SEQ ID NO: 591 - DNA, 593 bp, Flaveria ramosissima
tcgtcttcaatccccacagcctcaagccccatcggcgctctgcacctgttcgcctgaaacaatgccgttcaagaggtacgttgagatcggaagagttgccctcgttaactacggaaaagattacggaaagcttgtagtcatcgtcgatgtcatcgatcaaaacagggctcttgttgatgctcctgatatggtgagaggccagatgaactttaagaggctaacacttacagacatcaaaattgacatcaaaagagttccaaacaagaaaactcttattgctgctatggaggctgctgatgttaaaaacaaatgggaaaacagctcatggggaagaaaactcattgttcaaaagaagagagcatctcttaacgatttcgacaggtttaagattatgttggcaaagattaagaaggcgggtgttgttaggcaagagctggcgaagctaaagaaggagactgcttaatctgtatcaatgttaagattttgttgcattttatttgaattactgttgagtagaccattgttggtttttagtagtttatgtttgacctttcaaaagttcttaaaagggatgtttgaatttggttttattc

SEQ ID NO: 592 - DNA, 577 bp, Flaveria ramosissima
tcgtcttcaatcccctcagcctcaagccccatcggcgctctgcaatcgttcgcctgaaaaatgccgttcaagaggtacgttgagatcggaagagttgctctcgttaactacggaaaggattatggaaagcttgttgtgatcgtcgatgtcatcgatcaaaacagggctcttgttgatgctcctgacatggtgagaggccaaatgaactttaagaggctaacactcacggacatcaaaatcgacatcaaaagagttccaaacaagaaaactcttattgctgcaatggaggctgctgatgtcaagaacaagtgggaaaacagctcatggggaagaaaactcattgttcaaaagaagagagcctcacttaacgattttgataggttcaaaattatgttggcaaagataaagaaagcgggagttgttaggcaagagctagccaagctaaagaaggataccgcgtgatttgcactgactgtcaagatttatcagaattttgttgcagtttattacaattgttgttgagtagacagaccggtgtaggatttcatgtttgacctttttccatgtttgctggtat

SEQ ID NO: 593 - DNA, 588 bp, Flaveria ramosissima
tcgtcttcaatccccacagcctcaagccccatcggcgctctgcaactgttcgcctgaaaaaatgccgttcaagaggtacgttgagatcggaagagtcgccctcgttaactacggaaaagattacggaaagctcgtagtgatcgttgatgtcatcgatcaaaacagggctcttgttgatgctcctgatatggtgagaggccagatgaactttaagaggctaacacttacagacatcaaaattgacatcaaaagagttccaaacaagaaaactcttattgctgctatggaggctgctgatgtcaaaaacaaatgggaaaacagctcatggggaagaaaacttattgttcaaaagaagagagcatcacttaacgattttgacaggtttaagattatgttggcaaagattaagaaggcgggtgttgttaggcaagagctggcgaagctaaagaaggagactgcttaatttgtatgattgtcaagattttgttgcattttatttgaattactgttgagtagaccattggtttttatagtttatgtgtgacctttcagaagtttttaaaagggctgttagaacttgttttattc

SEQ ID NO: 594 - DNA, 576 bp, Flaveria ramosissima
ggatcgtcttcaatccccacagcctcaagccccatcggcgctctgcaaccgttcgcctgaaaaaatgccgttcaagaggtacgttgagatcggaagagttgccctcgttaactacggaaaagattacggaaagcttgtagtaatcgtcgatgtcatcgatcaaaacagggctcttgttgatgctcctgatatggtgagaggccagatgaactttaagaggctaacacttacagacatcaaaattgacatcaaaagagttccaaacaagaaaactcttatcgctgctatggaggctgctgatgttaaaaacaaatgggaaaacagctcatggggaagaaaacttattgttcagaagaagagagcgtcacttaacgatttcgacaggtttaagattatgttggcaaagattaagaaggcgggtgttgttaggcaagagctggcgaagctaaagaaggagactgcttaatttgtatgattgtcaagattttgttgcattttatttgaattactgttgagcagaccattgttgggttttagtagtttatgtgtgacctttcagaagtttttaaaagggtt

SEQ ID NO: 595 - DNA, 648 bp, Flaveria ramosissima
ctcaactctcccggcgatctgcaaccgcaaaaatgccgttcaagaggtacgttgagatcggaagagttgccctcgttaactacggcaaggattacggaaagctcgtcgtgatcgtcgatgtcatcgatcaaaacagggctctcgttgatgctcctgacatggtgagaggccaaatgaactttaagaggctgacactaacagacatcaaaattgacattaaaagagttcccaacaagaaaacccttattgctgcaatggaggctgctgatgttaagaacaagtgggaaaacagctcatggggaagaaagctcattgttcaaaagaagagagcctcacttaatgattttgataggttcaagattatgttggcaaagataaagaaggcgggagttgttaggcaagagctagccaagctaaagaaggagaccgcatgatttgcatcgactgtcaagatttatcagaatttggtgcagttcattacaattgttgttgagtagacagaccgttgtaggatttcgtttctgacttttttccatgtttgctggtattgtttttggttttacttgtttctttatgtcatatgcattttgttcaagtttttttgatataaaaacatttagatctaatgcataatattatgttggttag

SEQ ID NO: 596 - DNA, 664 bp, Triphysaria pusilla
tcagacgcatttgcagatcgccgccgaacaatgccgttcaagagatacgtggagattgggagggttgccctcgtcaattacggagaggactatggcaagctcgtcgtcatcgttgacgtcatcgaccagaacagggctctcgtggattctcctgacatggtacgaagccagatgaacttcaagagactttctcttacagatattaagattgatatcaagagagtcccgaagaagaagactcttatcgctgccatggaggctgctgatgttaagggcaaatgggaaaagagctcatgggggaggaagcttattgttcagaagagaagagctgctctcaatgactttgaccggttcaagctgatgcttgcaaaaatcaagaaagctggtgttgttcgacaagagcttgccaaacttaagaaagagactgcagcctgatcgagtagaacatgtgttttggtttaaagttgtatcagtttattatccatgcagatgtttttactcatctttgaattttcttgttcctgaattcattatgaatggataatcttcaattttgtctaattattgttcggattgtgtatgagaccataattctctaattgtttttttactttggatagttgtattttatgtgatgatttttataatcatatctgaagtttaa

SEQ ID NO: 597 - DNA, 652 bp, Triphysaria pusilla
cacacagcctctcctcacgtagtcagacgtatttgcagatcgccgccgaacaatgccgttcaagaggtacgtcgagatcgggagggttgccctcgtcaattacggagaggactatggcaagctcgtcgtcatcgttgacgtcatcgaccagaacagggctcttgtggattcccctgacatggtgcgaagccagatgaacttcaagagactttctcttacagatattaagattgatatcaagagagtcccgaagaagaagactcttattgctgccatggaggctgccgatgttaagggcaaatgggaaaagagctcatggggaaggaaactaattgttcagaagaggagagctgcactgaatgattttgaccggttcaagctgatgcttgctaaaatcaagaaggctggtgttgtccgacaggagcttgccaaactcaagaaagagactgctgcctaaacattataatctctgttttgtcgtgttctttttttgaagttgtgtcggtttattatccttgcagatttttttacttgtttttgagtttttctgttcttgaactcattatgaaaagaaaaatatttcaattttgtctaattattgtctggattgtattttgagaccataactctccaatgtcttttactcttggtt

SEQ ID NO: 598 - DNA, 627 bp, Elaeis guineensis
agcccagctcttctctctgtcgccctctcgccgccgatcttggacaatgccgttcaagcgatacgtggagatcgggagggtcgccctcgtgaactatgggaaggattacgggacgctcgtcgtcatcgtcgacgttgtcgaccagaaccgagctctggtcgatgcccctgacatggtgcgaggacaaatgaattttaagaggctttccttgactgatattaagattgacattccgagacttcctaagaagaagtctctaattgcagccatggaagctgcggatgtgaagaacaaatgggagaatagttcatggggaaggaaattgatcgttcagaagagaagagctgccttgaatgattttgacaggttcaaggtcatgttggcaaggatcaagagaggtggtgctatccagcaggagctcgcaaaactgaagaagcaggatgcatcccgaggtctgatgtcatagtttgctgatttttccacatgtagcttgtgatgcttcactattcgatcttacttttagttattgttcaaaagccagtacttgggggatcttttaaaagagttcctatcggagattttgtctagatattttcatttctaaggttttttttttttttttgtttt

SEQ ID NO: 599 - DNA, 1429 bp, Beta vulgaris
cctctttttattgagttaggggcaaagtttcaccccttattctcgtgggatgaaaatggacaaatcccacacatatattaggagaagagaccccggggcccaaaaattccccggcgttgcggggaaataaaaaagcgcgtcgtctggatagccctccatagaagtattttaaaaaaatttattttttagaaaaaatattaagaggtttccagaaaagagaaaaaagctttttttttttcttttttaaaaaaaactttttttttttaaacatctttactgtgttcagaaatttcttttgggaaaaccgaagggcaaagttttcccttaattcaaaaaaaggaggcatttggacccccatcaaaaatttggtggaactgtaaaagttttgaaatttggtttcaacaaggcttgaagctataaaaaaaatgattgattttttccaagaagcaggattgccttagcaggaatatttcaccgattgattgaaagctttgagacccccaattttctggtttgaaacccactatcttaacggaaagggaaaattcagggccctagtttttgatattatcttagcatgtgagtatgttcatgaaaagcattttcgaaaaaaaaaaaaaaaaaaaaactcgagtttttttttttttttcttttttacttgcctcctctcctcgtctcttcttcatcctctcgctactcatcttcagagaaaaccctaattttccaaaatgcctttcaagaggtacgttgagatcggaagagtaggtctagtcaactatggcaaagaatacggccgtctcgtcgttatcgtcgatgttcttgaccagaacagagttctagtcgatgctcctgatatgattaggggtcaaatgaacttgaagaggctttctttaactgatatcaagattgatatcgagaaggtaccaaagaagaaaaccttgattgacgcaatggaggctgctgatgttaagaacaagtgggagaagagttcatggggtaggaaattgatcgtccagaagcgaagagctgctctcaacgattttgacaggttcaagatcatgttggccaagatcaagaaagctggtgctgtgaggcaggagcttgccaagttgaagaaacaagctgcataagtgttaggattcaggattcgattgtctttgttttatgttttttggatatttaatatcagaaaaattttgagtgagacatttattttgtgaagttcttatttagcaaggggaatctatttctaccaatcttggttgtgtaaccaatacttcgtgtctgagtaatgaatctagatgatatctacaggttaaaggctttgcaacttgttctccgtttattttgttgtatgccccttgtgtttcattttacgtttcaacaatgttccatggttgggagtgactaaagaattttcaaccgttgc

SEQ ID NO: 600 - DNA, 734 bp, Gossypium hirsutum
agttcgcagttcgcacctccttttttatttccttttcgcctctctagtttcctacactctcacatactcacagcaaaaaatgccgttcaagaggtatgttgagatcgggagggtggctctcgttaactacggcaaagactacggcaagttggttgtcatcgttgatgttgttgaccagaacagagctcttgttgacgccccagatatggtcagaggccaaatgaacttcaagaggcttactttgacagatatcacaattgacattccccgagttccaaagaagaaaacattgattgaagccatggagaaggctgatgttaagaacaagtgggagaatagctcatggggtagaaagctgattgtccagaagagaagggcagctctcactgacttcgataggttcaagcttatgttagctaagatcaagaaggctggagtcgtcaggcaagagcttgcaaagcttaaaaaggagaatgcatcttgaagtaattctgaattaagggattttttgctagttttttcatcaatgttccgcgagttctttttgggattgattttcgtttttctattaaacagaggattaagatcttttgaggacaccttatttgctgtatgacagattttgtagtgagtttattgctatatattgcttgcttaatttggttgcatgttgcagtattcttttcctttcaaacttctgttgtttatgtcttggctgttcatttgatggtagt

SEQ ID NO: 601 - DNA, 621 bp, Eschscholzia californica
acatttctcaacaatgcctttcaagcgttatgtggaaatagggcgagtagctctggtgaattatgggaaagattatggaaaacttgtagtgattgtcgatgtcgtcgatcaaaacagggctcttgttgatgcacctgacatggttagaagccaaatgaacttcaagagactcacgttgactgatatcaaaattgacatcggcagagtcccaaaaaagaaggctttagttgaggccttggaggcaggagatgttaagaacaaatgggagaacagctcttggggtaggaaactgattgttcagaaaaggagggctgctctaagtgacttcgacagattcaagcttatgctggcaaagatcaagagaggtggagcgatccgacaagagctctcaaagcttaagaagcagaacgcataagatttcgactcatcactgatttttggaacatagatttatctactacttgtttttggattagttttgtaccaatactgttgggtaaaaacttaagtatattggctcatcgtttatgcaatccgaacagagtattagtttctaactgagttctagtttttgttaagatctttgatacgcatatctcatttgcaacataaatctggtgc

SEQ ID NO: 602 - DNA, 841 bp, Gossypium raimondii
gttataaacaccctataaaatccactataaactaaaatccgtagttcgcagttcgcacctccttttttatttccttctcgcctctgtagtttcctacactctcacacactcacagcaaaaaatgccgttcaagaggtatgttgagatcgggagggtggctctcgttaactacggcaaagactacggcaagttggttgtcatcgttgatgttgttgaccagaacagagctcttgttgacgccccagatatggtcagaggccaaatgaacttcaagaggcttactttgacagatatcacaattgacattccccgagttccaaagaagaaaacattgattgaagccatggagaaggctgatgttaagaacaagtgggagaatagctcatggggtagaaagctgattgtccagaagagaagggcagctctcactgacttcgataggttcaagcttatgttagctaagatcaagaaggctggagtcgtcaggcaagagcttgcaaagcttaaaaaggagaatgcatcttgaagtaattctgaattatgggattttttgctagttttttcatcaatgttccgcgagttctttttgggattgatttcgtttttctattaaacagaggattaagatcttttgaggacaccttatttgctgtatgacagattttgtagtgagtttattgctatatattgcttgctcaatgtggttgcttgttgcagtattcttttcctttcaaatttctggtgtttatgtcttggctgttcatttgatggcagcaaaatctttaagaatttgggcttgatattgcctgatatattgattaataatacagtattttttaaa

SEQ ID NO: 603 - DNA, 745 bp, Papaver somniferum
ctagtaatatcatagtagagagagactaaaaagagactgtgtatccccttctcgtttctcctcctccacggcgcttctctgatttctcccagttcctcgattcaatctcacaatgcctttcaaacgatacgttgagatcgggcgtgttgctctagttaactacggagaagactatggaaagcttgttgtcatcgttgatgttattgatcaaaacagagctttggttgatgcacctgatatggttaggtcacaaatgaatttcaagagattgtctttgactgatattaaaatcgatatcggccgtgtacctaacaagaaggctctccttgctgccatggaagctgcagatgtgaagaagaagtgggagagtagttcatggggtaggaagcttatcgtgcagaagaagagagcttcccttaacgatttcgagaggtttaaggtcatgcttgccaaaatcaagaggggtggtttgatcagacaagagctatccaagttgaagaagtctgcagcttaagacaagtattaactgcgtttttcaaagctttttatggtattttatagttttgattgtcaattttgtagagacttggtttcttacaaggatggatggatgttttgtcattattttagtagtagcatattttggaacttcctagcctttttattcttgtctaattaaaggccagtctacatgacaagatgcttgaatttataagatgtctttggttttgttagtgtgttagaa

SEQ ID NO: 604 - DNA, 897 bp, Papaver somniferum
ctctcgtttctcctcctccacggcgcttctctgatttctctcagttcctcgattcaatctcacaatgcctttcaaacgatacgttgagatcgggcgtgttgctctagttaactacggagaagactatggaaagcttgttgtcatcgttgatgttattgatcaaaacagagctttggttgatgcacctgatatggttaggtcacaaatgaatttcaagagattgtctttgactgatattaaaatcgatatcggccgtgtacctaacaagaaggcactccttgctgccatggaagctgcagatgtgaagaagaagtgggagagtagttcatggggtaggaagcttatcgtgcagaagaagagagcttcccttaacgacttcgagaggtttaaggtcatgcttgccaaaatcaagaggggtggtttgatcagacaagagctatccaagttgaagaaatctgcagcttaagacagggattatatttctgcgtttttcagagctttatggtattttatagttttgattgtcaattttgtagagacttggtttcttacatggatggatggatggatgttttgtcatgaatttagtagtagcatattttggaacttcgtagcctttttattcatgtctaattaaaagccagtctacatgacaagatgcttgaatttataagatgactttggttttgttagtgtgatggaatcatattagcgcatctacattaagctgtctaatgcttggccatataattgcagtccctggttcatatcccataatggggctagtagtgttcctcgaaaaatcagtctaatctctgatgacaagactgctcttccaagtttggtcataaatgtcgtactagccttttatttattctaattgaaggccattctata

SEQ ID NO: 605 - DNA, 709 bp, Papaver somniferum
ctgcgtatccccttctctcgtttctcctcctcctccacggcgcatctctgatttctctcagttcctcgattcagcctagcaatgcctttcaaacgttatgttgagatcgggcgtgttgctctagttaactatggagaagactatggaaagcttgttgtcatcgttgatgttattgatcaaaacagagctttggttgatgcacctgatatggttaggtcacaaatgaatttcaagagattgtctttgactgatattaaaatcgatatcggccgtgtacctaacaagaaggctctcctcgctgccatggaagctgcagatgtgaagaagaagtgggagagtagttcatggggtaggaagcttatcgtgcagaagaagagagcttcccttaacgatttcgagaggtttaaggtcatgcttgccaaaatcaagaggggtggtttgatcagacaagagctatccaagttgaagaagtctgcagcttaagccgaggattaagttactgcgtttttcaaagctttttatggtattttatagttttgattgtcaattttgtagagacttggtttcttacatggatggatggatggatgttttgtcatgaatttagtagtagcgtatatcggaacttcctagcctttttattattgtctaattaaaggcgtctacatgacaagatgcttagtaatttataagatgtctttggtaaact

SEQ ID NO: 606 - DNA, 656 bp, Papaver somniferum
cagttcctcgattcagcctcacaatgcctttcaaacgatacgttgagatcgggcgtgttgctctagttaactatggagaagactatggaaagcttgttgtcatcgttgatgttattgatcaaaacagagctttggttgatgcacctgatatggttaggtcacaaatgaatttcaagagattgtctttgactgatattaaaatcgatatcggccgtgtacctaacaagaaggctctccttgctgccatggaagctgcagatgtgaagaagaagtgggagagtagttcatggggtaggaaacttatcgtgcagaagaagagagcttcccttaacgatttcgagaggtttaaggtcatgcttgccaaaatcaagaggggtggtttgatcagacaagagctatccaagttgaagaagtctgcagcttaagacgaggattaagttactgcatttttcaaagcctttttatggtattttttagttttgattgtcaattttgtagagacttggatggatggatgttttgtcatgaatttagtagtagcgtatgttggaacttcctagcctttttattcttgtctaattaaaggccagtctacatgacaagatgcttgaatttataaggtgtctttggtttcattagtgtgttagaattatatt

SEQ ID NO: 607 - DNA, 636 bp, Antirrhinum majus
cagagatcgacgaaaatgccgttcaagcggtacgttgagatcggaagagttggcctagtcaactatggaaaggattatggcaagcttgtcgtcatcgttgacgtcatcgaccagaacagggctcttgtggattctcctgatatggtgcgaagccagatgaacttcaagaggctctctcttacagacatcaagattgacatcaaaagggttcctaagaagaagactctcgttgctgcaatggaggctgctgacgttaagggcaaatgggagaaaagctcatggggaaggaagcttattgttcagaagaggagggctgctctaaatgattttgacaggttcaagcttatgctggccaaaatcaagaaagctggtgttgttcgacaagagcttgctaagcttaagaaacagaccgcagcttgagatttattagtgaatttctgtttattaaagattttggcttagggttttggaagctgtattggtttattatgcagatttttgaatcatttcaacagactttgaattttatgtattatgatttcaatttggtgctctccatatctttgagcctttttggtttagatcggtttgtggtatcatttttatctcaatatgaaattgtggtagtactgttga

SEQ ID NO: 608 - DNA, 790 bp, Malus domestica
taagcaaaaccctaatcccaccgcgaccattttctcttctcttcaaagctccgcctcctcggacctctctcacacatcacacgcttcaccagaaccaaaaatgcctttcaagaggtacgtcgagatcggaagggtggctctcgtcaactacggagaggactacgggaagctcgtcgtcatcgtcgacgtccttgaccagaacagggctcttgtcgatgctcctgatatggtgaggtcccaaatgaacttcaagaggctttctctcaccgacatcaagattgatatcaagagggtccccaagaagaaggaattgcttgccgcaatggaagctgctgatgtgaagaagaagtgggagaacagctcatggggtaggaaactgattgttcagaagagaagagcagctctcaacgactttgaccgattcaagctcatgttggctaagattaagagggctggactggtaaggagcgagcttgcaaaattgaaaaagtccacagcttaagcaatttcagtcgtgaggtttacaattttgttatggaatcttttcagtgtactctggattgtaatcccgttgtttatcttggatcgaatttagtttttaagagcaatttttgtttctaatattgttgacaaatggagaacttatattggatgaattttctgtcattctgctttgtcttgtcattgtgatgtggaatcgatgttttagctatcttttggagcgtggtctttgcacccttattattgttcattgtctgaaatatgttttgagaccaatagcagttagcca

SEQ ID NO: 609 - DNA, 1458 bp, Beta vulgaris
  misc_feature (1)..(3): n is a, c, g, or t
  misc_feature (30)..(30): n is a, c, g, or t
  misc_feature (696)..(696): n is a, c, g, or t
  misc_feature (801)..(801): n is a, c, g, or t
  misc_feature (1369)..(1370): n is a, c, g, or t
  misc_feature (1382)..(1382): n is a, c, g, or t
  misc_feature (1385)..(1385): n is a, c, g, or t
  misc_feature (1389)..(1389): n is a, c, g, or t
  misc_feature (1391)..(1391): n is a, c, g, or t
  misc_feature (1393)..(1393): n is a, c, g, or t
  misc_feature (1396)..(1396): n is a, c, g, or t
  misc_feature (1402)..(1403): n is a, c, g, or t
  misc_feature (1409)..(1410): n is a, c, g, or t
  misc_feature (1420)..(1420): n is a, c, g, or t
  misc_feature (1422)..(1422): n is a, c, g, or t
  misc_feature (1428)..(1428): n is a, c, g, or t
  misc_feature (1448)..(1448): n is a, c, g, or t
nnngggggtagttttttaggggaggtttgnacacgggggatttgggggattttgggaccatggccctctttttaggggggatgtgggggaaaaaagagggggggggggggccccgggggacccagagataggggtagaaaccctcggggagggttttctaggggggaagggcgcggggttcggggaacctttttatccgggggtcccctttaggggaattttggtcctgggggggggcgggaaaacccaccgggcctttggtgcggccttggggcttggcacattttttggggtttcccggtttggggaacggattccccttgggggggaaaccttcccccccgaaccccggggcggggttttgggggggaggggagagggcccattgggaccgccttttccgggggggggggttcattaagaggggccgaacgttttccggttggaaggggggcgggagccaagccaattaagggggttggcccctcttggggccccccgggtttccattttagcttccggctgggatggggggggaatgggggggggatacaatttcccccgggaaacggttatggcccggattggccaagtctggaatttaccccccctaaaggggaacaaaaggggggcttccccggggggggcgggcggttctagaattgggggtccccccgggcggcggaatttgggcangaggttggttctcttcttcatcctctcgctactcatcttcagagaaaaccctaattttccaaaatgcctttcaagaggtacgttgagatcggaagagtaggtctngtcaactatggcaaagaatacggccgtctcgtcgttatcgtcgatgttcttgaccagaacagagttctagtcgatgctcctgatatgattaggggtcaaatgaacttgaagaggctttctttaactgatatcaagattgatatcgagaaggtaccaaagaagaaaaccttgattgacgcaatggaggctgctgatgttaagaacaagtgggagaagagttcatggggtaggaaattgatcgtccagaagcgaagagctgctctcaacgattttgacaggttcaagatcatgttggccaagatcaagaaagctggtgctgtgaggcaggagcttgccaagttgaagaaacaagctgcataagtgttaggattcaggattcgattgtctttgttttatgttttttggatatttaatatcagaaaaattttgagtgagacatttattttgtgaagttcttatttagcaaggggaatctatttctaccaatcttggttgtgtaaccaatacttcgtgtctgagtaatgaatctagatgatatctacaggttaaaggctttgcaacttgttcnncgtttattttgntgnatgncncntgngtttcnntttacnnttcaacatgntncatggntgggagtgactaaagatttncaaccgttgc

SEQ ID NO: 610 - DNA, 773 bp, Gossypium hirsutum
agttcgcacctccttttttatttccttctcgcctctgtagtttcctacactctcacacactcacagcaaaaaatgccgttcaagaggtatgttgagatcgggagggtggctctcgttaactacggcaaagactacggcaagttggttgtcatcgttgatgttgttgaccagaacagagctcttgttgacgccccagatatggtcagaggccaaatgaacttcaagaggcttactttgacagatatcacaattgacattccccgagttccaaagaagaaaacattgattgaagccatggagaaggctgatgttaagaacaagtgggagaatagctcatggggtagaaagctgattgtccagaagagaagggcagcgctcaccgacttcgataggttcaagcttatgttagctaagatcaagaaggctggagtcgtcaggcaagagcttgcaaagcttaaaaaggagaatgcatcttgaagtaattctgaattatgggattttttgctagttttttcatcaatgttccgcgagttctttttgggattgatttcgtttttctattaaacagaggattaagatcttttgaggacaccttatttgctgtatgacagattttgtagtgagtttattgctatatattgcttgcttaatttggttgcatgttgcagtattcttttcctttcaaacttctgttgtttatgtcttggctgttcatttgatggtagtaaaatctttgagaatttgggcaagatattgcctgatatattaattaa

SEQ ID NO: 611 - DNA, 762 bp, Gossypium hirsutum
tttccttctcgcctctgtagtttcctacactctcacacactcacagcaaaaaatgccgttcaagaggtatgttgagatcgggagggtggctctcgttaactacggcaaagactacggaaaattggttgtcatcgttgatgttgttgaccagaacagagctcttgttgacgccccagatatggtcagaggccaaatgaacttcaagaggcttactttgacagatatcacaattgacattccccgagttccaaagaagaaaacattgattgaagccatggagaaggctgatgttaagaacaagtgggagaatagctcatggggtagaaagctgattgtccagaagagaagggcagcgctcaccgacttcgataggttcaagcttatgttagctaagatcaagaaggctggagtcgtcaggcaagagcttgcaaagcttaaaaaggagaatgcatcttgaagtaattctgaattatgggattttttgctagttttttcatcaatgttccgcgagttctttttgggattgatttcgtttttctattaaacaaagggttaaggtcttttgaggacaccttatttgctgtatgacagattttgtagtgagtttattgctatatattgcttgctcaatgtggttgcttgttgcagtattcttttcctttcaaatttctggtgtttatgtcttggctgttcatttgatggcagcaaaatctttaagaatttgggcttgatattgcctgatatattgattaataatacagt

SEQ ID NO: 612 - DNA, 753 bp, Eucalyptus grandis
cggacggcccagatcaaaatcaaaacccacctataaattccgaaaccctaaacctcttccgccggggattctcgccaccgttctctgccccgctccatccctctctcgccgtctcctgcttccagcgccggcgaaaatgccgttcaagaggcatgtggagatcggacgggtggctctgatcaactacggcaaggagtacggcaagctcgtcgtcatcgtcgatgtcgtcgaccagaaccgggctcttgtcgatgcccctgatatggttagaatgcaaatgaatttcaagaggctctccctcactgacattaagattgacattaagaggattccgcagaagaaaacactcgttgcagccatgcaggaagcagatgtgcaaggtaaatgggataagagttcctggggcaggaagcttgttgttcagaagaggagagcatccctgaatgactttgacaggttcaagctcatgctggccaagattaagagaagtggactaatcaggcaagagcttgcgaagctgaagaaagaaagtgcttcttaagtgactgttttcctaatttttgtgctgaatatttttttcagactccacagttttgctttttgtgttatttccttggtctcagaacaattttaaggggaattgaaactcaaaattcttatgtcttcccaaatcgattccagtagtcatgtgaaatccttatttttagaggcttgtttggaagtaaattcactgcttcacgccgaagcaaatgc

SEQ ID NO: 613 - DNA, 827 bp, Zingiber officinale
gtggggttcccattcttgtcgactccatcagcgatcactcctatcgattggccctctctatagggaacctccccctcagtgctgaagactatgtggttggtctctccgggtgcatcatcgcccgtgatcttagtgttgatgaggcacagcccgacgtagggatccttgggtttgtacttattgacgacgacgcccctgctttcttctcgccgacgaaatgccgttcaagcgatatgtggagatcggcagggttgcccttgtcaattacgggaaggagtacggaaggctcgtcgttatcgtcgatgtcatcgatcagaacagggctttggtcgacgcacctgatatgattcgtggccaaattaacttcaagaggctttctcttactgatataaagattgacataccacgtgttcctaagaaaaagaccctgatcgaagccatggaagctgcagatgtgaagaataaatgggagaagagctcatggggtaggaagcttatcgtgcagaagaggagagctgcgctgaatgacttcgaccggtacaaagtcatggtggccaagatcaagagaggacgtgccatcagagaaaaattggctaaactaaaaagggagaacccagcttgaggttgagaggattagtctgtctgatccagcataggtggtgtttaagtcctgttgaagttaggggataccatttccatgtttttcatagaacttgaatttctagagatattcgggcttgagattttgctattatcctcgactcgtccacaatgatggtcgtgaacttttgtttacaagtaaattaagttgtttgcatgtcttgatt

SEQ ID NO: 614 - DNA, 832 bp, Zingiber officinale
  misc_feature (252)..(252): n is a, c, g, or t
  misc_feature (733)..(733): n is a, c, g, or t
gcaccagtcctcgtgccgaattcggcacgagggttttgtactgataactgctggaattggaaatgttgcacgatgtgcagacttgctaattgcgggagaccatgcgcatcaactcctcgtccttgactagtgcgctaagcgtctcgggcgaaaggcacacctccatcataatgctccctttctcaggccctggaaacacagtcagcgtcgacctcaagatgccgttcaagcgatatgtggagatcggaaggnttgctcttgtgaactacgggaaggagtatggaaggctcgtcgtcatcgtcgacgttatcgatcagaacagggctttggtggatgctcctgatatggtgcgtggccaaattaactttaagaggctttctcttactgatataaagattgacattccacgagttcctaagaagaagaccctcattcaagccatggaagttgctgatgtgaagaataaatgggagaactgctcgtggggcaggaagcttatcgtgcagaagaggagagccgcactaaatgactttgacaggttcaaggtcatggtggccaagattaagagaggacgtgccatcaggcaaaaactgggcaggctcaaaagggaaaatgcagtctgagctgatcaggactaatccgtgaattttgattaggtttctgatcctgtgttggtgttgaagtcttgcatagagtttgtagtaaactcgtttccttgtttagaacttgaatnttttcaaatactctgaattaaaaatttacagtcttctcggcaatgatccacctgaatatttatttgaaattatattgatattctttttgctttacttgc

SEQ ID NO: 615 - DNA, 747 bp, Lotus japonicus
ggaggtatttcttccttgctctccctctgcttccctcagccgctgcttgagtctctcattcagaatccacaatgccgttcaagaggttcgttgaggtagggagggtggctctcgtcaactatggcaaggattatggcaggcttgtcgtgattgtggatatcattgaccagaacagggctcttattgatgcccctgacatggagaggtctcaaatgaatctcaagaggctttccctcactgacatcaagattgacatcaaaagggttcccaagaagaaggatctgattgctgccatggaagctgcagatgttaagaacaagtgggagaaaagctcctggggtaggaaactcattgtcaggaagagaagggcttccctcaatgattttgataggttcaagatcatgttggcaaagatcaagagggccggtgctgttaggacagagcttgcaaagctgaaaaagaccgcagcttaggcaatattttctgttatagtgttcaaattttgtaatgaattatcttccacctagcactccttgtttgttacgagcttttctttatcatttgagatacttgaatgtttcatcttcagattatgtagggggtttgtgtcagtactcagttctcccatttttgcgtttgcatgcagatttgtgagtgttggttcttgagataaaagtaattctctcaattgataacttgcttgattattggggtctatcttctgagttactgtgtgattgtttcatt

SEQ ID NO: 616 - DNA, 678 bp, Papaver somniferum
cagactgtgtatccccttctcgtttctcctcctccacggcgcttctctgatttctcccagttcctcgattcaatctcacaatgcctttcaaacgatacgttgagatcgggcgtgttgctctagttaactacggagaagactatggaaagcttgttgtcatcgttgatgttattgatcaaaacagagctttggttgatgcacctgatatggttaggtcacaaatgaatttcaagagattgtctttgactgatattaaaatcgatatcggccgtgtacctaacaagaaggctctccttgctgccatggaagctgcagatgtgaagaagaagtgggagagtagttcatggggtaggaagcttatcgtgcagaagaagagagcttcccttaacgatttcgagaggtttaaggtcatgcttgccaaaatcaagaggggtggtttgatcagacaagagctatccaagttgaagaagtctgcagcttaagacaagtattaactgcgtttttcaaagctttttatggtattttatagttttgattgtcaattttgtagagacttggtttcttacaaggatggatggatgttttgtcattattttagtagtagcatattttggaacttcctagcctttttattcttgtctaattaaaggccagtctacatgacaagatgcttgaatt

SEQ ID NO: 617 - DNA, 665 bp, Prunus persica
ctttgcttcatttgcttttctacgccccgcctccttccttgctcaaagttctcacagtcgcacacttgaccagaacaaaaaatgcctttcaagagatacgtcgagatcgggagggtggctctcgttaactacggcgaggactatgggaaactcgtcgtcattgtcgacgtccttgaccagaaccgagctcttgttgatgcccctgatatggtgagatcccaaatgaatttcaagagactttccctaactgacatcaaaattgacatcaaaagggtccccaagaagaaggaactgcttgctgccatggaggctgctgatgtgaagaagaagtgggagaatagctcttggggtaggaagctgattgttcagaagagaagggcagctcttaatgactttgatcgattcaagctcatgctcgctaagattaagagagctgggctggtgagaaccgagcttgcaaaactgaagaaggagagtgcatcttaggaaatatcatgatatttagtttacaattttgtcatggattttcttttgaaagctttatgtttgaatgtaatccctttgtttttcttcaatcaattttagttttcagatcattgttgtttctagtattgttgacaaatgttggcgcatctcttgattaattctgccagtctgtttcacgt

SEQ ID NO: 618 - DNA, 921 bp, Glycine max
accaaaccctagtttagtgttagtgttcttccacccccgtaccgtctctgcctctctgcaatccacagccgaaaatgcctttcaagaggtacgttgagatcgggagggttgctcaaatcaactacggcaaggaatatggcaggctcgtcgtcatcgtcgacgtcattgaccagaacagagcacttgtcgatgcccctgatatggtgaggtcccaagtcaatttcaaaaggctttcccttaccgacatcaagattgacatcaagagggtccctaagaagaaagatcttgtcaaagccatggaggatgctgatgttaagaacaagtgggagaagagttcatggggtagaaaactcattgttagaaagagaagggcatccctcaatgattttgataggttcaagataatgttagccaagatcaagagggcagcggttgtaaggcaagagcttgctaagctgaagaagagcgcttaggcataacttcacattatagtcttcaaattttagttatgaatttgcttgccttggttgttatgagatttcaagtatcatcattgaaccacgtttggtttactgttagggatttatgtcagtactccaagtttcaatactttgcattttcttgcagattttataatattattttcaatattaacttatattcccagaggttgcaagtgagagttgcaattggttttttccccataattttatatttattaagtacataggctttgtgattagaatgttcggctatgtagtttcaacatttgcttaacactggtacaatggtagtcatgccgtgtcgtacatgaacaacttctatgtagttaaattagcccgtgggcagtgtctggttttttatgaaattgaatttgttgatccatccaatagtaatgcaatgatatgtctgaattgtagt

SEQ ID NO: 619 - DNA, 702 bp, Fragaria vesca
agctctgcctcttttgcctcacacgcttctccgacgagtcttgactgctctcagatcccggaaaaatgcctttcaagaggtacgtcgagatcggaagggtggctctggtcaactacggcccggactacggcaggctcgtcgtgattgtcgatgtcatcgaccagaatcgggctctggttgatgcacctgatatggtgaggactcagatgaacttcaagaggctgtcactcactgatatcaagattgagatccccagggtgccgaagaagaagactctcattgctgccatggaggctggtgatgttaagaacaagtgggaacagagttcatgggggaggaagctgatagtgcagaagagaagggcttcacttaatgatttcgataggttcaagctcatgttggccaagatcaagaaagctggaattgtcaggcaggagctaacaaagctgaagaaatcaagtgcagcctaaatctgttgcagtcttgttataagatattgagttgcttctgttttgattcatagtggtagcaccatatgggtattttggttaggtcatagttgtgagaggcacttttgttgaaatgattggcaggttatctttaaaaactttgcatgagttttgtttgaattgaaatggaagccaactttcctcgagttgatatttctttttatgatgttattattgttgcattttgtgggtt

SEQ ID NO: 620 - DNA, 789 bp, Nicotiana tabacum
ggacatcacacaccattagcctaactcttcgcgcctggtcagctgcttcctcaaatcgtcgaaaatgccgttcaagaggttcgtagagatcggaagagtcgcccttgtcaactacggggaggactatgggaagctcgttgttatcgtcgatgtcattgaccaaaatagggcgcttgttgatgctcctgacatggtgaggagccagattaattttaagaggctttcactcacagatatcaaaattgacatcaaaaggatcccaaagaagaagaccctcgttgcagctatggaggctgctgacgtgaagagcaaatgggagagcagttcctggggaagaaagttgatagttcagaagaggaggtcctcgcttaatgattttgacaggttcaagctcatgctggcaaagataaagaaggctggagttgtaagacaggagcttgctaagcttaagaaggacgcttaagaactctttgattagtgagatttgtatgataggagttttggaagtcgttgtgttttgcttttagattttggttcattactggcaagtcatttggtttcatctttggtgtcattgaagactcctagaaatcaatttcccaatagttttaatttgaattatgatggtgaacattctcttcgcagacacttcattttgttgctcaaattgttttcgtttcatatacgtgatctcactctgctgtagggctgtgcataatttggtaaataccgaattatcgaacttaaacgcgaaattttttgtatttggtattcgcagcggccgcatga

SEQ ID NO: 621 - DNA, 719 bp, Cleome gynandra
cgggaggcaaaccctagcgtcgttcttcttcgcgtccgctttcctctctgagcttcgagtgtcttgccaatccgagaaaatggtgttcaagaggtacgtggagataggaagggtggcgcttatcaactacggcaaggagtatgggaggcttgtcgtgatcgtcgacgtcgtggaccaaaacagggctctggttgatgcccctgatatggtgaggactcaaatgaacttgaagaggttatcgttgacagatatcaagattgatatcaatagggtacctaagaagaagaatttgatcgaggcaatggaaaaggctgatgtgaagaacaaatgggagaagagttcatggggtaggaagctgatagtgaaggagagaagagcttcacttaatgatttcgacaggttcaagatcatgttggctaaaatcaagagggcgggtctcgttagacaggagcttgcaaagctcaagaaagagagctctgcctgataatctctctcttgcgctgttttgtcttatgatccgttggtcagttctggatttttattttattagtgtgatcctttgggttaggggttaccaaagtccatcatcgtccgaggaaataacctttcaacttttatcctattttattcaaaaatcagatttttcctcttctatattttctctataagtttatgttaggaaatacaatgaattggaatatgatatttggtagaattgc

SEQ ID NO: 622 - DNA, 634 bp, Cleome spinosa
tcgggggtcgtcacgaagccgaagcagaagcagccgcagtctcgagctccgttcgtgtagggcttatccatcgacgagatctaacaatggtgttcaagaggtacgtcgagatcggaagagtggctctgatcaactacggaaaggagtacgggaagctcgtggtgatcgtcgatgtggtcgatcagaacagagctcttgttgatgctcctgatatggtgaggacccaaatgaacctgaagaggctctcattgaccgatatcaaaatagacataaaccgtgtcccgaggaagaagtcgctcattgaagccatggagaaggctgatgtgaagaacaagtgggagaacagctcatggggcaggaagctggtcgtccagaagagaagagcctcacttaacgattttgacaggttcaaggttatgttggccaagatcaagagagctggattggtgaggcaagagcttgcgaagctgaagaaggaaagctcatcatagacgtgcatgagagtctaagtacttgttttggtttgaccagcgttgtaagaatttccgtctcttgttttctggatttcgttgtgctaaaaattaagaatctgttacatctatgccgacattgttctttggtttacatcccaaaa

SEQ ID NO: 623 - DNA, 410 bp, Cleome spinosa
aacaatggccttcaagaggtacgtcgaaatcggaagagtggctctggtaaattatggaaaggactacgggaagctcgtggttattgtcgatgtcgtcgatcagaacagggctcttgtcgatgcacctgatatggtgaggacccaaatgaacctgaagaggctctcactgaccgacatcaaaatcgacactaaccgtgtcccgaggaagaagtctctcatcgaagccatggagaaagctgatgtgaagaacaaatgggagaacagctcgtggggaagaaagctgattgttcagaagagaagagcttcactcaacgactttgacaggttcaaggttatgttggccaaaatcaagagagctggattggtgaggcaagaacttgcaaagctgaagaaggaaagctcatcataag

SEQ ID NO: 624 - DNA, 712 bp, Ipomoea nil
agcgctaccctcccatccaaaccctaaatctccgcattttccaccgggaatagctcgctctgcgcctccgcataaaccggcgctcctgctcattccagtagacgaaaatgccgttcaagaggtacgttgaaattggaagggtcgctctcgtcaactacggaaaggactatggaaagctcgtcgtcatcgtcgatgttattgatcagaacagggcacttgttgatgcccctgacatggtacggagccaaatgaacttcaaaaggcttacactcacagatataacaattgacataaaaagggtcccgaagaagaagactttgattgctgccatggaggctgctgatgtcaagaacaagtgggagaacagctcctggggcaggaagttgattgtgcagaagaggagggctgctctaaatgattttgacaggttcaagatcatgttggcaaaaatcaagaaggctggaattgtgagacaggagctttcaaagcttaagaaggagagcacagcctaaaatccattttcttataatattgatgttcttatattaggtcttctgccttgtatcaaggattgtctctttagtttctgcttctcttgtatcgagaaagacacaattttgtcatatcattcatcatatgcatttttggaaacttttttgcggtggatcttatgttgattgttgaaatattatcaagcaccataaaattaagt

SEQ ID NO: 625 - DNA, 722 bp, Ambrosia trifida
atattattaactttgggcttttaaagattaaacatgaacattcaacacttggggcagtctcaagtgagcccaagaacgtagccctaattatataacccaacgaccactccaaaaccctatctttcatcgtcatcaatcgccacagcctccgtctgtctcctcaacgatccgcaaccaaaatgccgttcaaaaggtacgttgagatcggaagaatcgccctcgttaactacggaaaggattatggcaagcttgttgtcattgttgacgtcatcgatcaaaacagagctttagttgatgctcctgatatggttagaggccaaatgaacttcaagaggctgacgcttaccgacatcaaaatcgatattaaaagagttccaaacaagaaaactcttattgctgcaatggaggctgctgatgtcaagaacaagtgggaaagcagttcgtggggaagaaaactaatcgttcaaaagaagagagcctcacttaatgattttgaccggttcaaggttatgttggcaaagataaagaaagcgggagttgttaggcaagagctagccaagctaaagaaggaaaccgcttgatttgcaccagttttgagatttcagcgcagttcatttaaatcgtggtttagtagattattgttggctttttaggacttcatgtttgaccttttacagggtattaaagggattgtctgattcagttttgaatttctatgttgg

SEQ ID NO: 626 - DNA, 622 bp, Curcuma longa
ttgcggccgaactgctttcttctcgccgacgaaatgccgttcaagcgatatgtggagatcggcagggttgcccttgtcaattacgggaaggagtacggaaggctcgtcgttatcgtcgatgtcatcgatcagaacagggctttggtcgacgcacctgatatgattcgtggccaaattaacttcaagaggctttctcttactgatataaagattgacataccacgtgttcctaagaaaaagaccctgatcgaagccatggaagctgcagatgtgaagaataaatgggagaagagctcatggggtaggaagcttatcgtgcagaagaggagagctgcgctgaatgacttcgaccggtacaaagtcatggtggccaagatcaagagaggacgtgccatcagagaaaaattggctaaactaaaaagggagaacccagcttgaggttgagaggattagtctgtctgatccagcataggtggtgtttaagtcctgttgaagttaggggataccatttccatgtttttcatagaacttgaatttctagagatattcgggcttgagattttgctattatcctcgactcgtccacaatgatggtcgtgaacttttgtttacaagtaaatta

SEQ ID NO: 627 - DNA, 656 bp, Euonymus alatus
gggattacggccgggggtctctacgaccacaaactctccgcctctctgtctctcgtctttctgtttcaccctcacatacacacactccacaagaaccaaaatgcctttcaaaaggtacgtggagatcggacgggtggcactcgtcaactacgggaaagactatggtaggctcgttgtcatcgtcgatgtcctcgatcagaacagagctcttgttgatgccccggatatggttaggacccagatcaatttcaagaggttgtctctaactgacatcaagattgagattaaccgtgtgcccaagaagaagaatctgattgaagccatggagaaggctgatgttaagaacaagtgggagaacagctcttggggtaggaagctgattgttcagaagagaagggcatcccttaatgactttgatagatttaaaattatgttggccaagatcaagaaatctggattagtgaagcaggagcttgcaaaactgaaaaaagaaaatgcgtcctaggcgattattcataagaacttcctatttttgtttaagcagtgttccttgagttgatgtttttggatcttactcatttttgttgtttaattttgagactgtcattcagtataaggatttggaatagttaaattgcaaggagtaaaacgtttta

SEQ ID NO: 628 - DNA, 653 bp, Euonymus alatus
cggccggccgggggcgtctctacgaacacaaactctccgcctctctgtctctcgtctttctgtttcaccctcacatacacacactccacaagaaccaaaatgcctttcaaaaggtacgtggagatcggacgggtggcactcgtcaactacgggaaagactatggtaggctcgtcgtcatcgtcgatgtcctcgatcagaacagagctcttgttgatgccccggatatggttaggacccagttgaatttcaagaggttgtctctaactgacatcaagattgagattaaccgtgtgcccaagaagaagaatctgattgaagccatggagaaggctgatgttaagaacaagtgggagaacagctcttggggtaggaagctgattgttcagaagagaagggcatcccttaatgacttcgatagatttaaaattatgttggccaagatcaagaaatctggattagtgaagcaggagcttgcaaaactgaaaaaagaaaatgcgtcctaggcgattatttataagaagttcctatttttgtttaagcagtgttccttgagttgatgtttttggatcttactcatttttgttgtttaattttgagactgtcattcagtataaggatttggaatagttaaattgcaaggagtaaaacgttt

SEQ ID NO: 629 - DNA, 622 bp, Euphorbia peplus
tttctcttattctctatagccctccgcctctctcagctttcacagtcacacactacacgaaatcaagatgccttacaagaggtatgtagagatcggaagggtagctcttgtcaactatgggaaggactacggaaagctcgttgtcatcgtcgatgtcatcgatcagaaccgagctttagttgatgcccctgatatggtaaggagccagatgaacttcaagaggctctcacttactgatatcaagattgacatcaacagggttccaaagaagaagaatttaattgaagctatggagaaggctgacgttaaaaacaagtgggagagtagttcctggggtagaaagctgattgtccagaagaaaagagcagctcttaatgattttgataggttcaagttgatgttggctaagattaagcgggctggattggtcaggcaagaactcgccaagttgaagaaagagagtgcagcctaaaattttctttcttttaagtttctcaattttgttatcattattgtgcaagttatttcagaatgttatccatttggattttgatttacctagatattgagagcagattaatggaacttttatatgacagatttcgtagtgagtgatattgtg

SEQ ID NO: 630 - DNA, 749 bp, Fagopyrum esculentum
ccctaatcactcttatacgctttcacaagtgtctccgcccgtcctttgtttctgtgattcggctgctactctttccgctacacagcttcagcgaagatgccgttcaagaggtacgtggagatcggaagagttgctcttcttaactacggcaaggagtatggcaggctcgtcgtcatcgttgatgttattgatcagaacagggcacttattgatgctccagacatggtcaggggccaaattaacttcaagaggcttacattaacagacatcaagattgacatccccagagtgccaaagaagaaaaccctcatcgaggctatggaggctgctgatgtgaagaacaagtgggagagctcctcttgggggaggaagttgattgttcagaagaagagagcttcactcaatgactttgatcgcttcaagatcatgttggctaagatcaagaaagctggagcggttaggcaggagcttgcgaagttgaaaaaggctagtgcttagttgagatgtcatctatgaaatttcaattttgtgatactgttttagttggagtttgcagtgttggatttacccccttttgttacaagttggggaatgaatggattttttttatcaagaactgaggttttatttagatttaccatcatttgttgatgatttgcattttgtcaatgtctaggaattgattgcataatttggactatcctacacttgaaattttctctaacaggttggatcttaaatgatctttt

SEQ ID NO: 631 - DNA, 629 bp, Fagopyrum esculentum
ttcggctgttactctttcccttacacagcttcagcgaagatgccgttcaagaggtacgtggagatcggaagagttgctcttcttaactacggcaaggagtatggaaggctcgtcgtcatcgttgatgttattgatcagaacagggcacttattgatgctccagacatggttaggggccaaattaacttcaagaggcttactctaacagacatcaagattgacatccccagagtgccaaagaagaaaaccctcattgaggctatggaggctgctgatgtgaagaacaagtgggagagctcctcttgggggaggaagttgattgttcagaagaagagagcttcactcaatgactttgatcgcttcaagatcatgttggctaagatcaagaaagctggagcggttaggcaggagcttgccaagttgaaaaaggctagtgcttagagttaagatgtcacctttgaaattaaattttcaattttgcgatactgttttagttggagtttgcagtgttggatttaccctcttttgttacaagttggggaatgaatggattcttgatcttttttacaatttggggaatgtatggattcttgatcaagaactgaggttttatttagatttaccattat

SEQ ID NO: 632 - DNA, 430 bp, Flaveria ramosissima
ctcaagtctcccggcgatctgcaaccgcaaaaatgccgttcaagagatacgttgagatcggaagagttgcccttgttaactacggaaaggattatggaaagctcgtagtgatcgtcgatgtcatcgatcaaaacagggctcttgttgatgctcctgacatggtgagaggccaaatgaactttaagaggctaacactaacagacatcaaaattgacatcaaaagagttccaaacaagaaaacccttattgccgcaatggaggctgctgatgtcaagaacaagtgggaaaacagctcatggggaagaaaactcattgttcaaaagaagagagcatcacttaatgattttgataggttcaaaattatgttggcaaagataaagaaggcgggagttgttaggcaagagcttgccaagctaaagaaggagaccgc

SEQ ID NO: 633 - DNA, 523 bp, Flaveria ramosissima
ctcaagtctcccggcgatctgcaaccgcaaaaatgccgttcaagaggtacgttgagatcggaagagttgctctcgttaactacggaaaggattatggaaagctcgtagtgatcgtcgatgtcatcgatcaaaacagggctcttgttgatgctcctgacatggtgagaggccaaatgaactttaagaggctaacactaacagacatcaaaattgacatcaaaagagttccaaacaagaaaacccttattgctgcaatggaggctgctgatgtcaagaacaagtgggaaaagagctcatggggaagaaaacttattgttcaaaagaagagagcctcacttaatgattttgataggttcaaaattatgttggcaaagataaagaaggcgggagttgttaggcaagagctcgccaagctaaagaaggagaccgcttgatttgcacaacgatcaagatttatcggaattttggtgcagtttattaaaattgttgttgagtagacagaccattgtaggattcatgtctg

SEQ ID NO: 634 - DNA, 582 bp, Flaveria ramosissima
ccacagcctcaagccccatcggcgctctgcaactgttcgcctgaaaaaatgccgttcaagaggtacgttgagatcggaagagtcgccctcgttaactacggaaaagattacggaaagctcgtagtggtcgtcgatgttatcgatcaaaacagggctcttgttgatgctcctgatatggtgagaggccagatgaactttaagaggctaacacttacagacatcaaaattgacatcaaaagagttccaaacaagaaaactcttattgctgctatggaggctgctgatgtcaaaaacaaatgggaaaacagctcatggggaaggaaacttattgttcaaaagaagagagcatcacttaacgatttcgacaggtttaagattatgttggcaaagattaagaaggcgggtgttgttaggcaagagctggcgaagctaaagaaggagactgcttaatttgtatgaatgtcaagattttgttgcattttatttgaattactgttgagtagaccattgatggtttttagcagtttatgtttgacctttcaaaagttcttaaaagggatgttagaactttgttttattaac

SEQ ID NO: 635 - DNA, 736 bp, Linum usitatissimum
ggagaaagctttaacactcctctgtcgatcctcttcagttcctctcgccgccattcatcttcctcttcccgcctctatcctccctccgactcacttgcagatccgcgaaaatgggtttcaagaggtacgtggagatcggaagagtagcgctcatcaactacgggaaggagtacggaaagctcgtagtgatcgtcgatgtcgtcgatcaaaacagggctttggttgatgcaccagatatggtaaggagccagatcaacttcaagaggttgacactcacagatatcaagattgagatcaatagggttcccaagaagaagacgctcgttgaggctatggagaaagcagatgtgaagggaaaatgggagaacagttcatggggaaggaagctcattgttcagaagagaagagccgaactcaccgatttcgacaggttcaaggtcatgttggcgaagatcaagaggggaggactcatcaagcaggagcttgcgaaacttaaaaaggagtctgcttagatttcttcaccttcgttgtttagaccgtctttgttgagaacagtaaacccttagcagttttgatttgtttcttaactgaatgtaagctcagattgtgttttaaattatggattcaggtgcggtcagccgacattgaggcaacgaatgtgttttttttctatgtatgacactgttactgtgcatgtatcgcgcggattttcttgtattacttggaacaaaagggc

SEQ ID NO: 636 - DNA, 704 bp, Linum usitatissimum
tctcgccgccattcatcttcctcttcccgcctctatcctccctccgactcacttgcagatccgcgaaaatgggtttcaagaggtacgtggagatcggaagagtagcgctcatcaactacgggaaggagtacggaaagctcgtagtgatcgtcgatgtcgtcgatcaaaacagggctttggttgatgcaccagatatggtaaggagccagatcaacttcaagaggttgacactcacagatatcaagattgagatcaatagggttcccaagaagaagacgctcgttgaggctatggagaaagcagatgtgaagggaaaatgggagaacagttcatggggaaggaagctcattgttcagaagagaagagccgaactcaccgatttcgacaggttcaaggtcatgttggcgaagatcaagaggggaggactcatcaagcaggagcttgcgaaacttaaaaaggagtctgcttagatttcttccccttcgttgtttagaccgtctttgttgagaacagtaaacccttagcagttttgatttgtttcttaactgaatgtaagctcagattgtgttttaaattatggattcaggtgcggtcagccgacattgaggcaacgaatgtgttttttttctatgtatgacactgttactgtgcatgtatcgcgcggattttcttgtattacttggaacaaaagggcatactgctgt

SEQ ID NO: 637 - DNA, 563 bp, Parthenium argentatum
atcctcagcctctgcaactattcacccctaaaaatgccgttcaagaggtacgttgagatcggaagagttgctctcgtcaactacgggaaagattacggtcgtcttgttgtgatcgtcgatgtcatcgatcaaaacagggctcttgttgattctcccgacatggttagaggccagatgaactttaagaggctaacacttacggacatcaaaatcgacatcaaaagagttccaaacaagaagacacttattgctgctttggaggctgctgatgtgaaaaacaaatgggaaaatagctcatggggtagaaaactcattgttcaaaagaagagagcatcactcaacgattttgacaggtttaagatcatgttggcaaagattaagaaagcaggagtcgttaggcaagagctagccaagctaaagaaggagactgcttaattcgtatgaagcatgagattttggtgcattgtgtttgaactattgttgagtagaccagtgttggttcttaggtgtttttgtttcactttttacaagggattaaggagatgttttgaactgttttattc

SEQ ID NO: 638 - DNA, 679 bp, Phalaenopsis aphrodite
tggtaggtttccagcggattggagcagcagccatgcctttccagcggtacgtggagatcgggagggtagcgctcgtcaactatgggaaagagtatgggagacttgttgttatcgtcgatgtcatcgatcagaatcgagccttagttgatgctcctgacatggttcgaggacaaatgaacttcaagaggctgtctctgactgatatcaagattgacatcccccgaattcccaagaagagcaaactgatcgaggccatggaagcggctgatgtgaagaatagatgggagaagagctcttgggggaggaagctgattgtgcaaaagaggagagctgaactgaatgattttgatagatttaaggtcatgttggctaaaattaagagaggagattccatccgacgtgagctttcaaagctaaagaagagtgcttcaaagtgaggtttttgaagaatcaatggctgattctgtttccattattgcagcatcaagttgatcgtcaaccaaacgttagaacaaatgtagttttggtcggtgttatgaactctgtggattcttaaagtttgatgttttgattctgtacccgtttgcttattatttgaatgaatttgagaattggattatgatttattattccacagtaaaagtgatttgtgagacttggtttttgtcgatatgtgatt

SEQ ID NO: 639 - DNA, 672 bp, Helianthus annuus
ccatctcaaccgccacaccttcaattctcctcggcgctctgcaactaatcgcctgcaaaaatgccgttcaagaggtatgttgagatcggaagaattgctctcgttaactacggaaaggattatggaaagctcgtagtcattgttgatgtcatcgatcaaaacagggctcttgttgactctcctgacatggtgagaggccaaatgaacttcaagaggctaacacttaccgacatcaaaattgacatcaaaagagttccaaacaagaaaactcttattgctgctatggaggctgctgatgtcaagagcaagtgggaaaacagctcatggggaaggaaactcattgttcaaaagaagagagcctcacttaacgattttgacaggttcaagatcatgttggctaagatcaagaaagcgggagtcgttaggcaagagctcgccaagctaaagaaggagaccgcttaatttgtatgaatgtcgagattttgatgcactttatttgaattattgttgagtagaccagtgttggtttttaggagtttatgtttcacttcttacaacagattaaggggatgtttagaaccgtttcattcaattttgaacttccatgtttgctggtttgttaaccaggttgtgtttcggattgacttatttgacacgttttagagctaggct

SEQ ID NO: 640 - DNA, 610 bp, Tripterygium wilfordii
tctcgtcttacgaacacttgaacgaaatccaaaatgcctttcaagaggtacgtggagatcgggcgggtggcactcgtcaactatgggaaagactacggcaggctcgttgtcatcgtcgatgtcctcgatcagaacagagcccttgttgatgctccagatatggttagaacccaaatgaatttcaagaggttgtctctaactgacatcaagattgagattaaccgggtgcccaagaagaagaatctgatcgaagctatggagaaggctgatgttaaaaataagtgggagaacggttcttggggtaggaagcttattgttcagaagagaagggcatctcttaacgacttcgacagatttaaaattatgttggccaagatcaagaggtctggattggtgaagcaagagctttcaaaactgaaaaaggaaaatgcatcctaggcgattatttataagaatttcccagttttgtttgcattttccttcagatgatgtttttggattctactcatttttcttgtttattttagagagaggccttcaatctgagaattttgcaaaaatgagattttgtaacctgtttaatgtgacctaatctgtcatgtggttcccg

SEQ ID NO: 641 - DNA, 545 bp, Utricularia gibba
cgcggaaatgccgttcaagaggtacgttgagatcggccgtgttgccctagtgaactacggaaaggagtatggcaggcttgtggtcatcgtcgacgtcattgatcagaacagggcacttgtggatgcgcctgacatggtgaggagtcaaatgaacttcaagaggctttcccttaccgacattaagatcgacatcaaaagggtcccaaagaagaaggcccttgtagatgccatggaggccgctgatgtgaagggcaaatgggaaaagagttcatggggccggaagctcatagtgcagaagaggagagcttccctgaatgatttcgaccggttcaagctaatgctcgccaagatcaagaaagctggagttgttagacgggagcttgctagtctcaagaagaaacagcttgagtagtgcttcatttggttactgcctccatgtgcccacataaagttccttgtttgttcctgatctttcttatgaatagaagttgatcgatttttgagttatttggagtaggtgccaagacaatatatccgacataaac

SEQ ID NO: 642 - DNA, 590 bp, Flaveria ramosissima
tcgtcttcaatccccacagcctcaagccccatcggcgctctgcaactgttcgcttgaaaaaatgccgttcaagaggtacgttgagatcggaagagttgccctcgttaactacggaaaagattacggaaagcttgtagtcatcgtcgatgttatcgatcaaaacagggctcttgttgatgctcctgatatggtgagaggccagatgaactttaagaggctaacacttacagacatcaaaattgacatcaaaagagttccaaacaagaaaactcttattgctgctatggaggctgctgatgtccaaaaacaaatgggaaaacagctcatgggaagaaaacttattgttcaaaagaagagagcatcacttaacgatttcgacaggtttaagattatgttggcaaagattaagaaggcgggtgttgttaggcaagagctggcgaagctaaagaaggagactgcttaatttgtatgaatgtcaagatttgttgcatttatttgaattactgttgagtagaccattgttggttcttagtagttatgttgtacctttagaagttacttaaagggaatgttagaacctggttttattc

SEQ ID NO: 643 - DNA, 457 bp, Triticum aestivum
gccgccgccccgccgtgttgctcgccgacaccgccccgccggcagccaaaatgccgttcaagaggttcgtggagatcgggcgagtggcccttgtaaactacggcaaggagtatggccgcctcgtcgtcatcgtcgacgtcgtcgaccagaacagggctcttgttgatgcccccgacatggttcgttgccaaatgaacttcaagcggctttccctgactgacatcaagattgacattaaacgtgtcccaaagaagactacactgatcaaggcaatggaggaagctgatgttaaaagaaagtgggagaatactcatggggcaagaactgatgttcaagaagaggagacacactcaatgactttgacaagtcaaaggcatgttggcgaagatcaaaaagggcgggccattaagaaagacttgctaacttaaaaagcggtgctgctgcttaaatgctttgg

SEQ ID NO: 644 - DNA, 488 bp, Liriodendron tulipifera
ctgatctacagccatgccgttcaagcgatatgtagagatcgggcgagtcgctcttgtaaactacgggaaagactatggaaagctggtcgtaatcgtcgacgttatcgatcagaaccgggctctcgtagatgcccctgacatggtgcgaggtcaaatgaatttcaagaggctttcgctaacagatatcaagatcgacattccaagaatacccaagaagaagtcacttgttgctgccatggaagctgcagatgtgaaggacaagtgggagaacagctcgtggggccggaagctgattgtgcaaaagagaagagcttccctcaatgactttgataggttcaagggcatgttggcaaggatcaagaggggaggtgcgatcaggcaagagttcgcccagctgagaaggcaagctcaagctgctgctgcttgagattctatttttgtttggacctttcattcttggtatggatttttgaaactggtgatttggg

SEQ ID NO: 645 - DNA, 554 bp, Petunia hybrida
accccccaaacccaaaaacacatcgaattaggaatccgccaccagccactagttcactcttggcgccgaatcagcagctcctccaaatcgccgaaaatgccgttcaagaggtttgtggagataggaagagtagcacttgtcaactacggcaaagactatggcagactcgtcgtcatcgtcgacgtcattgaccaaaatagggctctagttgatgctcctgatatggtgaggagccagatgaactttaagaggctttcgctcacagatatcaaaattgatatcaaaagaattcctcagaagaagaccctcattgctgctatggaggctgctgatgttaagaacaagtgggagagcagttcctggggaagaaaattgatagttcagaagaggagggcctctcttaatgattttgataggttcaagcttatgttagcaaagatcaagagggctggagtcgtgagacaggagcttgcaagcttaagagactgctgcttaagaactttttgattagtgcgatccgtataataggatttggaagttgtatttgttcttgc

SEQ ID NO: 646 - DNA, 479 bp, Euphorbia peplus
acgtaatactcacgtcgatcgactgaaaatgctgttcaaagaggtacgtaggagatatggaagagtggctctgtgttaatatacggcaaagaatatatggaagcttgtcgtgatacgtcgatgtaatcgatcaaaacagggcacttgttgatgctcctgatatggttaggagtcaaatgaacttcaagaggctatcactcactgatatcacaattgacatcaaaagggttcctaagaagaaaactctaattgaagctatggagaaagctgatgtgaagaacaagtgggagaacagttcatggggcaggaaactcattgtgcagaagagaagggccgcacttaatgattttgataggttcaagctcatgttggccaaaatcaagagaggaggaatcgtaaggcaagaacttgcaaaacttaaaaagcaggcggcgtagaaaatccttgtggactttctcttatctccccaaatttgcgta

SEQ ID NO: 647 - DNA, 680 bp, Allium cepa
aaatcttccttcattgtagccgcctgcttcagccatgccgttcaagagatatgtcgagatcgggcgcgttgcacttgtcaactatggaaaggattatggcaaacttgttgttattgtcgatgtcgttgatcagaacagagctttggttgatgctccagacatgatcagaggccagatgaacttcaaaaggcttagtctcacagacttcaaaattgacattccaagaacccccaagaagaaagtattgatcgaggctatggaaaaagctgatgtgaagaatagatgggaaaatagttcatgggaaggaagctgatcgtgcagaagaggagagcttccttgaccgacttcgacaggttcaaagtcatgtggcgaagatcaagagaggtactgctgtcaggcaagagctcaacaagttgaagaaacagagtgttgcagcttaaaggattatccatcttgtttgtattgttttaattggattcataatgtttttggatctgcggtttttgcttaatatgtacttaagttgtattgggagattctgaacttcaaatggtctgttatttatgttcttggttatagaacttttaggtcatgttttatttgtgtttgttggaggagaactgatattttaaaagaaaaatcagtatggtgcatggaggtatgtcatctttcttaagttt

SEQ ID NO: 648 - DNA, 643 bp, Antirrhinum majus
acacacacacacagagctcgcagatcgtcgaaaagccgttcaagaggtacgtagagatcggaagagtgggcctcgtcaactatggcaaagactacggccagcttgtcgtcatcgtcgacgtcatcgaccagaacagggcactagtagattcccctgatatggtaaggagccagatgaactttaagaggctttcacttacagacatcaaaattgacattaaaagagtccccaataagaagactctcgttgctgcaatggaggctgccgatgttaaaggaaaatgggagaagagctcttggggaagaaagctgattgttcagaagagaagggcagctcttaatgattttgacaggttcaagctaatgttggcaaaaatcaagagggctggtgttgtccgacaggagcttgcaaagcttaagaaacagacagcagcttaagaatttcacttttctttttatggagattttgaaataggattcggaaaattgtatcagttatttacgacgatttacttgtttctaaaccattacaatagggaggacactccaattttgcttattattctttcaacatgtttgagaatcagtgttcttgaaccgtgaacaggttttgtttaaattggctatgagtgttgccccttcca

SEQ ID NO: 649 - DNA, 488 bp, Vaccinium corymbosum
  misc_feature (41)..(41): n is a, c, g, or t
  misc_feature (43)..(43): n is a, c, g, or t
  misc_feature (125)..(125): n is a, c, g, or t
  misc_feature (127)..(127): n is a, c, g, or t
  misc_feature (148)..(148): n is a, c, g, or t
  misc_feature (182)..(182): n is a, c, g, or t
  misc_feature (192)..(192): n is a, c, g, or t
  misc_feature (373)..(373): n is a, c, g, or t
  misc_feature (416)..(416): n is a, c, g, or t
  misc_feature (486)..(487): n is a, c, g, or t
atttcccctctctcctcaattcgcctctccctcatcctcgnanaccaaaatgccgttcaagcgttacgtcgagatcgggagggtggctctggttaactacgggaaggaatatgggagactcgtcncntatcgtcgccgttatcgaccnaaacagggctcttgtaggatgcccctgacatggngagatgccanatgaactttaagaggctttctctcactgacatcaccattgacatcaaaagggccccaaagaagaaaacactgattgctgcaatggaggctgcagatgttaagaacaagtgggagaacagctcctggggcataaagctgattgtgcataaaagaagggccgctcttaatgattttgataggntcaagctcatgttggcaaaaatcaagaggggtggactgatcanaaaagagcttgcgaagctgaaaaagcagaatgcagcctaagcataacgtttctatgatcatgcccgaatnnt

SEQ ID NO: 650 - DNA, 597 bp, Flaveria ramosissima
ctcaagtctcccggcgatctgcaactgcaaaaatgccgttcaagaggtacgttgagatcggaagagttgccctcgttaactacggaaaggattacggaaagctcgttgtgatcgtcgatgtcatcgatcaaaacagggctcttgttgatgctcctgacatggtgagagggcaaatgaactttaagaggctaacactaacagacattaaaattgacatcaaaagagtcccaaacaagaaaacccttattgctgcaatggaggctgctgatgtcaagaacaagtgggaaaagagctcgtggggaagaaaacttattgttcaaaagaagagagcatcacttaatgattttgataggttcaaaattatgttggtcaaagataaagaaggcgggagttgttaggcaagagctcgccaagctaaagaaggagaccgcttgatttgcacaacgatcaagatttatcagaattttggtgcagtttattaaaattgttgttgagtagacagaccattgtaggatttcatgtctgacctttttccatgtttgctggtatcgttttttgttttacatgtttctttatgtcttatgcattttattcaag

SEQ ID NO: 651 - DNA, 1606 bp, Primula obconica
caaaggaaaaacccaaaaataccaattattccaaacagtagctaagctgcagtctgcttcttcagctttgcaagttcctgcctcacaactccagccttcttgatttttgcaagcataatcttgaacctatcgaagtcgttgagggaagccctcgtcttctgcacaatgagtttccttccccaagagctcttttcccatttgttcttaacatcagcagcctccatggctgcgatcaaagtcttcttgtttggaaccctcctgatttcaatcttgatgtctgtgagcgaaagcctcttgaagttcatctgagtgcgaaccatatctggagaatcgacaagagccctattttgatcgatgacgtcaacaatgacgacgagctgaccgtaatctttgccgtagttgacgagtgccactcttccgatctccacgtatctcttgaacggcattttgggtgctgggtctttgagagggagagagacagagactgaagccgaaagaggatttttacttcggccgtaatgcccattacggccgaaaacacctcaactactccacttcaaattctacataaccaaaaatgagtcttcatattctaaaacttgtttgtttcctagcgatagcgctcgccgcctctgcgcagccacagtgtggcagggacgtagggggcaagctgtgcgctggcgggttgtgctgcagccagtatggatactgcggcgacacatccgaatactgtggcacgaactgccaaagccagtgcggcggcagcccgacacctgggggcggtgttgggagtctcatttcaaaagcgcagtttgaacagctgctcttgcatcgcaacgataacgcttgccctgccaggaatttctacacgtatgaggcttttgtatctgcggcgaattcctttggcggatttgcaacaactggagacaccaacacgagggaaaaagagattgcggctttccttggccaaacttcgcatgaaaccactggtgggtggccttcggcacccgatggaccatactcttggggttattgtttcaaggaagagcaaggtaaccctccaaattactgccaaccgagttctcaatggccttgcgcagctggcaagagttattatggccgtggaccaatccaaatttcctacaactacaactatggaccggcaggaagagcgataaatagtgacctcttgaacaatcctgatcttgtggaaaacaacgcagttatctctttcaagactgctttttggttctggatgactccacaatcgccaaagccttcgtctcacgacgttatcaccggaaggtggaccccatctgctgccgataacgcagcaggaagagtcccaggatatggagtgatcacaaatatcataaacggagggcttgaatgtggccgtggcactgacccaagggtccaagatcgtatcggattctacaggagatactgtcaaatattgggagttgaccctggggccaaccttgactgcgcaaaccaaaggccatttgggtcttaaaattgggcgttaacattattgaataagaagcacaactgagtgttgtgcaacgcacaagttgccattgtactaaataagtgcactgaataa

SEQ ID NO: 652 - DNA, 675 bp, Primula obconica
aaaatcctctttcggcttcagtctctgtctctctccctctcaaagacccagcacccaaaatgccgttcaagagatacgtggagatcggaagagtggcactcgtcaactacggcaaagattacggtcagctcgtcgtcattgttgacgtcatcgatcaaaaatagggctcttgtcgattctccagatatggttcgcactcagatgaacttcaagaggctttcgctcacagacatcaagattgaaatcaggagggttccaaacaagaagactttgatcgcagccatggaggctgctgatgttaagaacaaatgggaaaagagctcttggggaaggaaactcattgtgcagaagacgagggcttccctcaacgacttcgataggttcaagattatgcttgcaaaaatcaagaaggctggagttgtgaggcaggaacttgcaaagctgaagaagcagactgcagcttagctactgttttggaataattggatttttgggtttttcctttgtattttcattatctcaaactaaagagaccgttttttttttctggatcaagtcttttctaaatttattggttactatcttttggtactaaatttgttctttcatttgtgtaaggactaagagcattctcaccactcaatagtcttatacatgtataggacatacagattt

SEQ ID NO: 653 - DNA, 969 bp, Cannabis sativa
aagagaagcccaaacatttctctccatttcagtagaaccctaaatataagtttgatccgaactggtagactataaaagaagctctatagaaaaaccctaatctcttaacactttatattcgtgtcttcgtcctcttgcttccgcctcttacacctctcaccttcacacacaccactcatccaaaatgccgttcaagaggtacgtggagatcggaagagtggctcttgtcaactacggaaaggactatggccagcttgttgttatcgtcgacgtcattgatcagaaccgggctcttgtggattctcccgacatggtgaggtcacagatgaacttcaagaggctttccctcactgatatcaagattgacatcaagagggtccctaagaagaaggaacttcttgcggccatggaagctgctgatgtaaagaagaagtgggagaacagctcctggggaagaaaattgattgtccagaagagaagggcagccctcaatgacttcgatcggttcaagcttatgttggcgaagattaagaaatctggacttgtcaagcaagagctcgctaagttgaaaaaggccaatgcataaacatttgttattgagtatttaaaattttgttttgagctttcaaaaaattctatctttggttgttagccttgtttcagatcagtttaagttttggatattgttgaaggattgaaggagacatattactggttttgtctttcaacttaaattaccatcttttaatgtagaattttttgttgtttctcttttacttatctattggttgatgtttgtctagttttgttatatgattcgaaacactatttaaaaccgttttaatttaccagtattagaacttaattttcttaatgatttatccatcattttcttattgtaatgatttattcttaacaaaaatttctgtgtgaacatcaagcaaccattgttagaaagcttacctaata

SEQ ID NO: 654 - DNA, 750 bp, Allium cepa
ccgccacaactcaaatccctgaacagcttacttttggaaaaaatgcctttcaagcggtatgtagagattggtagagtagctcttgttaattatggcaaagattacggcaagcttgttgtgattgtcgacgtcgttgatcaaaatagggctctagttgatgcacctgacatggttcgagggcaaatgaacttcaaaaggctgtcccttacggattttaagattgaaattccaagaaccccaaagaagaaagtgctcattgaggccatggaaaaagctgacgtgaagaacaggtgggagaagagtagctggggaaggaagctcattgttcagaagaggagagctgaattgaccgattttgacaggtttaaggtgatgctggcgaagattaagaggggaactgctgtcagacaagagcttaacaaactcaagaaagcggctgcttaagttattttttgtgtgtttaatttggatttgatggttgtactggattttttgtttcttggttcctgttttacagtcgaacatttcttagtatcttgtagcaaagttggactaaaatgcatttgctgagtaatatctttttattctgagcattgctcatcttctgtgttgtgcataatgtgggatgcgatgctcatctttggtaatgtcatttgttttaatatctcccgtgctagattgttagtcctttagtcatcctaattgtgagaaaatttataatttctttaaattattttttgtgcttatctg

SEQ ID NO: 655 - DNA, 684 bp, Plantago ovata
caaaccctcaatctctctttccgcctctaccgcatcggagctttgcaggaagacaaaaatgccgttcaagaggtacgttgagatcggaagagtcgctcttgtcaactacggcaaggactatggccagctcgttgtcatcgttgatgtcatcgaccagaacagggctcttgtggatgcacctgatatggagaggacccagatgaacttcaagaggcttcaactcacagacattaagattgacattcgaagggttcccaagaagaaagcactagttgccgctatggaggcagctgatgttaagggcaaatgggagaagagttcatgggggaggaagctcatagtccagaaaagaagggcggctttgaacgactttgatcgatttaagctaatgttggctaaaatcaagagggccggtgttgtcaggcaggagcttgcgaagctgaagaaggctgcagcttgagaatttcctcctcgcctggtttagagggtttcaaatttgtgttggtctacttttgagtaccttgttatggaaacatgtcacagaaggattagtgattttgcgtattatattatgaaccccttaattaattgccagttgatttttgcttaaatgtctttcctgtttgttcctaacctaggtatcttatactccattatttccctaaaaatggttccgatctagtc

SEQ ID NO: 656 - DNA, 647 bp, Phaseolus coccineus
ctcctcctttcatcacttcggcagcagtcacagaaccctcgtagccgaaaatgcctttcaagaggtacgttgagattggaagggtggctcaggtcaactacggcaaagagtatgggaggctagtagtcattgtcgatgttattgaccagaacagagctcttgtggatgctcccgacatggtgaggtcccaagtgaacttcaagaggctgtcactcactgacatcaagattgatatcaagaggattccaaagaagaaggatctcatccaagccatggatgctgctgatgttaagaacaggtgggagaaaagttcatggggaaggaaactgattgtgcagaagagaagagcatctctcaatgactttgacaggttcaagattatgttggcaaagatcaagagggcatcagttgttaggcaagagcttgctaagctgaaaaagagtgcttaggcataattccatgcaatttcctaattttgttatgaatttctttcaatttagtttactttggttacatgggttttattatgtatcattgacagattttctagaaatttttattttgagatcctttttgttactagtggattgatgcctgttttcgtaatctcattgttataatatggggtgcctatttttgcactgttc

SEQ ID NO: 657 - DNA, 679 bp, Centaurea maculosa
cttcatcgccaccgtctcctccatcctccacggcgctctgcaaccgaagaacgcctgaaaatgccgttcaagaggtacgtcgagatcggaagagttggactcgttaactacggaaaggattatggaaagctcgtcgtcatcgtcgacgtcattgatcaaaacagggctcttgttgatgcccctgacatggtgaggagccaattgaacttcaagaggctaacactcacagacatcaagatcgacatcaaaagagttccaaacaagaaaactcttattgctgctttagaggctgccgatgtgaagaacaagtgggaaaatagctcgtggggaagaaagctcatcgttcaaaagaagagagcctcacttaacgatttcgataggttcaagatcatgttggcaaagattaagaaggcgggagtcgtcaggcaagagctagccaagcttaagaaggagaccgcagcgtgatttgttatttgtggtcgaattgtttttgagtagattcgtgttgtttttgtaggagcttgtgtttaatttttttacaagtgattgttggaattttggccaactcaattttgaactttctttaaaaaagaagacaatttgaatagaagaaaaaataggatatagaatccagtaattatacaagacatcctaaggatattattcatttctatggctt

SEQ ID NO: 658 - DNA, 841 bp, Vigna unguiculata
agatagtgttccaccacccacccatccaccgtctctgcctctctgcaattcaagccgaaaatgcctttcaagaggtacgttgagatcgggagggttgctctcgtcaactacggcaaggaatatgggaagctcgtcgtcatcgtcgacgtcattgaccagaacagagcacttgtcgatgccccagatatggtgaggtcccaagtcaatttcaaaaggctttccctaaccgatattaagattgacattaagagggtccccaagaagaaagatcttgttaaagccatggaggctgctgatgttaagaacaaatgggagaacagctcatggggcaggaaactcattgtcaaaaagagaagggcagccctcactgacttcgacaggttcaagctaatgttggccaagattaagagggcagctgttgtaaggcaagaactctctaagctgaaaaagagcgcgtaggcattacttcacgatataatgttcaaattttgttatgaattttacatttggtatgagattttatgtatcatcgagacacttggagaaaagtttcatcttcagatatttatgttaggatttatgatataacttgaaatcttgttggttttataatatttatgattggcaattgttttgctccctcagttacatactgattaatataggtgttgaaatttgatatttctgccctctgctatgtacaactggagtgattctacagtaattgctatgcagttagattatcccagttaaatttcttgatccatcattggaatgtcttgattgatatgtaaattggccgatgtgcttttattttcatatattggtgattaaaacgccc

SEQ ID NO: 659 - DNA, 843 bp, Vigna unguiculata
gctagatagtgttccaccacccacccatccaccgtctctgcctctctgcaattcaagccgaaaatgcctttcaagaggtacgttgagatcgggagggttgctctcgtcaactacggcaaggaatatgggaagctcgtcgtcatcgtcgacgtcattgaccagaacagagcacttgtcgatgccccagatatggtgaggtcccaagtcaatttcaaaaggctttccctaaccgatattaagattgacattaagagggtccccaagaagaaagatcttgttaaagccatggaggctgctgatgttaagaacaaatgggagaacagctcatggggcaggaaactcattgtcaaaaagagaagggcagccctcactgacttcgacaggttcaagctaatgttggccaagattaagagggcagctgttgtaaggcaagaactctctaagctgaaaaagagcgcgtaggcattacttcacgatataatgttcaaattttgttatgaattttacatttggtatgagattttatgtatcatcgagacacttggagaaaagtttcatcttcagatatttatgttaggatttatgatataacttgaaatcttgttggttttataatatttatgattggcaattgttttgctccctcagttacatactgattaatataggtgttgaaatttgatatttctgccctctgctatgtacaactggagtgattctacagtaattgctatgcagttagattatcccagttaaatttcttgatccatcattggaatgtcttgattgatatgtaaattggccgatgtgcttttattttcatatattggtgattaaaacgcc

SEQ ID NO: 660 - DNA, 630 bp, Mesembryanthemum crystallinum
ctctcttgcagtcgtctgagcttcagcgaaaaaccctaagcttgcgaaaatgccgttcaagaggtatgtagagctcggaagggttgcccttgtcaactacggaaaagagtatggccgactcgtcgtcatcgtcggcgtcctcgaccagaacagagttcttgttgatgcccctgatatggttagaggccagatgaatttgaagaggctgtccttgactgatatcaagattgacattgagaaagcaccatcaaagaagacattgattgaggccatggaggctgctgatgttaagaacaagtgggagaacagctcttggggcaggaagttgattgttcagaagagaagagccaaccttaatgactttgacaggttcaagatcatgttggctaagatcaagaaagctggagccgtgaggcaggaactcgcaaagttgaagaagcaagcagcataagaagtggttgtggtgtaggattcatgattttgtcagttagtggttttaaacaatatgcttcgtagtaccattgtcctccgttttgaatcttatacaattcgatgtggtggttttgaatcttatatatgtttccaaattttgttgaatttgagtattatatagtttgatggtgggttcgc

SEQ ID NO: 661 - DNA, 626 bp, Lactuca sativa
caccactagtgtctcaaccattcctctcggcgctccacatccagggcttcaaaaatgccgttcaagaggtacgttgagataggaagaatcgcccttgtcaactacggaaaggattatggaaggctcgttgttatcgtcgatgtcatcgatcaaaacagggctcttgtggatgcacctgacatggttaggggtcaaatgaacttcaagagactaactctcacagacatcaagattgatatcaacagagtcccaaagaagaaaactcttgttgctgctttagaggcagctgatgttaagaacaagtgggagaacagttcatggggaagaaaacttattgtccagaagaagagagcctcacttaatgattttgacaggtttaagatcatgttggcaaagattaagaaagctggagttgtaaggcaagagctagcaaagcttaagaaggaaaccacagcttaatatcttgattttgtttctaattatcaaagattttgttgaacttatgaggaagccattgttggttgcttagaagctttgtggttctttttacattttttctctcccatgtattttattaaaagaaaccttattgcaagattttagcttttgttttcgttggaagtacc

SEQ ID NO: 662 - DNA, 660 bp, Nuphar advena
cccgaagccgtcagccatgcctttcaaacggtatgtggagatcgggagggtggcgatgataaattacgggaaggagtacggcaggctcgtcgtcatcgtcgatgtcatcgaccagaatcgggctcttgttgatgcacctgatatggtgaggagccagatgaatttcaagagacttgccttgactgatatcaaagttgacatcccgaggatccccaaaaagaagtccttgattgcagcaatggagactgcagatgtcaaaaacaagtgggagaacagctcatggggtaggaagttaattgtgcagaaaaggagagcttcgctcaatgattttgacaggttcaaggttatgttggcaaagatcaagagggctagctttatcaggcaggaactatcaaagttgcaaaaggacagtggggcgtgaaaagggatgcatatcaatttttgatttcttggttcttttttagttcatagggaatgattatggagagctggacttgttatttgttgtgtttttgcttcaaattgagtattagggtgcttagcagtaaaacaaatggatgattttctctctatatttcggtctgccactaattcaattctagaaacttttgtctaacaatgcttttatagtaatgaatctacgagactcatttcagatat

SEQ ID NO: 663 - DNA, 739 bp, Allium cepa
tcaaatccttgaacagcttacttttggaaaaaatgcctttcaagcggtatgtagagattggtagagtagctcttgttaattatggcaaagattacggcaagcttgttgtgattgtcgacgtcgttgatcaaaatagggctctagttgatgcacctgacatggttcgtgggcaaatgaacttcaaaaggctgtcccttacggattttaagattgaaattccaagaaccccaaagaagaaagtgctcattgaggccatggaaaaagctgacgtgaagaacaggtgggagaagagtagctggggaaggaagctcattgttcagaagaggagagctgaattgaccgattttgacaggtttaaggtgatgctggcgaagattaagaggggaactgctgtcagacaagagcttaacaaactcaagaaagcggctgcttaagttatttttgtgtgtgtttaattttggatttgatggttgtactggatttttgttttcttggtttcctgttttacagttggaacgtttcttagtatcttgtagcaaagttggactaaaatgcatttgctgagtaatgtcttcttattctgagaattgctcatcttctgcgttgtgcataatgtgggatgcaatgctcatctttgataatgtcatttgttttaatttctcccgttctagattgttagtccttcagtcatcctaattgtgagaaaatttataatttctttaaattatattttgtgctt

SEQ ID NO: 664 - DNA, 724 bp, Allium cepa
aactcaaatccttgaacagcttacttttggaaaaaatgcctttcaagcggtatgtagagattggtagagtagctcttgttaattatggcaaagactacggcaagcttgttgtgattgtcgacgtcgttgatcaaaatagggctctagttgatgcacctgacatggttcgtgggcaaatgaacttcaaaaggctgtcccttacggattttaagattgaaattccaagaaccccaaagaagaaagtgctcattgaggccatggaaaaagctgacgtgaagaacaggtgggagaagagtagctggggaaggaagctcattgttcagaagaggagagctgaattgaccgattttgacaggtttaaggtgatgctggctaagattaagaggggaactgctgtcagacaagagcttaacaaactcaagaaagcggctgcttaagttatttttgtgtgtgtttaattttggatttgatggttgtactggattttttgttttcttggtttcctgttttacagttggaacgtttcttagtatcttgtagcaaagttggactaaaatgcattttgctgagtaatgtcttcttattctgagaattgctcattcttctgcgttgtgcataatgtgggatgcaatgctcatctttgataatgtcatttgttttaatttctcccgttctagattgttagtccttcagtcatcctaattgtgagaaaatttataatttc

SEQ ID NO: 665 - DNA, 826 bp, Arachis hypogaea
ggggaacaaaaaccctagctcttcatcatttctccattcggttttggagcttcagcagcagcagcagtcacaggaaaacttcacctccgaaaatgccgttcaagaggttcattgagattggaagggttgctcagatcaactacggcaaagagcatgggaggctagtagtcattgttgatgtcatcgaccagaatagggctcttgttgacgcccctgatatggtccgatcccaagtgaatttcaagaggctctcgctcactgatcttaaggttgatattaagagggtccccaggaagaaggaactcattaaggccatggaggaagctgatgtcaagaacaagtgggagaagagctcttgggggaggaaactcattgtccagaagagaagggcatccctcaatgacttcgacaggttcaagattatgttggctaagatcaagagggcagcaactgttaggcaagagcttgctaagctcaagaagagtgcatcttaagcattttttacttgaaattttcaaattttgttatgaatttcgatcagatagtacaccttggttgttatgagattatgtatgttattgacagatttcctaagaagttctattgcgatatttttgttagtggattgatatcagaacttcctctctcattgttgaaagtcgttagttgcaatcgcattacaaaaaagccatttgcctgcatgtttgtgcaattgataacttgactagctttgatatcatggtagtcatggatgtcatatgcattaggaggtgctgtgtaattaaatctatttcaatcacatattgaactgataggagttagtagg

SEQ ID NO: 666 - DNA, 744 bp, Populus trichocarpa
accaatgtaaagagacacgtgtaaacatccaataacccccccgagagcaccacaacctaaacgaaaaaccctagaagcaggtcttctagtatttcataacctcggtgctcacagccctctcctctccctcagcagtcgcctctctccgtcgagtttttgcagatctgccaaaaatgccgttcaagaggtacgtcgagattgggagagtggctcttgtcaactacggcaaggattacggcaagctcgtcgttattgtcgatgtcatcgatcaaaacagggctctagttgatgccccagatatggttaggagccaaatgaacttcaagaggctttcgcttactgatatcaagattgagatcaacagggttcctaagaagaaggcactaattgaagccatggagaaggctgatgtgaagaacaagtgggagaacagttcatggggcaggaggctcactgtgcagaagagaagggcatcacttaatgattttgataggttcaagctcatgttggcaaagatcaagaaggcaggaatcgtcaggcaggagcttgcaagactcaaaaaggaagcagcctaagatttgttcacttctgagcttttcattattttacaagttccaaacttcgcatcagttttagcattttgggttttcctttctggcttttgatcaatttcctagttagtggcagaaaccaattgttatggatcttgttatgaaagaacattaatgatttttctagacttcc

SEQ ID NO: 667 - DNA, 665 bp, Populus trichocarpa
cgctactaatattacataacctcgctggtcacctctctccttcacctcagcggtcgcctctctctctgtcgattctcagcagatccgccaaaaatgccgttcaagaggtacgtggagattgggagagtggctcttgtcaactacggcaaggattacggcaagctcgttgttatagtcgatgtcatcgatcaaaacagagctctggtagatgctccagatatggttaggagtcaaatgaacttcaagaggctttcactcactgatatcaagattgagatcaacagggttcccaagaagaaggcactaattgaagccatggagaaggctgatgtgaagaacaagtgggagaacagttcatggggcaggagactcactgtgcagaagagaagggcatcacttaatgattttgataggttcaagctcatgttggcaaagatcaagaaggcaggaattgtcaggcaggagcttgcaaaactcaaaaaggagacagcctaagatttgttcacttctgagcttttcgatagcttaaaagttccaaaatttgctccagttttactgttttatgttgtttttttttggcttttgattattttcatagttagtggcggaaaccaattattatggatcttgttacgaggaaacattaatgatatttctagacttgc

SEQ ID NO: 668 - DNA, 688 bp, Rosa hybrid cultivar
cacacactagtcatttgtctccgacgaccgactgctctcagatcccggaaaaatgcctttcaagaggtacgtggagatcgggcgggtggctctggtcaactacgggccggactacggcagactcgtcgtgattgtcgatgtcatcgaccaaaatcgggctctggttgatgcacctgatatggtgaggacccagatgaacttcaagaggctatcacttactgatatcaagattgagatccccagggttccgaagaagaagactctgattgctgccatggaggctggtgatgttaagaacaaatgggaacagagttcatggggaaggaagctgatagtgcagaagagaagagcgtcgcttaatgatttcgataggttcaagctcatgttagccaagatcaagaaagctggaatcgtcaggcaggagctaacaaagctgaagaaatcaagtgcagtctgaaactgttttaagttttgcaatcttgttgcaagatattgggttgctgctgttttgattcatagtggtagcagcatcttggtattttggttaggtcatagttgtgagaggcacgttctttgaaatgattggcaggttatcactattttatgaatttgtttgaattgaaatggaagccagtaactttctttgaggagttgatagttatttttataatattattgttacatttta

SEQ ID NO: 669 - DNA, 643 bp, Carthamus tinctorius
gcggggactttatcatcttcatcacagtttttctcggcgatttgcagccaggatctcgaaaatgccgttcaagaggtacgttgagatcgggagaatcgcactcgttaactacggcaaagattatggaaagcttgtagtcatcgtcgatgttatcgatcagaacagagcacttgtcgattcccctgacatggtaaggagtcaaatgaacttcaagagactgacacttaccgacatcaagattgacatcaaaagagttccaaacaagaaaaccctcattgctgctttggaagctgctgatgttaagaacaagtgggagagcagttcatggggaagaaagcttattgttcagaagaagagggcatcactaaatgatttcgataggtttaaggttatgttggcaaagattaagaaagctggtgttgtaaggcaagaattagccaagcttaagaaggagaccgcagcttgatatgggttattttacgataatctttgtcttagtatcaagatttttggtgtagtttccttttttgaatttcatgttgcttatgatcttgtatttttattggattaaatctcagatttgtggccatttttattttggttggtgttctctagtgtctgaatacaatgattttacattacc

SEQ ID NO: 670 - DNA, 637 bp, Glycine max
aacacactcctttataattgcagcgtcgacaaaaaccctaactcctaacctttttttcttcctttcacctcttcagcagtcgttacagagactccataacccgaaaatgcctttcaagaggtacgttgagattggaagggttgctcagatcaactatggcaaagagtatgggaggctcgtggttattgtcgatgtcattgaccagaatagggctcttgttgatgctcctgacatggtgaggtcccaagtgaacttcaagaggctatcactcactgacatcaagatcgatattaagaggatccccaagaagaaggatctcattcaagccatggaggctgctgatgttaagaacagatgggagaagagttcttggggcagaaaactgattgtgcagaagaggagggcatcccttaatgactttgataggttcaagataatgttggccaagatcaagagggcagctgttgttaggcaagagcttgctaagctgaagaaaagtgcatcataggcattatatcatgtgcaattttcaaattttgttatgaatttcattcagttagtactttttggttgctatgagtttttatgtatcaatgagggacatcctagaaatgtttatttttaaatcatttgtgtt

SEQ ID NO: 671 - DNA, 650 bp, Helianthus annuus
accttcatcactaccgcaccaacctttccaacctttcttccggcgcctgcacttttacgactccgaaaatgccgttcaagaggtacgttgagatcggaagaattgctcttgtcaactatggaaaggattatggaaagcttgtcgtcatcgttgacgtcattgatcaaaacagggctcttgttgatgcacctgacatggtgaggggccaaatgaatttcaaaaggctaacactcacagacatcaagattgacatcaaaagagtcccaaataagaaaactctaattgctgctttggaggctgctgatgtcaagaacaagtgggagaacagttcttggggaagaaagcttattgtgcagaagaagagggcatcacttaatgattttgatcggttcaagatcatgttggccaagattaagaaggctggagttgtaaggcaagagctagcaaagcttaagaaggaaaccacagcctaataatggcattttgtttttgttacaaaagatttttctcaactgttgaggaagctattattggttgcctagaagtttgtgttttacctgtttttgttctttctcaatgtatcaaaggaaacctaatggcaagttttaaacttatgttttggttacaatttttatgaaaatgtttttttt

SEQ ID NO: 672 - DNA, 712 bp, Rhizophora mangle
gcccgtttcatccatttggctgctgccgtccctcattttctctctctctaacacagtcacacacctcacctcaactcacgaacttcaaagatgcctttcaagagatacgtggagatcgggagggtggctctcatcaactacggcaaggagcacggcaagctcgttgtcatcgttgatgtcgtcgaccagaaccgggctttagttgatgcgccggatatggtgaggagccaaatgaacttgaagaggcttacactcactgatttcaagattgatattaacagggttccaaagaaaaagaatttgattgaagctatggagaaagctgatgttaaaagcaagtgggaaaacagttcatggggcagaaagctgattgttaagaagagaagggcagctctcaatgattttgataggttcaagttgatgttggctaaaatcaagagggctggattggtaaggcaggagcttgcaaaactgaagaaggcagcttgagagttttcttccatatggagttcccaattttgctattggaaatttcacaagtttctttgtccttttgttttctgatttgtttttccagattaaaaacagttttaatgaagctttttatttatggaagattctgtagctggttctatgttgcatcttttgttcttgatattatatgtttgttgcctacttgctcttttagtggagttttcatgtatttctgttc

SEQ ID NO: 673 - DNA, 640 bp, Cleome gynandra
tttcgctcacgaagccgaagcagctacagtcgcgagctccgtacgtgtagggtttatccatcgacgagaaccaacaatggtgttcaagaggtacgttgagatcggaagagtggctctgatcaactatggaaaggactacgggaagcttgtggttattgttgatgttgtcgatcaaaacagagccctggttgatgctcctgatatggtgaggactcaaatgaacctgaagaggctctcattgaccgacatcaaaatcgaaatcaaccgtgtcccaaggaagaagtcgctcattgaagccatggagaaggctgatgtgaagaacaagtgggagaacagctcgtggggaagaaaactgatcgtgcagaagagaagagcctcgctcaacgactttgacaggttcaaggttatgttggccaagatcaagagagctggattggtgaggcaagaactggcaaagctgaagaaggaaagctcatcctaagccaatggtgtttgagtaactcggttctttttactcatattatgagaatttctgttaaattaagagttttgatgagatctactcctgacattgttctatggttgcattcgaaaaaaggttattttgttcatggattcaatttttattataatcaatctg

SEQ ID NO: 674 - DNA, 718 bp, Mimulus guttatus
attctccgccacctctctcacacagctcgcactctgctgcatctttctccgaaaatgccgttcaagaggtacgttgagatcgggagggtagccctcgtcaactacggaaaggactatggaaagcttgtcgtcatcgttgacgtcatcgaccagaaccgggctctagtggattccccggacatggtgaggagtcagatgaacttcaagaggctttctcttacagacatcaagattgacatcaaaagatcgccgaagaagaagactcttgtagctgccatggaggctgccgatgttaaagggaagtgggaaaagagctcatggggcaggaagttgattgttcagaagagaagggctgctctaaatgacttcgaccgctttaaattgatgcttgcaaagatcaagagggccggtgttgttcgacaggagcttgcgaagcttaagaaagagacccctgtttgattattatagtttctgattttgtcaagattttgtaggattttggaactttgtttatgcagatccttttcttgaatttgtttacagaatggaaatgtctttgaatttttcgtatttaccatttggacttgcttggaagttatttttctctaatttgttgtgatcttggtttttgtagtgatctttatttttctatggagtttatttggttgagccaggggcaaattgtcgctgcttttccaaaaatcactcgattgaaacc

SEQ ID NO: 675 - DNA, 617 bp, Cleome spinosa
tctacgaagccgaagtagccacagtctcgagcttcacacgtttagggtttgttcatcgacgagaatcaacaatggtgttcaagaggtacgtcgagatcggaagagtggctctgatcaactatgggaaggactacgggaagctcgtggttatcgttgatgtcgtcgatcagaacagagctcttgttgatgcccctgatatggtgagaacccaaatgaacctgaagaggctctcattgaccgatatcaaaatcgagattaaccgtgtcccgaggaagaagtctctcatcgatgccatggagaaggccgatgtgaagaacaagtgggagaacagctcgtggggcagaaagctgatcgttcagaagagaagagcctcgctcaacgactttgacaggttcaaggttatgttggctaagatcaagagagctggattggtgaggcaagaactcgccaagttgaagaaggaaagctcatcataagcgcgtagtgttactaagaatttctgcctctttcattttctggattttgattttctgctaaattccagagttcattgcatcttatcttactcccaacattgttatcttttgcatttggattttacgtttttactaaaaaac

SEQ ID NO: 676 - DNA, 586 bp, Salvia sclarea
ctactagaccttggctgtcactcagattcttcaacccctttctatctttctctctcactccacaacccgcctctcctcctccccgcagacaacacttcgccgccaatcatgccgttcaagaggtacgtggagatcggaagggttgccctcgtcaattacggcgaggactacggcaagctcgtcgtcattgtcgatgtcatcgatcagaacagggcccttgtcgattcccccgacatggtacgtagccagatgaacttcaagagactttctcttacagacatcaagattgacatcaaaagagttcccaagaagaaagttctagttgctgctatggaggctgctgatgtcaaaggcaaatgggaaaagagctcatggggaaggaagctcattgttcagaagagaagagcctctctcaatgactttgaccgcttcaagctgatgctcgccaaaatcaagaaggctggtgttgtcaggcaggagcttgcaaaacttaagaaagagaccgcatcttagaaagtttttatttctctgggtttacgcgaatttcttttaggtctttggaatttgttcttgaacacattgcaac

SEQ ID NO: 677 - DNA, 538 bp, Rosa hybrid cultivar
ccaaaaatgcctttcaagaggtacgttgagatcggaagggtggccctcgtcaactacggcgaggactacggcaagctcgtcgtcatcgtcgacgtcatcgaccagaacagagcacttgtggatgcgcctgatatggtgaggtcccaaatgaatttcaagagactttccctcactgacatcaagattgacatcaagagggtcccgaagaagaaggaactgcttgctgcaatggaggctgctgatgtgaagaagaagtgggaaagcagctcttggggtaggaaactgattgttcagaagagaagggcatctcttaatgactttgatcgattcaagctcatgttggctaagattaagagggctgggctggtgaagaacgagctttctaaactgaagaaggaggttgcagcttaagcaatacttcagccttacagttttgtcatggatttccttttaaaacagaaccttggattgtgtacctctgtttttgttaaaaccgattttagatttcagaggaatcatttcaatttttcgtattgtt

SEQ ID NO: 678 - DNA, 810 bp, Aristolochia fimbriata
aggagccagtcccctaaaaccctaactcgctcccgtctctctctctctctcactctcccccatcttgagcagccactgagcgacaatgccgttcaagcgatacgttgagatcgggagggtggctctcgttaactacgggaaggactatggcaagctcgttgtcatcgtcgacgtgatcgaccaaaacagggcccttgttgatgcaccagatatggtgagaggtcaaatgaactttaagaggctttctcttacagacattaagattgatattccaaggatcccaaagaagaagtcccttattgctgccatggaagctgcagatgtgaaaaacaagtgggagagcagttcatggggcaggaagttgattgttcggaagaagagagcttctctcaatgactttgatcggttcaagatcatgctagccaagatcaagagatctagtgcaatcaatcaagagctggccaagttgaagaagcagtctgcgtaggttgtcaaaattttgtttttgaatagacagcgattgtttgatcaattgtcagttttttggctcttaattaaagactgcttgttcttactattactgaaaatagggaagttatatccagtgagagatttgtgccgctagaagttgtctttcgaaatgaattttgtactgaagtttatggcttttttctgcgtctaaatgttgtttagcctacattacacttcccagtgggaatatttggtgggatccacggctttgtgctctctggtaacttgatttaatgttaaaattctaagttacagtgccgataatggcagtcttcaacc

SEQ ID NO: 679 - DNA, 522 bp, Cynodon dactylon
cgtggagatcgggcgggtggctctggtcactacggcaaggactacggccgtctcgtcgtcatcgtcgatgtcgtcgaccagaacagggcacttgtggatgcccccgatatggttcgcagccagataaacttcaagcgtctttctttgactgacatcaagattgacattaagcgtgtccccaagaagtccactttgatcaaggctatggaggaagccgatgtgaaaaccaagtgggagaacagctcatggggcaagaagttgattgtccagaagaggagagcgtctctcaatgactttgacaggttcaaggtcatgttggctaagatcaagaggggtggtgctgtcaggcaagagctttctaagcttaaaaatgaggttgctgctgcttagattgctatgtttgctgacctgttgagattttgatcctcaatgttccaatgtggaatcctgtattgtgcgaattactcgaaagtttattggagcctgttgaaaatttataattttaaacatgtctttttttta

SEQ ID NO: 680 - DNA, 731 bp, Fagopyrum esculentum
aattcacttgtgtccgtctaccttctgtgtttcggctgttcctctttccccgagtttcatcgaagatgccgttcaagaggtacgttgaaatcggaagagttgctcttcttaactacggcaaggactatggcagactcgtggtgatcgttgatgttattgatcagaacagggcacttattgatgccccagacatggtcagaggccaaattaacttcaagaggcttacactgacggacatcaagattgacatccccagagtgccgaagaagaaaaccctcattgaggctatggaggctgctgatgtgaagaacaagtgggagagcagttcttgggggaggaagttgattgttcagaaaaagagagcttccctcaatgactttgatcgcttcaagatcatgttggctaagatcaagaaagctggagcggttaggcaagagcttgcgaagttgaaaaaggctagcgcttagagttaaagatgtcacctatgaaatttcaattttgtgatactattttatttggtgtttgcagtgttggatttaccatatttgttacaagttggggaatgaatggattcttgagcaagaactgagattttgtttagatttaccatcatttgccgatatcatgatgatttgcagtgttggatttaccatattttgttacaagtggctagtgtatacaaatttttgagtccagaagtgctaataatgttaaagtaaattgaagcctgc

SEQ ID NO: 681 - DNA, 739 bp, Linum usitatissimum
gacgataggccagctaaaaccctagatggggagaaagctttaacactcctctgccaatcctcttcagctcctctcgccgccattcatcttccccttcccggctctatcctccctccgactcacttgcagatccgcgaaaatgggtttcaagaggtacgtggagatcggaagagtggccctcatcaactacgggaaggagtacggaaagctcgtcgtgatcgtcgatgtcgtcgatcagaacagggctttggtcgattcaccagatatggtgagaagccagatcaacttcaagaggttgacactcacagatatcaagattgagatcaatagggttcccaagaagaagacgctagttgaagctatggagaaagcagatgtgaagggcaaatgggagaacagttcatggggaaggaagctcattgttcagaagagaagagctgctctcaccgatttcgacaggttcaaggtcatgttggcgaagattaagaggggaggactcatcaagcaggagcttgcgaaacttaaaaaggagtctgcttagattcttcaccttcgttgtttagaccgtttctgttgagaacagtaaatctttgttagttttgatttgtttcttaactgaatgtaagcttagattgtgttttaaatcatggattgaggtgcagtcaaccaacattttgaggcaacgactgtgtcttctctttgttttcgttttacaaatggagctgctaccgcgctacat

SEQ ID NO: 682 - DNA, 661 bp, Linum usitatissimum
tctcgccgccattcatcttccccttcccggctctatcctccctccgactcacttgcagatccgcgaaaatgggtttcaagaggtacgtggagatcggaagagtggccctcatcaactacgggaaggagtacggaaagctcgtcgtgatcgtcgatgtcgtcgatcagaacagggctttggtcgattcaccagatatggtgagaagccagatcaacttcaagaggttgacactcacagatatcaagattgagatcaatagggttcccaagaagaagacgctagttgaagctatggagaaagcagatgtgaagggcaaatgggagaacagttcatggggaaggaagctcattgttcagaagagaagagctgctctcaccgatttcgacaggttcaaggtcatgttggcgaagattaagaggggaggactcatcaagcaggagcttgcgaaacttaaaaaggagtctgcttagattcttcaccttcgttgtttagaccgtttctgttgagaacagtaaatctttgttagttttgatttgttttttaactgaatgtaagcttagattgtgttttaaatcatggattgaggtgcagtcaaccaacattttgaggcaacgactgtgtcttctctttgttttcgttttacaaatggagctgctaccgc

SEQ ID NO: 683 - DNA, 698 bp, Linum usitatissimum
gcctcttgtcaccgcagaacctcgaggaaaatgggtttcaagaggtacgtggagatcggtagagtggcgctcatcaactacggcaaggactacggaaagctcgtggtcatcgtcgatgtcgttgatcagaacagggctctggttgatgcaccagacatggtgaggagccagctgaacttcaagaggctaacactcaccgatatcaagattgagatcaacagggttcccaagaagaagacactgattgaagcaatggagaaagcagacgttaaggggaagtgggagagcagttcgtggggaaggaagctgattgtccagaagaggagagccgctctcaccgattttgacaggttcaaggtcatgctggctaagataaagagaggagggctggtcaggcaggagcttgcgaaactgaaaaagacgtctgcctagatttcaactccactgttttgcccatctgttgagtggtttgcctttgtttttcttgctagcaaattcgtaggactggatgatctattgcattgtattgactattgattgagatacccctggcttttcgagatatcagatgttttgaatattacaagtctcgaaatttcggtgaagtgtctcaccaaatggtagttgatgcagttttgaagtcggaattaatcaacacaacagtatattaagtatacaatccatcccagcaattgacg

SEQ ID NO: 684 - DNA, 729 bp, Guizotia abyssinica
accgtctccaatcgccgcagcctcaattctcctcggcgctctgcaaccggtccaccgaagaaatgccgttcaagaggtatgttgagatcggaagaattgcactcgttaactatggaaaggattatggaaagctcgtagtgatcgtcgatgtcatcgaccaaaacagggctcttgttgatgctcctgacatggttagaggccaaatgaactttaagaggctaacacttaccgacattacgatcgacatcaaacgagttccaaacaagaaaactcttattgctgcgatggaagctgccgatgtcaaaaacaaatgggaaaacagctcatggggaagaaaattcattgttcagaagaagagagcatcccttaacgatttcgacaggtttaaggttatgttggcaaagattaagaaggccggagtcgttaggcaagagctagcgaagctaaagaaggagactgcttaatttgtatgaatgttgagataatgttgcattttatttggttattgtcaagtagaccagtgttggtttttaggtgtttacgtttgacctttagaacttgttatgttcaattttggacatccatatttgccggttttaatgtattttttctacattatactttcatctcaaagctttttgtaagctttattctagtttcagtgtccagcagccaaaaaaactagagtactttttgacacgaccctaacctccatccggaacacgaatg

SEQ ID NO: 685 - DNA, 629 bp, Pisum sativum
cttctgaaacctacggtgtctggtttagcttctcttcaagccgaaactcgaaaatgccgttcaagaggtttgttgagatcgggagagttgcacttgtcaactacgggaaagactatggaaagctagttgttatcgtcgatgttatcgaccaaactagggcccttgttgatgcacctgacatggagaggatcccaatcaattttaagaggctttctcttactgatatcaagattgatatcaagagagtccctaagaagaaggatctcatcaaggccatggaagccgcagatgtgaagaacaagtgggagaaaagctcatggggaaggaaactgattgttaggaagagaagggctgcactgaatgattttgacaggttcaagattatgctggcaaagattaagagagctgccagtgtcaggcaagaacttgccaagctaaagaagactgcagcttaggcgttacttcttgatacatttttcaaattttgttgtcaattttctctattttagtacggatcaaaacacgaggttgcagattcttcccttgagggttagtgccaaaacctcctcgaaaactggttctgtttctcgcaagaaaagaagttctacctcagaagcttctgctggtgg

SEQ ID NO: 686 - DNA, 743 bp, Phalaenopsis aphrodite
ttcgtaaccctactggagcttccagcagatcgcggcagaagtgcgacgttcgtcttccagcagatcgtcatgcctttccagaggtacgtggagatcgggagggtagcgctcgtcaactatgggaaggagtatgggagacttgttgttattgtcgatgtgatcgatcagaatcgagccttagttgatgctcctgacatggttcgaggacaaatgaacttcaagaggctgtcgctgactgatatcaagattgacataccccggattcccaagaagagcaaactgatcgaggctatggaagcagctgatgtgaagaatagatgggagaagagctcttgggggaggaagctgattgtgcaaaagaggagagctgaactgaatgatttcgatagatttaaggttatgttggctaaagttaagagaggagattccatccgacgtgagctttcaaagctaaagaagagtgcttcaaagtgaggcttttgaagaattaatggctgattctgttccaattattgcaggattaagttgagtgtctaccaaccgttgttagaacaagtgtagttttggtcggtgttatgaacttttgtggattctttaaagtttgacgttttgattttgtacctctttgctttattatttgaatgaatttaagagtaatttgtgaaactggtttctgtcaatatgtgattgcaggttctccaacgcaatctacaagttgcattttttattgtttaatatataag

SEQ ID NO: 687 - DNA, 683 bp, Phalaenopsis aphrodite
agctctgtccttggtatgtggtaggttccagcagattggagcagcagccatgcctttccagcggtacgtggagatcgggagggtagcgctcgtcaactatgggaaggagtatgggagacttgttgttatcgtcgatgtcatcgatcagaatcgagccttagttgatgctcctgacatggttcgaggacaaatgaacttcaagaggctgtctctgactgatatcaagattgacatcccccgaattcccaagaagagcaaactgatcgaggccatgcaagcggctgatgtgaagaatagatgggagaagagctcttgggggaggaagctgattgtgcaaaagaggagagctgaactgaatgattttgatagatttaaggtcatgttggctaaaattaagagaggagattccatccgacgtgagctttcaaagctaaagaagagtgcttcaaagtgaggtttttgaagaattaatggctgactctgtttccacaattccaggattaggttgagagtcaaccaaccgttagaacaaatgtagttttggtcggtgttatgaactctgtggattcttaaagtttgatgttttgattttgtacccgtttgcttgttatttgaatgaatttgagaattggattattattatcattccacaggtaaaagtgatttgtgaaactggtttttgt

SEQ ID NO: 688 - DNA, 625 bp, Phalaenopsis aphrodite
gaagtgcgacgttcgtcttccagcagatcgtcatgccattccagaggtacgtggagatcgggagggtagcgctcgtcaactatgggaaggagtatgggagacttgttgttattgtcgatgtgatcgatcagaatcgagccttagttgatgctcctgacatggttcgaggacaaatgaacttcaagaggctgtcgctgacagatatcaagattgacatcccccgaattcccaagaagagcaaactgatcgaggctatggaagcagctgatgtgaagaatagatgggagaagagctcttgggggaggaaactgattgtgcaaaagaggagagctgaactgaatgatttcgatagatttaaggttatgttggctaaagttaagagaggagattccatccgacgtgagctttcaaagctaaagaagagtgcttcaaagtgaggcttttgaagaattaatggctgattctgttcccattattgcaggattaagttgagtgtctgcaaaccgttgttagaacaaatgtagttttggtcggtgttatgaacttttgtggattctttaaagtttgacgttttgattttgtacctctttgctttattatttgaatgaatttaagagtaatttgt

SEQ ID NO: 689 - DNA, 695 bp, Cajanus cajan
ttactagttagtgttccatctcccaccgtctctgccgaaaatgcctttcaagaggttcgttgagatcgggagggttgctctcatcaactacggcaaggactatggcaggctcgtcgtcatcgtcgatgtcatcgaccagaccagagctcttgtcgatgcccctgatatggtcaggtcccaaatcaatttcaaaaggctctccttaaccgacattaaggttgacattaagagggtccctaagaagaaagatcttgttaaagccatggaggatgctgatgttaagaacaagtgggagaagagctcatggggcagaaaactcattgtcaaaaagagaagggcttccctcaatgattttgataggttcaagcttatgttggccaagattaagagggcagcagttgtaaggcaagagcttgctaagctgaaaaagaccgcttaggcagacatagctttcccatatattgttcaaatttttcttattaagttgcttactttggttcatgtatcattgagacactagtgaaaagcttcatcttcagatatttatattagggattggtgacaatactttttaagtttcctagttttgcctttgcttgtgcttgcagatttcttaatattattttttaagataaactttaattgttgcaactgattttcctccataattttatatttttaagttacatctgact

SEQ ID NO: 690 - DNA, 704 bp, Cajanus cajan
gaaaaccctagttactagttagtgttccatctcccaccgtctctgccgaaaatgcctttcaagaggttcgttgagatcgggagggttgctctcatcaactacggcaaggactatggcaggctcgtcgtcatcgtcgatgtcatcgaccagaccagagctcttgtcgatgcccctgatatggtcaggtcccaaatcaatttcaaaaggctctccttaaccgacattaaggttgacattaagagggtccctaagaagaaagatcttgttaaagccatggaggatgctgatgttaagaacaagtgggagaagagctcatggggcagaaaactcattgtcaaaaagagaagggcttccctcaatgattttgataggttcaagcttatgttggccaagattaagagggcagcagttgtaaggcaagagcttgctaagctgaaaaagaccgcttaggcagacatagctttcccatatattgttcaaatttttcttattaagttgcttactttggttcatgtatcattgagacactagtgaaaagcttcatcttcagatatttatattagggattggtgacaatactttttaagtttcctagttttgcctttgcttgtgcttgcagatttcttaatattatttttttaagataaactttaattgttgcaactgattttcctccataattttatatttttaagttacatctg

SEQ ID NO: 691 - DNA, 1433 bp, Plantago ovata
ctactccctcgcttcactccgcctctcacacaccgcctctctctcaatctctgtgaaaaaatgccgttcaagaggtacgtcgagatcggaagggttgctctagtgaactacgggaaggactatggcaccctcgtcgtcattgttgacgtcatcgaccagaatcgggctctagtggattccccagacattgaaaggactcaaatgaacttcaagaggcttcagcttactgacatcaagattgacatcaaacgtgtccccaagaagaaagctcttgttgctgcgatggaagctgctgatgtcaagggtaagtgggagaagagctcatggggaaagaagttgattgttcagaagaggagagctgctctgaatgattttgacaggttcaagctgatgctggccaagattaagagggctggtattgtccgacaggagcttgccaagcttaagaagaccgcggcctaagtattctttttctagtaggatttttaaaaagttgtatcagagatctagacttcttttgttctgggatcatagaaagaaaatatttcagttttgtgctttaaacttgctcacaatgagttcacttgataccttatatttttataatgttgtgagtttgactgtgcttgttgtctcgtacatgatatatccatgaagggtgcttttttcttttttttctgatcttacaaagctctatattgtgacattttccatacacaatcatactcacagttacaaaaatcacatatagcaaaacgttataacgaatataaatctacataaatcccgcacgaattaccacatcaataaaacccaaacaaaagttaagagaccacacgtaccccactagaatccccatcattttgaaaccaaaagaatctcaggcttcttagctttactaggcgtattcacatttgaactggaaccattagcagccgccattgctgcagtcttaaccgcctcacgtgccctattatcaagttgaatcaagctcttagtagccaaaatcgcttgtggaaccaagtcatgcgaagccctagcatacaacctcctcgccgccaatgacgcctcagacttcacctcatcggcattaagcggccccaacaaacaatgccccaatatcctcaacaccggctgcaacaactcccacggcaacggaatcctcaaatcctcccccgaattctcatccacaatatccaaatccctgactctttccaccacactctcaatctcacacccagtgtcatcactgtctagtacactaacctccccaaatccattttcgtgaacctcttcaacgtcgaattcagacgtgcaggggcaatcccgcccgcccaaacggccacgaatttacaaaaatcatgtttagaccagctaggcatttgagagatctgcttatagtaacaatctaatgcaacacctacaatgcaagc

SEQ ID NO: 692 - DNA, 608 bp, Plantago ovata
caaaccctcaatctctctttccgcctctaccgcatcggagctttgcaggaagacaaaaatgccgttcaagaggtacgttgagatcggaagagtcgctcttgtcaactacggcaaggactatggccagctcgttgtcatcgttgatgtcatcgaccagaacagggctcttgtggatgcacctgatatggagaggacccagatgaacttcaagaggcttcaactcacagacattaagattgacattcgaagggttcccaagaagaaagcactagttgccgctatggaggcagctgatgttaagggcaaatgggagaagagttcatgggggaggaagctcatagtccagaaaagaagggcggctttgaacgactttgatcgatttaagctaatgttggctaaaatcaagagggccggtgttgtcaggcaggagcttgcgaagctgaagaaggctgcagcttgagaatttcctcctcgcctggtttagagggtttcaaatttgtgttggtctacttttgagtaccttgttatggaaacatgtcacagaaggattagtgattttgcgtattatattatgaaccccttaattaattgccagttgattttgctta

SEQ ID NO: 693 - DNA, 718 bp, Primula obconica
tagactcgccggagtttccgacccaccagctacaaggccggtgcagtggtgcccattacggccgaaaaccactctctctcatcgtctcagcagcagctctctggtagcactcccaaaaccgaaaatgccgttcaagagatacgttgagatcggaagggtagccctagtcaactacggcaaggattacggccagctcgttgtcattgtcgacgtcatcgaccaaaacagggctcttgttgattctcctgatatggttcgtactcaaatgaacttcaagaggctctcactcacagatatcaccattgagatcaagagggttccgaataagaagactctgattgcagctatggaggctgctgatgtgaagggaaagtgggagaaaagctcatggggaaggaagcttattgtgcagaagaagagggcttctcttaacgacttcgataggttcaaggtcatgatcgccaaaatcaagaaagctggagttgtcaggcaggaacttgctaagctgaagaagcaggccacagcctagggaccaataattggttttgttctcatattgtagttcttttgaagttattggattttggacaacatctctgccttttttttaattagttgtatcgaaactaaagatgccaatgtgttttgtttttatgagtgagaacctcgttttgcttattgttgtggttctgttatctgctacgattattcatgtttt

SEQ ID NO: 694 - DNA, 732 bp, Trigonella foenum-graecum
ccctaacctccctctgagctgtatccaatggaatccccaacaactcaatcatcagctttcacactctctctctctgcttcaaccttgaatctcagaaaccctagagaacaaaatgcctttcaagagattcgttgagattggaagggttgctttgatcaactacggaaaagattatggcagactcgttgttatcgttgatgtcatcgaccaaaccagagctcttgttgatgctcctgatatggagaggatccctataaatttcaagaggctctcactcactgacatcaagattgatatcaagagggtgcccaagaagaaggatctcatcaaagctatggaggcggctgatgttaagaacaaatgggagaagagctcgtggggcagaaaactgattgtgaagaagagaagggcagccctcaatgattttgataggttcaagatcatgttggcaaagatcaagagggcagctgttgttaggcaagagcttgctaagctgaagaagactgcagcttaggcattaaaaattatcatttttgaattttcctatgaatttctttcgattagtacaatcttggtttgttttatgagattctatgtaatcattgagtaacttcctagaaaggtttattttgagtagtgatgtgtaagttctacctagtttgcatctggtttgaaatttttacttttgcttgctgatgatttgcctaatttggttttaatatgttcaaatac

SEQ ID NO: 695 - DNA, 696 bp, Trigonella foenum-graecum
ctctctctctgcttcaaccttgaatctcagaaaccctagagaacaaaatgcctttcaagagattcgttgagattggaagggttgctttgatcaactacggaaaagattatggcagactcgttgttatcgttgatgtcatcgaccaaaccagagctcttgttgatgctcctgatatggagaggatccctataaatttcaagaggctctcactcactgacatcaagattgatatcaagagggtgcccaagaagaaggatctcatcaaagctatggaggcggctgatgttaagaacaaatgggagaagagctcgtggggcagaaaactgattgtgaagaagagaagggcagccctcaatgattttgataggttcaagatcatgttggcaaagatcaagagggcagctgttgttaggcaagagcttgctaagctgaagaagactgcagcttaggcattaaaaattatcatttttgaattttcctatgaatttctttcgattagtacaatcttggtttgttttatgagattctatgtaatcattgagtaacttcctagaaaggtttattttgagtagtgatgtgtaagttctacctagtttgcatctggtttgaaatttttacttttgcttgctgatgatttgcctaatttggtttttaatatgttcaaatactaatagaaatctcaagctgcagatgatg

SEQ ID NO: 696 - DNA, 537 bp, Utricularia gibba
ccgcctaaaatgccgttcaagaggtacgtggagatcgggagggtagccctcgtcaattacgggaaggaatatggaaggctggttgtcatcgttgatgtcattgaccagaatcgggcccttgttgatgctcccgacatggttcggagccagatgaacttcaagaggctctctctcacggacatcaagatcgatatcaaaagggttcccaagaagaaggctcttgtagatgcgatggaggctgctgatgtgaagggaaaatgggagaagagcagctggggaaggaagctgattgttcagaagagaagggccgccctcaatgactttgatcggttcaaattgatgttggccaaaatcaagaaagctggtgttgtgcggcgggagcttgccggcctcaagaaaagcagttctacctgagaattgaaaaaatgttacgcttttgccatttagatttccggaacaagtgtgagaacaaaccttcattcctgttgtttcatggctactttattctctgtttttaccccccaaatagaatttgtg

SEQ ID NO: 697 - DNA, 742 bp, Helianthus annuus
tatctccaactattaaacacacaccctatccaaaaccctaatttccaccatctcaaccgccacaccttcaattctcctcggcgctctgcaactactcgcctgcaaaaatgccgttcaagaggtacgttgagatcggaagaatcgccctcgttaactatggaaaggattacggaaagctcgttgtgatcgtcgatgtaatcgatcaaaacagggctcttgttgactctcctgacatggtgagaggccaaatgaacttcaagaggctaacacttaccgacatcaaaattgacatcaaaagagttccaaacaagaagactcttattgctgctatggaggctgctgatgtcaagaacaaatgggaaaacagctcatggggaaggaaactcattgttcaaaagaagagagcctcacttaacgattttgacaggttcaagatcatgttggctaagatcaagaaagcgggagtcgttaggcaagagctcgccaagctaaagaaggagaccgcttaatttgtatgaatgtcgagattttggtgcactttatttgaattattgttgagtagaccagtgttggtttttaggagtttatgtttcacttcttacaacagattaaggggatgtttagaaccgtttcattcaattttgaacttccatgtttgctggtttgttaaccaggttgtgtttcggattgaaagaaaaaaaaataacattttattaaaaaaaaccttgtcggccgcctgggc

SEQ ID NO: 698 - DNA, 856 bp, Phaseolus coccineus
gtatgtgcttttggcccatttatcacagcacatgttcctttctttataattgcaatttcaacaaaaccctaacttcaaaccttcactcctcctttcatcacttcggcagtcacagaacctcttagccgaaaatgcctttcaagaggtacgttgagattggaagggtggctcaggtcaactacggcaaagagtatgggaggctagtagtcattgtcgatgttattgaccagaacagagctcttgtggatgctcccgacatggtgaggtcccaagtgaacttcaagaggctgtcactcactgacatcaagattgatatcaagaggatcccaaagaagaaggatctcatccaagccatggatgctgctgatgttaagaacaggtgggagaaaagttcatggggaaggaaactgattgtgcagaagagaagagcatctctcaatgactttgacaggttcaagattatgttggcaaagatcaagagggcatcagttgttaggcaagagcttgctaagctgaaaaagagtgcttaggcataattccatgcaatttcctaattttgttatgaatttctttcaatttagtttactttggttacatgggttttattatgtatcattgacagattttctagaaatttttattttgagatcctttttgttactagtggattgatgcctgttttcgtaatctcattgttataatatggggtgcctatttttgcactgttcgattattggtttttgacattattaaaaataccttttgctacaatgcaaatgttatcagaaattgttttttatttttctcattaggatttgatctatttttttcttttgttttttgttttaaattttaa

SEQ ID NO: 699 - DNA, 597 bp, Centaurea maculosa
caacgatctgcaaccaggagcttggaaatgccgttcaagaggtacgttgagatcgggaggatcgcactcgttaactacggcaaagattatggaaagcttgtagtaatcgtcgatgttatcgatcagaacagagcacttgtcgattcccctgacatggtaaggagtcaaatgaacttcaagagactgacactcaccgacatcaagattgacatcaaaagagttccaaacaagaaaacgctcattgctgctttggaagctgctgatgttaagaacaagtgggagagcagttcatggggaagaaagcttattgttcagaagaagagggcatcactaaatgatttcgataggtttaaggttatgttggcaaagattaagaaagctggagttgtaaggcaagaacttgccaagcttaagaaggagaccacagcttgatatgggttattttatgataatctttgtcttaatatcaagattttggtgtagtttcttttttgaattccatgttgcttatgatcttgtatttttatgggattaaatcagatttgtggccatttttatattttggtttgtgttctctagtgctgaatacaatttaca

SEQ ID NO: 700 - DNA, 628 bp, Centaurea maculosa
acgccaacgatctgcaaccagaagctcggaaatgccgttcaagaggtacgttgagatcgggaggatcgcactcgttaactacggcaaagattatggaaagcttgtagtcatcgttgatgttatcgatcagaacagagcacttgtcgattcccctgacatggtaaggagtcaaatgaacttcaagagactgacactcaccgacatcaagatcgacatcaaaagagttccaaacaagaaaacgctcattgctgctttggaagctgctgatgttaagaacaagtgggagagcagttcgtggggaagaaagcttatcgttcagaagaagagggcatcactaaatgatttcgataggtttaaggttatgttggcaaagattaagaaagctggtgttgtaaggcaagaactagccaagcttaagaaggagaccacagcttgatatgggttattttattataatctttgtcttgatatcaagattttggtgtagtttctttctttgaatttcatgttgctaatgatcttgtatttttatgggattcagtcagatttgtggccattttattattttggtttgtgttctcaagtgtcagaatacaatttacatgaccagcaacaacccctttatcat

SEQ ID NO: 701 - DNA, 583 bp, Rosa hybrid cultivar
accctcctccgcctccttcctctcacacactcacacacagcacttcaccacaacccaaaaatgcctttcaagaggtacgtggagatcggaagggtggctctcgtcaactacggcgaggactacggcaagctcgtcgtcatcgtcgacgtcatcgaccagaacagagctcttgttgatgcccctgatatggtgagatctcaaatgaatttcaagaggctttctctcactgacatcaaaattgacatcaagagggtccccaagaagaaggaattgcttgccgcaatggaggctgctgatgttaagaagaagtgggaaagtagctcttggggtaggaagcttattgttcagaagcgaagggccaatcttaatgactttgatcgcttcaagcttatgttggccaagatcaagagggctggcctggtcaagagcgaacttgcaaaactgaagaagcagagtgcttaggcaatatttgatgttaggtttacaattttgtaatgaattttcttcaaaactgtacttcggtttgtaatcccttgttccttatattagtctttttcagagtactatatttgttttttttttt

SEQ ID NO: 702 - DNA, 624 bp, Helianthus annuus
gggaccaccatcttcatcactaccgcaccaaacctttcttccggcgcctgcacttttacgactccgaaaatgccgttcaagaggtacgttgagatcggaagaattgctcttgtcaactatggaaaggattatggaaagcttgtcgtcatcgttgacgtcattgatcaaaacagggctcttgttgatgcacctgacatggtgaggggccaaatgaatttcaaaaggctaacactcacagacatcaagattgacatcaaaagagtcccaaataagaaaactctaattgctgctttggaggctgctgatgtcaagaacaagtgggagagcagttcttggggaagaaagcttattgtgcagaagaagagagcatcacttaatgattttgataggttcaagatcatgttggccaagattaagaaggctggagttgtaaggcaagagctagcaaagcttaagaaggaaaccacagcctaataaaggcattttgtttttgttacaaaagatttttctcaactgttgaggaagctattattggttgcttagaagtttgtgttttacctgtttttgttctttctcaatgtatcaaaggaaacctgatggcaagttttaaacttatgttttggt

SEQ ID NO: 703 - DNA, 685 bp, Malus domestica
aataacaataacaaaaccctaaatccccgaccttgactacacttgctcttctccgctccgcctcctctactgccagagctgtcacaccagaaccagaaaaatgcctttcaagaggtacgttgagatcggaagggtggctctcgtcaactacggcgaggactatgggaagctcgtcgtcatcgtcgacgtccttgaccagaacagggctctggttgatgcccctgatatggtgaggtcccaaatgaatttcaagagactttctctgactgacatcaaaatcgagatcaagagggtccccaagaagaaggaactgcttgctgccatggagactgctgatgtgaagaagaagtgggagaacagctcgtggggtagaaaactggttgttcagaagagaagggcggctcttaatgactttgatcggttcaagctcatgctggctaagattaagaaagctgggcttgtcagaaatgaacttgcaaaactgaagaagcagagtgcagcttaggcaataattttagtttacaattttatcgtggatttctttttcgaaactgtatcggatcttttatcaattttagcttttcagagattttttccgtttctaatatcattgacactgttttgatatatagattttcagtttcctgtatggatgatttgtgttttctgatggggattctgcacc

SEQ ID NO: 704 - DNA, 726 bp, Arabidopsis thaliana
aataatctcttgggcacataaaaatctcttcgccgcacaattgctccaatctgtttcttctagccggccaaaatgggttttaagagattcgtggagattgggagagtggcgctcgttaactacggcgaggattatggaaagctcgtggttatcgtcgatgtagtcgaccaaaacagggcacttgtggatgcccctgacatggagagaatccagatgaatttgaagaggttgtctcttactgacatcgtcattgatatcaacagagttcccaagaagaaggttttgattgaggcaatggagaaggctgatgtgaagaacaagtgggagaagagttcatggggtaggaaacttattgtgcagaagagaagagctgccctcaatgattttgacaggttcaagatcatgttggccaaaatcaagagggctggtattgtgaggcaggagcttgctaagctaaaaagggagatcgctgcttgatttcttaattatgatccattaccaaatcttatttttgcaactgtttttttagtgcaaattatgacaagttgagttttttttagtgcaaattatgatatcaattttgctgattccgggctactaaatagtgaattttttttgctatcggatattattattttagtttagtttttctttctaaagtcttggtctgattggtctggtcatctttttaaaccacctatgaacttcgatctttagtagatgcag

SEQ ID NO: 705 - DNA, 656 bp, Artemisia annua
ggtatcaacgcagtactccgacgggggccgccacataaccaatctgcaaaatgccgttcaagaggtacgttgagattggaagagttggtttggttaactatggcaaagattatggaaagcttgttgtcattgttgatgttattgatcagaacagggctcttgttgatgcccctgacatggtaaggagccaattgaacttcaagaggctaacactcaccgacatcaagattgacatcaaaagagtcccaaataagaagactcttattgctgctttggaagctgctgatgttaagaacaagtgggagaacagttcatggggaagaaagctaatcgttcagaagaagagggcatcacttaatgattttgataggttcaagattatgttggccaagatcaagaaagctggagttgtaaggcaagaactagccaagcttaagaaggagacgacagcatgatgatatggtcttattatcaagattttggtgtagtttgtttaaatgtttatgaatcatttgtttctggattggatttaaatgaaattattttcctgtttggatttctattatgttttctttgatgctatggtttgcttttgatcgttgaaaaagtttagatgtgaagaagatgagatgtttgagagccatttctacagtgct

SEQ ID NO: 706 - DNA, 660 bp, Phaseolus coccineus
aaaccttcactcctcctttcatcacttcggcagtcacagaatcctcgtagccgaaaatgcctttcaagaggtacgttgagattggaagggtggctcaggtcaactacggcaaagagtatgggaggctagtagtcattgttgatgttattgaccagaacagagctcttgtggatgctcccgacatggtgaggtcccaagtgaacttcaagaggctgtcactcactgacctcaagattgatatcaagaggattccaaaaaagaaggatcttatccaagccatggatgctgctgatgttaagaacaggtgggagaaaagttcatggggaaggaaactgattgtgcagaagagaagagcatctctcaatgactttgacaggttcaagattatgttggcaaagatcaagagggcatcagttgttaggcaagagcttgctaagctgaaaaagagtgcttaggcataattccatgtgcaatttcctaattttgttatgaatttctttcaatttagtttactttggttacatgagtttgattatgtatcattgacagattttctagaaatgtttattttgagatcctttgtgttactagtggattgatgccagttttcgcaatctcattcttataatatggggtgcctatttttgcacttgttcgagc

SEQ ID NO: 707 - DNA, 589 bp, Phaseolus coccineus
gctgcagtcgaagccgaaaatgcctttcaagaggtacgtcgagatcggaagggttgctctcgtcaactacggcaaggaatatggcaagctcgtcgtcatcgtcgacgtcattgaccagaacagagcactcgtcgacgccccagatatggtgaggtcccaagtcaacttcaaaaggctttccctaaccgatattaagatagacattaagagggttcccaagaagaaagatcttgttaaagccatggaggctgctgatgttaagaacaaatgggagaaaagctcatggggcaggaaactcattgtcagaaagcgaagggcagccctcactgacttcgataggtttaagctaatgttggccaagattaagagggcagctgtggtaaggcaagaactctctaagctgaaaaagagcgcgtaggcattattttacgatattttacgatataaccttcaagttttgttatgagttttctttactttgggtatgagattttatgtatcattgagcacttggtgaaaagtttcatcttcagatatttatgatataactcaaatctagttgattttataatatttatgattgacaatt

SEQ ID NO: 708 - DNA, 657 bp, Coffea canephora
gaaaccctagagccaacatattcctccgcgtcaactcatcaccactccctccgtagcgcccatcagagatcgccgaaaatggtgttcaagaggtacgtggagatcggaagggtcgctctgatcaactatggcaaggaatacggaaagctcgtcgtcatcgtcgacgtcatcgaccagaatagggctcttgttgatgcccccgacatggtgaggagtcaaatgaatttcaagaggctcactctcacagatatcaaaattgatatcaaaagaattccaaagaagaaggctttggttgctgctttggaggctgccgatgtcaagactaaatgggagaatagttcttggggtagaaagctgattgttcagaagagaagggcctcactcaatgattttgacaggttcaagcttatgctggcaaagattaagaaagctggagtagtaaggcaggagcttgcaaagctaaaaaggcagagtgctgcttgaggaaaatcttcacatcataattgcaatttttgttttagtgcctattttggaaggtgtattgatgtactctcagtttaattttaatagtttatggattactggaaggagagaaacatgctttctttgaccatttttggatggaatttacgatccctcttggagttcttgagtttt

SEQ ID NO: 709 - DNA, 642 bp, Cynara scolymus
cgggacctttcagcttcatcacttccgcctcgataatcttctcggcgctctacacccagggcttgaaaatgccgttcaagaggtacgttgaaatcggaagaatcgcccttgtcaactacggaaaggattatgggaaactcgttgttatcgttgatgtcatcgatcaaaaccgggctcttgttgattcccctgacatggtgagaggtcaaatgaatttcaaaaggctaacactaacagacatcaagattgacatcaaaagagtcccaaacaagaaaactctgattgctgccttggaggctgctgatgtcaagaacaagtgggagaacagttcttggggaagaaagcttatcgtgcagaagaagagagcctcacttaatgattttgataggttcaagatcatgttggcaaagataaagaaagctggagttgtaaggcaagagctagcaaaacttaagaaggaaactacagcttaatatcttcattttgttctactttattaaagactttttattgaggaaaccattgttggttgcttagaagcttgtgtttttatttattgtctcttgtattaaaggaaacctaatttggcagttttgaacttctgttttggttgcaattgttgtgaaactgctttttgcttgg

SEQ ID NO: 710 - DNA, 604 bp, Lactuca sativa
cggggatgtatcatcccaccgtctctgttctcctcggcactgtgcaactggtcgcctgaaaaaaatgccgttcaagaggtacgtggagatcggaagagttgccctcgtcaactacggaaaggattatggaaggctcgtagtgatcgtcgatgttatcgatcaaaacagggctcttgttgactctcctgacatggtgaggggccaaatgaacttcaagaggctaacactcacagatatcaagatcgacatcaacagagttccaaacaagaaaactctcattgctgctttggaggctgctgatgtcaagaacaagtgggaaagcagttcatggggtagaaagctcattgttcaaaagaagagagcatctcttaatgattttgataggttcaagattatgttggcaaagataaagaaggctggagttgttaggcaagaacttgccaagcttaagaaggagactgcatgatcttgtcatttgtgctacagcttatttgaattgttgttgagttgatcagttttggattctaggagcttttgtttgacattttacagatgattgtaagaaactttttccgattcaattttgaacttgtgtatttgcttc

SEQ ID NO: 711 - DNA, 776 bp, Medicago truncatula
tccttcactctctctgcaccttgaatctcagaaaccctagagaacaaaatgcctttcaagagattcgttgagattggaagggttgctctgatcaactatggaccagaatatggtagaatcgttgtcatcgttgatgtcattgaccaaaccagagctcttgttgatgctcctgatatggagaggtcccctataaatttcaagaggctctcactcacagacatcaagatcgatattaagagagttccgaagaagaaggatctcatcaaagccatggaagctgctgatgtcaagaacaagtgggagaagagctcatggggcagaaaactgattgtgaagaagagaagggcagccctcaatgattttgataggttcaagatcatgttggcaaagatcaagagggcaggcgttgttaggcaggagcttgctaagctgaggaagactgcagcttaggcatttattattgatcaatttttgaattttcctatgaatttctttggatacatcttggtgtgttttatgagattctatgtaatcattgagtgacgtcctagaaagatttattttgagagttcatattagtgatgttagttccctcaagttgcatatcggttttgcattggccttttgcttgcttatggtttgcatattttgcttttcaagttgttcttatgctgatagaaatctcaagctgcagaggatgttaactcctgtatttttaatgtcattttttttgcgtctctattgttactgccaatctggtttacacgggtgtaact

SEQ ID NO: 712 - DNA, 798 bp, Medicago truncatula
ccctaattgtgctcttttactttccttcactctctctgcaccttgaatctcagaaaccctagagaacaaaatgcctttcaagagattcgttgagattggaagggttgctctgatcaactatggaccagaatatggtagaatcgttgtcatcgttgatgtcattgaccaaaccagagctcttgttgatgctcctgatatggagaggtcccctataaatttcaagaggctctcactcacagacatcaagatcgatattaagagagttccgaagaagaaggatctcatcaaagccatggaagctgctgatgtcaagaacaagtgggagaagagctcatggggcagaaaactgattgtgaagaagagaagggcagccctcaatgattttgataggttcaagatcatgttggcaaagatcaagagggcaggcgttgttaggcaggagcttgctaagctgaggaagactgcagcttaggcatttattattgatcaatttttgaattttcctatgaatttctttggatacatcttggtgtgttttatgagattctatgtaatcattgagtgacgtcctagaaagatttattttgagagttcatattagtgatgttagttccctcaagttgcatatcggttttgcattggccttttgcttgcttatggtttgcatattttgcttttcaagttgttcttatgctgatagaaatctcaagctgcagaggatgttaactcctgtatttttaatgtcattttttttgcgtctctattgttactgccaatctggtttacacgggtgtaact

SEQ ID NO: 713 - DNA, 688 bp, Prunus persica
taagaaaaaccctaatccccccgcttccattttctcttcttctaagctccgcctcctacttcttcagagctctcacactcacacacctcaccagaaccggaaatgcctttcaagaggtacgttgagatcggaagggtggctctcgtcaactacggcgaggactatgggaagcttgttgtcatcgtcgacgtccttgaccagaacagggctcttgtcgattctcctgatatggtcagatcccaaatgaatttcaagagactttcactcactgacatcaaaattgatatcaagagggttcctaagaagaaggaattgcttgctgcaatggaagctgctgatgtgaagaagaagtgggagaacagctcttggggtaggaaacttattgttcagaagaggagagcatctcttaacgactttgatcgattcaagctcatgttggctaagattaagagggctggcttggtcaagagtgagcttgcaaaactgaaaaaggagacatcatcttaagcaatatcggatattaagtttacaattttgttatggattattttcaaaactgtactctggattgtaatccctttatttttattcgagtttagtttttttcggagctgtttttgttttaaaatattattgacaaaggagctcttttaatgatcaattttctgttgtcctgtgtttccttcca

SEQ ID NO: 714 - DNA, 711 bp, Rosa hybrid cultivar
ggctgcctcttctgcctcacacacactagtcatttgtctccgacgaccgactgctctcagatcccggaaaaatgcctttcaagaggtacgtggagatcggacgggtggctctggtcaactacgggccggactacggcagactcgtcgtgattgtcgatgtcatcgaccaaaatcgggctctggttgatgcacctgatatggtgaggacccagatgaacttcaagaggctatcacttactgatatcaagattgagatccccagggttccgaagaagaagactctgattggtgccatggaggctggtgatgttaagaacaaatgggaacagagttcatggggaaggaagctgataaggcagaagagaagagcgtcgcttaatgatttcgataggttcaagctcatgttagccaagatcaagaaagctggaatcgtcaggcaggagctaacaaagctgaagaaatcaagtgcagtctgaaactgttttaagttttgcaatcttgttgcaagatattgggttgctgctgttttgattcatagtggtagcagtatcttggtattttggttaggtcatagttgtgagaggcacgttccttgaaatgattggcaggttatcactattttatgaatttgtttgaattgaaatggaagccaggaacttctttgaggagttgatagttatttttataatattattgttacattttatgatc

SEQ ID NO: 715 - DNA, 781 bp, Glycine max
gtgttttggcccatgcgtgtgttcctcatctcaactcactcctttataattgctgcgtcgacaaaaaccctaactcttaatcttttttctcttcctttcacctcctcagcagtcgtcagaaagactccataacccaaaaatgcctttcaagaggtacgttgagattggaagggttgctcagatcaactatggcaaagagtacgggcggctcgtgatcattgtcgatgtcattgaccagaatagggctcttgttgatgctcccgacatggtgaggtcccaagtgaacttcaagaggctctcgctcactgacatcaagattgatattaagaggattcccaagaagaaggatctcattcaagccatggaggctgctgatgttaagaacagatgggagaagagttcttggggcagaaaactgattgtgcagaagaggagggcatccctcaatgactttgataggttcaagataatgttggcaaagatcaagagggcagctgttgttaggcaagagctcgctaagctgaagaaaagtgcctaattttcaattttcaaattttgttttgaatttccttcagttagtacattttggttgctatatgaatttttatgtatcaatgagagacatcctagaaatgcttattttgaaatcattcgtgttattggttgatgctagttctcccaatatcattgttagaatatcaggtccgttttggcttttgcttgcagatgtttgaatattggtttttgaaattttataaaaccttgagctaaaattcaaata

SEQ ID NO: 716 - DNA, 822 bp, Glycine max
agtgttagtgttcctcaagccaccgtaccgtgttgcctctctgcaatctacagccaaaatgcctttcaagaggtacgttgagatcgggagggttgcccaaatcaactacggcaaggaatatggcaggctcgtcgtcattgtcgacgtcattgaccagaacagagctcttgtcgatgcccctgatatggtgaggtcccaagtcaatttcaaaaggctttccctaaccgatattaagattgacattaagagggtccctaagaagaaagatcttgtcaaagccatggaggatgctgatgttaagaccaagtgggagaagagttcatggggcaggaaactcattgtcagaaagagaagggcatccctcaatgattttgataggttcaagataatgttggccaagatcaagaaggcagcggttgtaaggcaagagcttgctaagctgagaaagagcgcttaggcatagcttcacattatagtcttcaaatttttgttatgaatttgcttaccttggttgttgtgagatttcatgtatcattgaaccgcttgatttaatgttagtactccaagtttccaatactttgcatttgcttgcatattttataatattatttgtaagatcaacttatattctcaggctgcaagttagagttgcaactggtttttctcccataattttatatttattaagttggctttgtgattagaatgttcggcattgtagtttcaaatttgcgtaacactggtactagggtattcatgaagtgtcttacatgaacatgttctatgtagttaaattagcccgtgtgccgtgtctgctttttt

SEQ ID NO: 717 - DNA, 725 bp, Fragaria vesca
aatcctcgaccatttgcctccgcctccttcctcacaacccttacactctcacacttcaccgcaaccaacaatgcctttcaagaggtacgtcgagatcggaagggtggctctcgtcaactacggcgaggactacggcaagctcgtcgtcatcgtcgacgtcatcgaccagaacagagcccttgttgatgcccctgatatggtgagatctcagatgaatttcaagaggctttctctcactgacatcaaaattgacatcaagagggtccccaagaagaaggaattgctggctgcaatggaggctgctgatgtgaagaagaagtgggaaagtagctcttggggcaggaagcttattgttcagaagcgaagggctaatcttaatgactttgatcgcttcaagcttatgttggctaagatcaagagggctggcttggtcaagagcgagcttgcaaaactgaagaagcagagtgcttaggcaatatttgatgttaggtttacaattttgtaatggattttcttcaaaactgatttcggtttgtaatcccttgttccttctatcaatttctagtctttttcagattgctatattgctgtttactttttcgttattttggcgacaagttgtgaacctcattattttgggtcatgctgtttactatttactgataaccatgtgttttactttgcctagtcataatattttttgcgtgaactttgtttttttgatc

SEQ ID NO: 718 - DNA, 633 bp, Orobanche aegyptiaca
ctccgcctctttctcacacacagcacacacacatctccaaaaatgccgttcaagaggtacgtcgagatcggaagagtggccctcgtcaactacgggaaggactacggcaagctcgtcgtcatcgtcgacgtcatcgatcagaacagggcacttgtggattcccccgacatggtgaggggccagatgaacttcaagaggctttctcttacagacatcaagatcgacatacaaagggtcccaaagaagaaggctcttatagctgctatggaggctgctgatgtcaagggtaaatgggaaaagagttcatggggtaggaagcttattgttcagaagagaagggccgccctcaatgatttcgatcggttcaagttgatgattgctaagatcaagaaggccggtgtggttcgacaagagcttgctaagctcaagaaagagactgttgcttgagtaggatagtttcgtcttttatttaaatattggcttagtgttctcggtattgtatctctttttatcatgcaaaacttgttcctgaattcatcagagaaggggttgtccttaaattttgaatatcatcatttgaacctgtttctatatttttactttccatattttctaatcatgcatttgatttcc

SEQ ID NO: 719 - DNA, 906 bp, Amorphophallus konjac
tcttcgtcttcgtcttcgtcttgtccgaagttgcagaaatggtgttcaagcgctacgttgagattgggagggtggccctcgtcaactacggcaaggagtatgggaggctcgtcgtcatcgtcgacgttgtcgatcagaaccgagttcttgtggactatccggacatcgtcagaggacaaatgaatctcaaaaggctacagctgactgacttcaagattgacattcccagggtgccaaaaaagaagacgcttgttaccgcactagaagaagctgatataaagaacaagtgggagagcagttcctggggtaggaagctgattgtgcagaaacggagagccgctctcaatgactttgagagattcaaggtcatgttggcgaagatcaagcgaggtgctgccatcaggcaagagctcgcgaagttgaaaaaacagaacgcgtcttaggatcgtccgcttacttattaccagttttgatttgtcactgtgttatctatttcctgaggatttgtggttcaagacttttttttgggatatgtttcatttgcaaagccatcgttttctccactttgagatggctggccatttccagagataggtgtcgaaaatcttcccgttaaagaatactctattattttcttattctaacccttggctcagggtacgcatctcgtcttcatcgttgtggatgtggagtgagcacacacccgtgcctccatgctttgtgtgagcggtgagctcacagtttgtctgccacccctccccccgatatatttactctccgagctaacgaataatgtttccagccaattgtacgagataatggtggtggtggaatgcaaattatctactctttagatttgtaaagatgacatggtggtgaaatgattgaaaaggcactgtacagcat

SEQ ID NO: 720 - DNA, 782 bp, Amorphophallus konjac
aaggcctggctagtagctaacaaggcggctgccccttcgtcccctttgcgtccatctccttcccctcccagctgctcctctgcaagctcgccatggttttcaagcggtacgtggagatcgggagggtcgccctcgtcaactacggcaaggagtacgggaggcttgtcgtcatcgtcgatgtcgtcgaccagaaccgagttcttgtcgactatactgacattgtgcgagggcaaatgaacctgaaaaggcttcagctaactgatttcaagattgacattcctcgtgtgccaaaaaagaaaacgttgattgctgcactggaggaggctgatataaagaacaagtgggagagcagttcctggggtaggaagctgattgtgcagaaaaggagagctgctctcaccgactttgagaggttcaaggttatgctggcaaagatcaagaggggtgctgctatcagacaagagcttgcaaagctgaagaaacaaactgctgcttaagttccccttcgaaatttcatcaattttgtcatggatgatgcaacctgtatttgcttggctccagttttcggctaagtcttatcttagagatgtcatttccagatgcttatgctggccggatatatcattctgtagcgtgtttagctgccatttgtgtgggacgtaagttcttgttcttaaagcattgtgagcatgttcgcaactgataaaaattatttaacccgtggttgcggtgtttataacgcaaaacattcattcacttaacatgttggtaagtggatgctc

SEQ ID NO: 721 - DNA, 573 bp, Arnica chamissonis
gtcgcctcggagctctgcaacttctcgcctgaaaaaaatgccgttcaagaggtacgttgagatcggaagaattgcactcgttaactacggaaaggattatggaaagctcgtcgtgatcgtcgatgtcatcgatcaaaacagggctcttgttgatgctcctgacatggtgagagggcaaatgaactttaagaggctaacacttacagacatcaaaattgatatcaaaagagttccaaacaagaaaactcttattgctgctttggaggctgctgatgttaaaaacaaatgggaaagcagctcatggggaagaaaactcattgttcaaaagaagagagcatctcttaatgactttgacaggtttaagattatgttggcaaagattaagaaagcgggagtcgttaggcaagaactagccaagctaaagaaggagactgcttaatttgtatgaatgttgagattttgttgcattttatttcaattattgttgtgtagaccagtcttgttttattcacttttgaacttctatgtttgctggtttattttatgttttcaacatttcacttttcatctcaa

SEQ ID NO: 722 - DNA, 563 bp, Cirsium arvense
tcgctacctccacaacgatctgcaaccaggagctcagaaatgccgttcaagaggtacgttgagatcgggaggatcgcactcgttaactacggcaaagattatggaaagcttgtagtaatcgtcgatgttatcgatcagaacagagcacttgtcgattcccctgacatggtaaggagtcaaatgaacttcaagagactgacactcaccgacatcaagattgacatcaaaagagttccaaacaagaaaacgctcattgctgctttggaagctgctgatgttaagaacaagtgggagagcagttcgtggggaagaaagcttattgttcagaagaagagggcatcactaaatgatttcgataggtttaaggttatgttggcaaagattaagaaagctggtgttgtaaggcaagaacttgccaagcttaagaaggagaccacagcttgatatgggttattttatgataatctttgtcttaatatcaagattttggtgtagtttcttttttgaattccatgttgcttatgatcttgtatttttatgggattaaatcagatttgtggcca

SEQ ID NO: 723 - DNA, 835 bp, Cirsium arvense
gcaaagatccaatccttttccatctatcatcatctcttaccactaaaagtttgtaatctttatttcttttttattttaatttcattatcatccaatggaatcgccggagaaccaccggatacctcttgaaaaagccgaacagatcgttctccggtgggactccaccgtctccgaagaagcgagagctcgtatgatcttcgaaggagatcgacaagagatcgataattacctccaagcaatcgacgaaatccaacgctccatggagtcaacgaccttatccgatgaagattccgatgaccacaaccagtcaaaaaagaaaaaagtaccgactgcgactctgcaaccgaacgcctgaaaatgccgttcaagaggtacgtagagatcggaagagttggactcgttaactacggaaaggattatggaaagctcgtcgtcatcgtcgacgttatcgatcaaaacagggctcttgttgatgcacctgacatggtgaggagccaattgaacttcaagaggctaacactcacagacatcaagatcgacatcaaaagagttccaaacaagaaaactcttgttgctgctttagaggctgccgatgtgaagaacaagtgggaaaatagctcgtggggaagaaagctcatcgtccaaaagaagagagcctcacttaacgatttcgataggttcaagatcatgttggcaaagataaagaaggcgggagtcgttaggcaagagctagccaagcttaagaaggagaccgcagcgtgatttgttatttgtggttgaattgttttccgagtagattcctgttgtttttgtaggagcttgtgtttaatttttt

SEQ ID NO: 724 - DNA, 607 bp, Taraxacum officinale
tcttctcgctacccgccagtcttcatcggcgatctgcatacagaaccgccgaaatgccgttcaagaggtacgttgagatcgggagaatcgcactcgtcaactacggaaaggattatggaaggcttgtcgtcatcgtcgatgtcatcgatcaaaacagggcacttgttgatgctccagacatggtaaggggtcaaatgaacttcaaaagactgactcttacagacattaagattgacatcaatagagtcccaaacaaaaaaactcttgttgctgctttagaagctgctgatgttaagaacaagtgggagaacagttcatggggaagaaagcttattgttcagaagaagagagcttcacttaatgacttcgataggttcaagattatgttggcaaagattaagaaagctggagttgtaaggcaagaactagccaaacttaagaaggagaccacagcatgagatgttgacttttggttttttttttatctgaatattaagattttggtgtagttttattaaatgtttatgaattatttgttgctttatgatattgtgttctatcttttttcaacaatgaaatttttgtttctagaaaaaaaaaaaaaaaa

SEQ ID NO: 725 - DNA, 607 bp, Taraxacum officinale
attctccgcaccgtctctatcctcctcggctctcagcaaccggtcgcctgaaaaaatgccgttcaagaggtacgttgagatcggaagagtcgccctcgtcaactacggaaaggactatggtaggctcgttgtgatcgtcgatgtcatcgaccaaaacagggctcttgttgatgctcccgacatggtgaggggccaaatgaacttcaagaggctaacactcacagatatcaaaattgacatcaacagagttccaaacaagaaaactcttgttgctgctttggaagctgctgatgtgaagaacaagtgggaaaacagttcatggggaagaaaactcattgtgcaaaagaagagagcctctctcaatgattttgataggttcaagattatgctagcaaagataaagaaagcgggtgttgttaggcaagaactatcaaagctgaagaagcagactgcttgaaattgtcatttgatcacaaggttttgctgcagtttatttgaattgttgttgagtagaccaattttgaattctaggagcttatgtttgactttttacaaggtattgttacaaactttttaaatgcaattttgaacttctatatttgcttct

SEQ ID NO: 726 - DNA, 607 bp, Fagopyrum esculentum
gattcggctggtggctcatccaaatctcagcaaaaatgccgttcaagaggttcgtcgagatcggaaggatcgctctcatcaactacggtaaggattatggccagctcgtcaccatcgtcgacgtcatcgatcagaacagagctcttgttgatgcccctaacatggtaaggtgccaaatgaacttcaagaggctcacacttacagacatcaagattgacatccctaggataccaaagaaaaagacacttattgaggcaatggaagctgctgacgtgaagaacaagtgggagagcagctcatggggaaggaagttgatagttcagaagaaaagagctgcactcaacgacttcgacaggttcaagatcatgttggccaaaatcaagaaagctggtgctgtgaggcaagaactcgcaaagttgaaaaaggcagcggcctaagaagatcattatctgttgatttttcccagttctgtttgttttggcctagttttttaactgtattttgctattttccattgaagacccgagcttttcttgatgtgctctactgacttttctattaagagaatcaagcttttcgttgaattacctatatcaatcttagaaat

SEQ ID NO: 727 - DNA, 601 bp, Flaveria ramosissima
gtaccgacggcgcttcacatcgacaacgaaaatgccgttcaagagatacgtcgagatcggaagagtcgctcttgtcaactatggaaaggattatggaaagcttgtagtcatcgttgatgtcatcgatcaaaacagggctcttgttgatgcacctgatatggtgaggggccaaatgaatttcaaaaggcttacactcacagacatcaaaattgacatcaaaagagtcccgaataagaaaactttagttgctgctttggaggctgctgatgtcaagaacaagtgggagagcagttcttggggaagaaagcttattgtgcagaagaagagagcatcacttaatgattttgataggttcaagatcatgttggcaaagatcaagaaagctggagttgtaaggcaagagctagcaaagcttaagaaggaaaccacagcataattagcaaagattttgttgatttgttgagtaagccatttttggttgcttagaagctttgttgtttttaccttttttcttttattgttttttctccatgtatcaaaaggaaaaccttatggcaagtttcgaacttatgatttggttacaattagttaaaaattagtg

SEQ ID NO: 728 - DNA, 539 bp, Flaveria ramosissima
cacacaaacctttaggtcgatggttaaactaaacccaagcattttagccaatcgtaaaccctagctttcatcatctccatcgtcaccgccacattcttcttcggcgatcttccgaaatgccgttcaagagatacgttgagatcgggagagtcgcactcgtcaactacggcaaggattacgggaagcttgtggtcatcgtagatgttatcgatcaaaatagggcacttgttgatgcccctgacatggtaaggggccaaatgaactttaaaagattgacactcactgatatcaatattgacatcaatagagttccaaagaagaaaacacttgttgctgcaatggaagctgctgatgttaagaacaaatgggagagcagttcatggggaagaaaacttatcgttcagaagaagagggcttcacttaatgattttgatcggttcaaaattatgttggccaagataaagaaagctggagttgtgaggcaagaactagcaaagcttaagaaggagacctcagcatgatatggtctagatgatcaa

SEQ ID NO: 729 - DNA, 541 bp, Linum usitatissimum
gcagaaccgcgaggaaaatgggtttcaagaggtacgtggagatcggtagagtggcgctcatcaactacggcaaggactacggaaagctcgttgtcatcgtcgatgtcgttgatcagaacagggctctggttgatgcaccagatatggtgaggagccagctaaacttcaagaggctaacactcaccgatatcaagatcgagatcaacagggttccgaagaagaagacgttgatcgaagcaatggagaaagcagacgttaaggggaagtgggagagtagttcgtggggaaggaagctgattgtccagaagaggagagccgctctcaccgattttgaccggttcaaggtcatgttggctaagatcaagagaggagggctagtgaggcaggagctttccaaactgaaaaaggcgtctgcctagattgccactccactgtgcctttgtttttcttgctagcaattttgtaggactggatgatctattgcattgtattgactatgattgagataccattggcttttggagatatgagatattagcac

SEQ ID NO: 730 - DNA, 551 bp, Guizotia abyssinica
aactttcttcccggcgctccaagaaaatgccggtcaagaggtacgtcgagatcggaagaatcgctctggtcaactatggaaaggattacggaaagctagtagtcatcgttgatgtcattgatcaaaacagggctcttgttgatgcacctgacatggtgagaggccagatgaatttcaaaaggctaacactcactgatatcaagattgatatcaaaagagtcccaaataagaagaccctaattgctgctatggaggctgctgatgtcaagaacaagtgggagagcagttcttggggaagaaagcttattgttcagaagaagagagcatcacttaatgattttgataggttcaagatcatgttggcaaagatcaagaaggctggagttgtgaggcaagaattagcaaagcttaagaaggaaaccacagcctaatggtggcattttgttttcatttattaaagattttgttgaactattcaggtagccattcttggttgcttagaagcttgtatcacaggaaacctaatggcattatggcaagttttaaactca

SEQ ID NO: 731 - DNA, 595 bp, Guizotia abyssinica
atcgtcgtcaatcgccacaacctgtctcctcggcgatctgcaactggtcgcttgaaaaaatgccgttcaagaggtacgttgagatcggaagaattgccctggttaactacggaaaggattatggaaagctcgtcgtgatcgtcgatgtcatcgatcaaaacagggctcttgttgattctcctgatatggtgagaggccaaatgaactttaagaggctaacactcacagacatcacaatcgacatcaaaagagttccaaacaagaaaaccctcattgctgcaatggaggctgctgatgtcaagaacaagtgggaaaacagctcgtgggggagaaaactcattgttcaaaagaagagagcctcacttaatgattttgataggttcaagattatgttggcaaagataaagaaggcgggagtcgttaggcaagagttagccaagctaaagaaggagactgcctaatttgcatgaatatcaagattttggtgctgtttatttaaattgttgagtagagagaacattgttgggtgttaggacttttatgtcttaccttttacaggggggatgtttaaagtgtatcttattcaatttgaact

SEQ ID NO: 732 - DNA, 718 bp, Humulus lupulus
actcttccttcgtccttctcctcttcgcttccgcctcttacagttctcaccttcacacaccgcactcatccaaaatgccgttcaagaggtatgtggagatcggaagagtggctcttgtcaactacggaaatgactacggaaagcttgtagtgatcgtcgacgtcattgaccagaaccgggcccttgttgattctcccgacatggtgaggtcacagatgaactttaagaggctttccctcactgatatcaagattgacatcaagagggtacctaagaagaaggaacttcttgcggccatggaagctgctgatgtaaagaagaagtgggagaacagctcctgggggaggaaattgattgtccagaagagaagggctgctctcaatgactttgatcgtttcaagcttatgttggccaagattaagaaatctggacttgtcaagcaagagctagccaagttgaaaaaagccaatgcatagacatttgttattgaattctcaaaattttgttatgagcttgtttgaattctatcgttggatgttagcctgtttcagatctttttaaatattgttaaaggattgatattctaattgtctttcagtttaaactttaatgtagaatttttgtttggttttgatgaatgttttatctagatgtattctaggatttggatgcacaatttatccattctcaatctaccagtatataaattcagtttctt

SEQ ID NO: 733 - DNA, 612 bp, Lippia dulcis
aataatctgaaatcgaaaaaccctagctagcagcagcacttctatatccgaagaaaccctttcacctgtgcatttgctacctccgcctcttctctctcacttcacacaacacacaacaggaaaatgacgttcaagaggtacgtcgagatcgggagggtggccctcgtcaactacggaaaggactatggccagctcgtcgtcatcgttgacgtcatcgaccagaacagggctcttgttgactcccctgacatggtaagaagccagatgaatttcaagagactttctcttactgacattaagattgacatcaagagggtgccaaagaagaaggctcttgttgcagctatggaggctgctgatgttaagggaaaatgggaaagcagctcctggggaagaaagttgattgttcagaagagacgggctggcctcaatgattttgaccggtttaagcttatgttggccaagatcaagaaagctggtgttgtccgacaagagcttgccaagcttaagaaagagattcctgcttgagtagtatagattttggtttagtatttttgagacttgtattttgtttcctatccttgtggaaattaagagagttatatttggtgt

SEQ ID NO: 734 - DNA, 660 bp, Lippia dulcis
acataagctcgctcaaactccaaactctgcatctcctcctccccagagacgaacgctgctaatcatgacgtttaagaggtacgctgaaatcggaagggtagccctcgtcaattacggcgaggactacggcaagcttgtcgtcattgttgatgtcgtcgatcagaatcgggcccttgtcgattcccctgacatggtacgtagccagatgaacttcaagaggctttctcttacagacatcaagattgacatcaaaagagttccgaagaagaaagctcttgttgctgctatggaagctgctgatgtcaaaggcaaatgggaaaagagctcatggggaaggaagctcattgttcagaagagaagagcctctctcaatgactttgaccgcttcaagctgatgctcgccaagatcaagaaggctggtattgtcaggcaggagcttgcaaaacttaagaaagagactgcatcttagaaagcataagttctgtggtttatgagaatttggcttaggattttggaaattgtccttgaatacttttcaacagtaaggataatcaaattttgcctatttatgtttgaacatgaatatttatatttttgttggttggattgggggcatcatctctcttggtgccattggcacttatcatctttcctctcact

SEQ ID NO: 735 - DNA, 694 bp, Cajanus cajan
tacggggggcccatgtgtgttccccatcacaacacctgttcctttctttataaaattgcaacttcaacaaaaaccctaactcctaaacttctctcttcttttaacctcttcagcagtcacagaaactccgtacccgaaaatgcctttcaagaggttcgttgagattggaagggttgctcagatcaactatggcaaagagtatgggaggctcgtggtcattgtcgatgtcattgaccaaactagagctcttgttgatgctcccgatatggtgagatcccaagtgaacctcaagaggctctctctcactgacattaagattgatattaagagggtccccaagaagaaggacctcattcaagccatggaggctgctgatgtcaagaacaggtgggagaagagttcttggggcagaaaattgattgtgcagaagaggagggcagccctcaatgattttgataggttcaagataatgttggcaaagattaagagggcatctgttgttaggcaagaacttgctaagctgaagaaaaccgcatcttaggcatgatatcatgtgcaattttcaaattttgttatgaatttttctttcagttagtacatttttggttatttcattgactttttatgtatcatttgagagacatcctaggaatgttattcgaggtcttctgtgttagtggattgatgcctgttc

SEQ ID NO: 736 - DNA, 876 bp, Cajanus cajan
aagcatatgaccctagtatggtttggcccatgtgtgttccccatcacaacacctgttcctttctttataaaattgcaacttcaacaaaaaccctaactcctaaacttctctcttcttttaacctcttcagcagtcacagaaactccgtacccgaaaatgcctttcaagaggttcgttgagattggaagggttgctcagatcaactatggcaaagagtatgggaggctcgtggtcattgtcgatgtcattgaccaaactagagctcttgttgatgctcccgatatggtgagatcccaagtgaacctcaagaggctctctctcactgacattaagattgatattaagagggtccccaagaagaaggacctcattcaagccatggaggctgctgatgtcaagaacaggtgggagaagagttcttggggcagaaaattgattgtgcagaagaggagggcagccctcaatgattttgataggttcaagataatgttggcaaagattaagagggcatctgttgttaggcaagaacttgctaagctgaagaaaaccgcatcttaggcatgatatcatgtgcaattttcaaattttgttatgaattttctttcagttagtacattttggttatttcatgactttttatgtatcattgagagacatcctaggaatgtttatttcgaggtcttctgtgttagtggattgatgcctgttcttctcccaatttcattgttagaatatcgggtgtccttttttggcttttgcttgcagacatttgaatattggtttttattatcttgttaaaatcttaagctgcattatgcaaatgtgagcaggaactgctttttaaattttctcattatgatggtcttctgattcgat

SEQ ID NO: 737 - DNA, 638 bp, Fragaria vesca
ttcatttgttctctctctctcttactgacccgacccaccccgccgcaccggaccaaaaatgcctttcaagaggtacgtcgagatcggaagggtggctctcgtcaactacggcgaggactacggcaagctcgtcgtcatcgtcgacgtcatcgaccagaacagagctcttgtggatgcccccgatatggtgaggtcccaaatgaatttcaagagactttccctcactgacatcaagattgatatcaagagggtccccaagaagaaggaactgctggctgcaatggaggctgctgatgtgaagaagaagtgggaaagcagctcttggggtaggaaactgattgttcagaagagaagggcatctcttaatgactttgatcgattcaagctcatgttggctaagatcaagagggctgggctggtgaagaacgagctttctaaactgaagaagggggttacagcttaagcaatactcaggcttacagttttgtcatgaatttctttttaaaaccaaacctcggattgtgtaccttgatttttgttaaaaagattttagatttcagagaaatcattgatatctgttgtattattaatgattgggcaccttcagtttatttttctcaactccctttccaactttt

SEQ ID NO: 738 - DNA, 462 bp, Tripterygium wilfordii
acgcacacttcacaagatccaaaatgcctttcaagaggtacgtggagatcgggcgggtggcacttgtcaactacgggaaagactatggcaggctcgttgtcatcgtcgatgtcctcgatcagaacagagctctagttgatgccccagatatgattaggacccaaatgaatttcaagaggttgtctctaactgacatcaagattgagattaaccgggtgcccaggaagaagaatttgattgaagctatggagaaggctgatgttaagaacaagtgggagaacagctcttggggtaggaagctgattgttcagaagagaagggcgtctctaaatgactttgatagatttaaaattatgttggcaaagatcaagaaatctggattggtgaagcaggagctttcaaaactgaagaaagaaaatgcgtgttaggcaattattataagaacttcccagttttgtttgt

SEQ ID NO: 739 - DNA, 663 bp, Zostera marina
caccggctgttggtttccgttcttcctcttcgagaatgcctttcaaaagattcgtcgagatcgggagagttgcccttgtgaactacgggaaggattatggaagcctcgttgtcatcgtcgacgtcgtagaccaaaatcgagctttggtcgatggtccaggaatggtgaggcaccaggtaaactttaagagactttctcttacagatatcaaaatcgatataaagagaagccccaagaagaagtttcttatcgctgcaatggaggctggggatgttaagaataaatgggagaagagtagctgggggaaaaagctcatcgttcaaaaaagaagggctgcaatgaatgattttgatcggttcaaagtcatgcttgcaaggattaagagatccactgttgttaaccaagaactggccaagctcaaaaaagaggccaaagcttaacctgagtatatgactcgcagattttggtttgctttcagttttaaacatgttaagtttatatttttatttagacaaaaaatcataagacatctcgcataaaatgaatcaaaaactattatttcttgttattttaaatattatttattatttttcttttcacctgtgccgactgccgactgtgcgtttacacagaaataagacatgataaaagttgacaggaaag

SEQ ID NO: 740 - DNA, 989 bp, Phaseolus coccineus
gggagatagggtgataatattaggtttggatctggtgtacgcattgaggcctgtgtttgggtggaaaagaatagagtcggaggcccatgttaacgtggatccgaggttcttttataaaatacccgaagttgtaaacttaaaaccctagattgtgttccaccaccacgcatcctccgtctccccctcgctgcagtcgaagccgaaaatgcctttcaagaggtacgtcgagatcggaagggttgctctcgtcaactacggcaaggaatatggcaagctcgtcgtcatcgtcgacgtcattgaccagaacagagcactcgtcgacgccccagatatggtgaggtcccaagtcaacttcaaaaggctttccctaaccgatattaagatagacattaagagggttcccaagaagaaagatcttgttaaagccatggaggctgctgatgttaagaacaaatgggagaaaagctcatggggcaggaaactcattgtcagaaagcgaagggcagccctcactgacttcgataggtttaagctaatgttggccaagattaagagggcagctgtggtaaggcaagaactatctaagctgaaaaagagcgcgtaggcattattttacgatattttacgatataaccttcaagttttgttatgagttttctttactttgggtatgagattttatgtatcattgagcacttggtgaaaagtttcatcttcagatatttatgatataactcaaatctagttgattttataatatttatgattgacaattgttttcactctccgtagttacatatttattaattaggttttatgattagataggttctgccctcttctgcatacaattcgattgattctacagtaactgctatggatttagattagcccagctgaatttcttgagccatcttattggaatgtcttgaacaggacatgcaatttgctggatatgctcttattctcatatagtttatcagaacgcc

SEQ ID NO: 741 - DNA, 783 bp, Lactuca sativa
gcaaaccctaacttccactatctgcaccactactgcctcaacccttcttctcggcgctccacatccagaactgcaacaatgccgttcaagaggtacgttgagataggaagaatcgcccttgtcaactacggaaaggattatggaaggctcgttgttatcgtcgatgtcattgatcaaaacagggctcttgtggatgcacctgacatggttaggggtcaaatgaacttcaagagattaacactcacagacatcaaaattgacatcaacagagtcccaaagaagaaaactcttgttgctgctttagaggcagctgatgttaagaacaagtgggagagcagttcttggggaagaaaacttattgtccagaagaagagagcctcacttaatgattttgacaggtttaagatcatgttggcaaagataaagaaagctggagttgtaaggcaagagctagcaaagcttaagaaggaaaccactgcctaattatcttgattttgttattaattatcaaagattttgttgaacgtatgaggaagccattgttggttgcttagaaagctttgtggtttttttccccctttttttctcaatgtattttattaaaagaaaccttattgcaagattttagcatttgttttcgctgcaattaccaactgtctgaactattttaggtgggtaaaattttaaaaatatgccccgtgaatatttatttttgtttgtttggcataacatagacatgtgaagtcgaaagagtaattgctccctttctttcgtaaaataaac

SEQ ID NO: 742 - DNA, 666 bp, Lactuca sativa
gcggggtcactatctgcaccactactgcctcaacccttcttctcggcgctccacatccagaactgcaaaaatgccgttcaagaggtacgttgagataggaagaatcgcccttgtcaactacggaaaggattatggaaggctcgttgttatcgtcgatgtcattgatcaaaacagggctcttgtggatgcacctgacatggttaggggtcaaatgaacttcaagagactaactctcacagacatcaaaattgacatcaacagagtcccaaagaagaaaactcttgttgctgctttagaggcagctgatgttaagaacaagtgggagagcagttcttggggaagaaaacttattgtccagaagaagagagcctcacttaatgattttgacaggtttaagatcatgttggcaaagataaagaaagctggagttgtaaggcaagagctagcaaagcttaagaaggaaaccactgcctaattatcttgattttgttactaattatcaaagattttgttgaacgtatgaggaagccattgttggttgcttagaaagctttgtggtttttttttccctttttctctcaatgtattttattaaaagaaaccttattgcaagattttagcatttgttttcgctgcaattaccaactgtctgaactattttaggtg

SEQ ID NO: 743 - DNA, 588 bp, Lactuca sativa
cgcctccgccagtcttcctcggcgatctgaatacagtaaagctgaaatgccgttcaagaggtacgttgagatcgggagaatcgccctcgtcaactacggaaaggattatggaaggcttgttgtcatcgtcgatgttattgatcaaaacagggcacttgttgatgctcctgatatggtaagaggccaaatgaacttcaagaggttgacacttacagacatcaagattgacatcaatagagttccaaagaagaaaacccttgttgctgctttagaagctgctgatgtcaagaacaagtgggagagcagctcatggggaagaaagcttattgttcagaagaagagggcttcactcaatgactttgacaggttcaagattatgttggcaaagataaagaaggctggagttgtaaggcaagaactagccaagcttaagaaggagacagcatgagatatgactttggttgtctttgttctttgttctgaatattaagattttggtgtagttttattttaatgttattgatgaattatttgttgcttatgatcttgtgttttaccctcatttacaatgaaattatatttcatttt

SEQ ID NO: 744 - DNA, 713 bp, Lactuca sativa
cagagtttactctttaccatataaaccctcccatatcgtaaaccctagctttcatcatcttcaacgcctccgccagtcttcctcggcgatctgaatacagtaaagctgaaatgccgttcaagaggtacgttgagatcgggagaatcgctctcgtcaactacggaaaggattatggaaggcttgttgtcatcgtcgatgttattgatcaaaacagggcacttgttgatgctcctgatatggtaagaggccaaatgaacttcaagaggttgacacttacagacatcaagattgacatcaatagagttccaaagaagaaaacacttgttgctgctttagaagctgctgatgtcaagaacaagtgggagagcagctcatggggaagaaagcttattgttcagaagaagagggcttcactcaatgactttgacaggttcaagattatgttggcaaagataaagaaagctggagttgtaaggcaagaactagccaagcttaagaaggagacagcatgagatatgactttggttgtctttgttcttttttctgaatattaagattttggtgtagttttattttaatgttattgatgaattatttgttgcttatgatcttgtgttttaccctcatttacaatgaaattatatttcatttttggacttctattatagtagttacttgaatgcttttgtttgtgtttatagcctttgtcaaat

SEQ ID NO: 745 - DNA, 567 bp, Elaeis guineensis
aaattgctccaatctgtttcttctagccggccaaaatgggttttaagagattcgtggagattgggagagtggcgctcgttaactacggcgaggattatggaaagctcgtggttatcgtcgatgtagtcgaccaaaacagggcacttgtggatgcccctgacatggagagaatccagatgaatttgaagaggttgtctcttactgacatcgtcattgatatcaacagagttcccaagaagaaggttttgattgaggcaatggagaaggctgatgtgaagaacaagtgggagaagagttcatggggtaggaaacttattgtgcagaagagaagagctgccctcaatgattttgacaggttcaagatcatgttggccaaaatcaagagggctggtattgtgaggcaggagcttggctaagctaaaaagggagatcgctgcttgatttcttaattatgatccattaccaaatcttatttttgctaactgttttttagtgtctaaattatgtactaagttgtagtttttttagtgtactaaattatgtatatcaattttgctgtattccggg

SEQ ID NO: 746 - DNA, 661 bp, Euphorbia peplus
gacctgagaatcacacgactagacagcttgaagacgtgcctttacaagaggttcgtcgagatcggaagggtagctctgtcaaactacggaaaggactatggaaagctcgtcgtcatcgtcgatgtcgtcgaccagaaccgagctctagttgatgcccctgatatggtaaggagccaaatcaacttcaagaggctctctctcactgatatcaagattgatatcaacagggtgccaaagaagaggaatttgattgaagcaatggagaaggctgatgttaagaacaagtgggagagcagttcttggggcagaaagttgattgtccagaagaaaagagcatcccttaatgattttgacaggttcaagcttatgatagctaagatcaagagagctggattggtcaggcaagagcttgccaagttgaagaagagtgcagcctagactttaagttagcagttttgttatcatttttgtgcaagttatttttggtatgttatctatttggattttggtttactttggattcgagaaccatttaaaggaaccttcaaatggcagatattttctagctgagtgtcattgtgcaaccttttcttgtacttgaaatgtgggatgtttatcagatttggttggaatgtaggatatgcaagtgttatactcgtgt

SEQ ID NO: 747 - DNA, 578 bp, Flaveria ramosissima
gttacgactgaaaaatagaccgttcaagagtacgttgagatcggaagagttgccctcgttaactacggaaaggattatggaaagctcgtagttatcgtcgatgtcatcgatcaaaacagggctcttgttgatgcccctgacatggtgagagggcaaatgaactttaagaggctaacacttacagacatcaaaattgacatcaaaagagttccaaataagaaaactcttattgctgctatggaggctgctgacgtcaaaaacaaatgggaaaagagttcatggggaagaaaactcattgttcaaaagaagagagcatcactaaatgatttcgactaggtttaagattatgttggcaaagattaagaaggcgggtgttgttaggcaagagctggcgaagctaaagaaggagactgcttaatttgtatgaatgtcaagattttgttgcattttatttgaattactgttgagtagaccattgttggttcttagtagtttatgtttgacctttcgaaagttcttaaaagggatgttagaacctggttttattctaattttgtaactcccactgtttgttggtc

SEQ ID NO: 748 - DNA, 678 bp, Vaccinium corymbosum
ctccctcatcctctcagaccaaaatgccgttcaagcgttacgtcgagatcgggagggtggctctggttaactacggcaaggaatatgggagactcgtcgttatcgtcgacgttatcgatcaaaacagggctcttgtggatgcccctgacatggtgagatgccaaatgaactttaagaggctttctctcactgacatcaccattgacatcaaaagggccccaaagaagaaaacactgattgctgcaatggaggctgcagatgttaagaacaagtgggagaacagctcctggggcagaaagctgattgtgcataaaagaagggttgctcttaatgattttgataggttcaggctcatgttggcaaaaatcaagaggggtggacttatcagaaaagagcttgcgaagctgaaaaaagcagaatgcagcctaggcataacgtttctatgatcatgcccgaattttgttatgatttttcggaaggttgtactgatggctagttttgatttgtttctgtctaatttacagtttgagaaccgtctgtattttattaagagatcccagaatttggttttttggggttggttatagttttcctgatggcaatgcattgtcaaatgaaccaagaacgtttaattgtatggattcagaatagttttaagcccaaaaatggattcagatt

SEQ ID NO: 749 - DNA, 610 bp, Secale cereale
  misc_feature (71)..(71): n is a, c, g, or t
ccacccgtctcctcgccccgccgtctcgccccacgccgcctccgccgccgctgcgaagagccgttcaagangttcgtcgagatcgggcgggtggccctggtgaactacggcaaggactacggccgcctcgtcgtcatcgtcgacgtcgtcgaccagaaccgggcactcgtggatgctcctgatatggtcaggtgccagatgaacttcaagcgtctttcgctcaccgacatcaagattgacatcaagcgtatccctaagaaggcaactttgatcaaggccatggaggaagcagatgtgaaaaccaaatgggagaacagctcatggggtaagaagcttgttgtccagaagagaagagcatcgctgaatgactttgacaggttcaaggtcatgttggctaagattaagaggggtggtgctatcaggcaagagcttgccaagctcaagaaggaggttgctgcttagaatatcttagtgaatggcatgttgagttttttgttccaagttggatctgctctatgttccagtgttcttaaagccagaattagtacaactgttttcagcgaactatttcatattttgtcatggctgttattgaatacccaagctagtt

SEQ ID NO: 750 - DNA, 753 bp, Citrullus lanatus
ttctgtagcctttcaagaggttcgttgagatcggaagagtcgctctcgtcaactatggcgaagactatggaaagcttgtcgtcatcgtcgatgttattgaccagaacagagctttggtggatgctcccgatatggtcagatctcaaatgaacttcaagagactttctcttactgacattaaaattgacattaagagggtccctaggaagaaggaactcattgaagctatgaaggctgctgatgttcagaagaagtgggaggatagctcttgggggagaaaattactcgtgaagaaaagaagggcatctcttaatgattttgataggttcaagcttatgctggctaagataaagagagctggattggtgaggcaagaacttgcaaagctgaaaaaaagtgcatcttagaaagtgcgtttctttagcttcaaattttgttacatgttaaagttatcagttttggattgttttctctcttgtttctctagccctctggagttcgcgattgttttgaggtgtatgggattctagacatccagtgtagtgagtttttatttaactttttcacaagatgtccacattactccaattaagcattaatctgaatcttttgatgtttttctgcctaactgttaaattggattgctgtgccactggatttggtttctgttttctgaattttatgtctgggttgcctgcctttagtgccaatggcattgatgaaatatttcgtaccatagtcatgctagaaaat

SEQ ID NO: 751 - DNA, 3174 bp, Brassica napus
cgcaacctaccggcggcgaaaatggttttcaagaggtacgtggagatagggagagttgcccttgtaaactacggaaaagaccatggaaagctcgtcgttatcgtcgacgttgttgaccagaacagggctttggtagacgcccctgatatggagaggatccaaatgaatttcaagagattgtctcttactgatatcgttattgagatcaaccgagtgccgaagaagaaggctttgattgaggccatggagaaggctgacgtgaagaacaagtgggagaagagctcatggggtagaaagctgatcgttcagaagcgtagggctagcctcaatgacttcgataggttcaagatcatgttggccaaaatcaagaaagctggtgttgtcaggcaagaacttgcaaagctcaagaaggagatcactgcttgagttatattatctgcgaatctgttattgtattttgggttttggattactagcgttttgcaacttatcaaactctgttagtttcagttttgaaacctccttcacaactttcttctttcgtttaatgttaaaaaaccgtttgcgacttcaaaaaaaaacccttctctcctttgccccttggcggctgcggccagcttctcctccttctcatctcttaaaccctagattcgatctcctgactctgtttagggtttctatcttcctctcttttggccgcatccccctttatccgagaaggatctatcaatcaaaccttttgtttctcgaatctgattatcatggctactgttgctgatcaatctgctgatatgttgcagaagctctctttggactcacaagccaaagcttccgagatccctgagcctaacaagaagactgctgtttaccagtatggaggtgtggattcacatggtcaagttcctacctatgaccgttctctgactccattgcttcccagtgatgctgttgacccttctgtttgctatgttcccaatgcttacccgctagttttattatggaggatatgggaatggcgactggagcgaatacactggttaccagaatcctgaaggtgttgacatgagctctggaatttagtggagagaatggctctattgtgtatcctcagagttatgggtatgcggcttatccttactcgccagcgacaagccctggtccacatgttggcggagatgggcagttgtatggtgctcagcagcagtaccagtatcctgcctttttccccacctggagcttttgcttcgtctgttgcgacccctaaccagggagatctctctgcaaacaaagctggtggtgtgaagacagcggaaactaagaatgttgcatctgctactggtatggccaagggaagcaacggagcagttacagggaaaccaaataaccagaccacacataacaccgcaagcaatttgtatggaactggtgctccgggaggaggttttactggtgggtatggttatgatgggttttatgctcctgtgccatgttacgacggctctaagtattcagatgtgcagagatctggtagtggagttgcatcctcctattctaagtcgaccactgtaccatcatcgaggaatcaaaattaccgctcaaattcccattacatgcctgcctcaatgacaggccagggatactacaacagggtgtatcagaacaaggtatatggtagctatggaagctcagggagatctggtacgggttatggttcttctgggtatgattcaagaacaaatggaagaggatgggtgagcacaacagacaacagatacagaaactggggaaggggtaacaattccttctatggaaatgagaacaacgcagatgggtgaatgaacttaacaggggacctagagcgaagggcgcaaagaaccagaaggaaaattcagaagatagcttagaggtgaaggagcagactggcgagtcaaatgtagttgaggctgtggagacagagaacacttgcattgttcctgacagggaacagtacaacaaagaagatttcccagtggattatgagaatgctatgttcttcgtcatcaagtcctacagtgaagatgatgtgcacaagagcatcaaatataatgtttgggccagcacaccaaacggaaacaagaaacttgctgcagcgtaccaggaagctcagcagaaacctggcggctgtcctatctttctctttttctcggtcaatgcaagtggacaatttgttgggcttgctgaaatgacagggccagttgatttcaacacaaatgtggagtactggcagcaagacaagtggacgggctctttccctcttaagtggcatattgtgaaggacgttccaaacagcttgctgaagcacattacccttgagaacaatgagaacaagcccgtcaccaacagtagagacacacaagaggtcaagttggagcaaggtttgaagatagtgaaaattttcaaggagcatacaagcaagacttgcattttggatgacttttccttctatgaggttaggcaaaagactatcttggagaagaaggctaagcaacagcaaacccagaaacatgtaagtgaggagaagactacaacagatgagaaaaaggactccgcaactgctgattcggctaataaggaatctcctccagctaccagtgatgccaaggctgatgagaatgggtctgttgcaaaaccagtcggtgtggtggcaaatggttgctagattaggcgatgtagctcacggcttgtgcattaaacgcaacaagagagaagaagatatgaacagtcccgtttacagtttctctggagaagtgccgtgagctttgaagcatggaaggaagagccttagtacctgagaccgagattctgtttctatgcccttagaagttaaatgtcccagttttattgtttcttcaatcttttcgtgttctctttttaccttgtctttacagttttttcttttcttttttcatgttctgttgttcctcctgccttgtaaaatgcttataggacctactaaattgtgggaaaagtaagagaaagaagatataatagcagggtgggagttgtttccatttctgttggattgataggcagatttttgtttattttccccctttttctattctcctgtttcttgtttgggttcagacatgactctatttgatatctgttagcatctgaggttctgtcgaaaaa

SEQ ID NO: 752 - DNA, 2518 bp, Brassica napus
ggaaagaaagtgaatcgaattaagacgtggctagaaggtaaacatgtctttagtgaagagagcaagatcgaacaacaaaatgaagtcttccaaacaaggtttcattcaaactttaatttaagatccgacaatagagtagacagtcttgtaaaagcactaactaccaatcaaaatcgaaaaacagagatgcagatagtcctcaatctgatcaggcagtgatttccttcttgagttttgcaagctcttgcctgacaacaccagctttcttgatcttggccaacatgatcttgaacctgtcgaaatcattgaggctagccctacgcttctgaacgatgagcttcctaccccacgagctcttctcccacttgttcttcacgtcagccttctccatggcctctatcaaagccttcttctttggcactcggttgatctcaatcacgatgtcagtaagtgacaacctcttgaagttcatctggattctctccatgtcaggtgcgtctaccaaagccctgttctggtcaacgacgtcgacgataacaacgagctttccatggtcttttccatagttcacaagagccactctcccgatctccacgtacctcttgaaaaccattttcgccggcggtagcttgattttcctggaagatcatattttttttcttctaaacactgtttctgatctgaagactaataaagtctgaagcttggttccgtaacatgtcggtgacagctcgatgattgtaaagtagattactttttttttttaagcaacgtaaagtagattactttaggggttgttttcgattctttgattgatttatcaattcgatcggagattagaggttacttagcgcacgagttcgttcttcttcattgaattgaattgaattggggttagattagatacacagaataaagggagaaaaaaggttactttttggttggagataaatggatcgagtggtaggtggcaagttcaagcttggtcgaaagcttggaagtggatcctttggtgaaatctttctaggggtgaatgtacaatctggagatgaagttgctgttaagctcgaacctcttagaagtaggcatcctcagcttcattacgagtcaaagatttatatgtttctccaaggaggatctggtattccacaccttaaatggtttggggttgagggtgaatacaactgtatggtgatcgaccttcttggtcctagtctggaggagtttttcaactattgcagtcgttctttctctctcaagactgtcctaatgctcgctgatcagatgctaaacagagtggagtatatgcatatacgaggctttctccatcgtgatattaagcctgataactttctgatgggcgttggccgcagagcaaaccaagtttacatcattgactatggcttagcaaaaaagtatagagatcttcaaacacacaagcatattccttacagagaaaacaagaatcttacaggaacggctcgatatgcaagtgttaacactcatcttggaattgagcaaagtaggagggatgatctggagtctcttggctatatgcttatgtattttctccgaggaagccttccatggcaaggccttcgtgcaggaaccaaaaaggaaaagtatgacaggatcagtgaaaagaaaagactcacaccagtcgaggtcctctgtaaaagctttccacctgagttcacttcctacttcctctacgtgcgttcgttacggtttgaagacaaaccagactattcctacttaaagaggcttttcagagacctattcatccgagaaggttatcagtttgactatgtattcgattggactatcttgaagtatccgcagttcgggtccagctccagttccagttctagttccaagccaagaccgggcctaagaccagctctgaacattccagcaccatctgctgagaaagttgaaaagccttcaactgggaaagagactcgcgatagatattcaagtgttttcgaggcatacactagaagaactggcttaggaaccggccttcaagctgatcggtctagtagaccgagaacctcagagaatgttcttgcatctagagacgcgctaaaccaggagagatcaatgacttcatctaggaaccagagttcttcaagaaaagcagttgctgggtcaagtgttcgagctacttcctcagctgatttcgcagagaaccgaaccagcagcagactcgtcccaagcaacggtcggtcctcgacaactcagaggactcagtttgcgccttcctcctcaaaggctgcaccgtcgagaattcctcctgacgttacactagagtttctcagtattgggaacgggaagaggaagtgatggatgataaattatttatccatcttttgtttgacaagttatattaccttttatccttgtggttgattacactgataacagtgtggatattaatattttcgaattatgttttattagccgtataaacaacatattaaatattagtaatactcagcgttataacttgttatgc

SEQ ID NO: 753 - DNA, 525 bp, Brassica juncea
gcttcccaccttccaaacctaccggcggctaaaatggttttcaagaggtacgtggagatagggagagttgctcttgtcaactacggaaaagaccatggaaagctcgtcgttatcgtcgacgttgttgaccagaacagggctttggtagatgcccctgatatggagaggatccagatgaatttcaagagattgtctcttactgatatcgttattgagatcaaccgagtgccgaagaagaaggctttgattgaggccatggagaaagctgacgtgaagaacaagtgggagaagagctcatggggtaggaagctgatcgttcagaagcgtagggctagcctcaatgacttcgataggttcaagatcatgttggccaaaatcaagaaagctggtgttgtcaggcaagaacttgcaaagctcaagaaggagatcactgcttgagttatattatctgcgaatctgttattgtattttgggttttggattactagcgttttgcaacttatcaactctgttagtttcagtttt

SEQ ID NO: 754 - DNA, 548 bp, Brassica juncea
gcgaaaatggttttcaagaggtacgtcgagatcgggagagtggcacttgtgaactacggtaaagaccatgggaagctcgtcgtcatcgtcgacgtcgttgaccagaacagggctttggtggacgccccagacatggagaggattcagatgaacttcaagaggctgtctcttactgacatagtcattgagatcaaccgagtgccaaagaagaaagctttgatcgaggccatggagaaagctgacgtgaagaacaagtgggagaagagctcatggggtaggaagctcatcgttcagaagcgtagggctagcctcaatgattttgacaggttcaagatcatgttggctaaaatcaagaaagctggtgttgtcaggcaagagcttgcaaaactcaagaaggagatcactgcctgatctactcgaggattatctacaactctgtttttcgattttgaattggtagttagtgttttgaaagtgtcaacatcattatctactctattgtcggatgttaatttcaagtttgaatgaaaccttgtttcgaatacttc

SEQ ID NO: 755 - DNA, 475 bp, Brassica juncea
agtacgcgggagacgcttcagctgttgctcgtaccacttagcttctaccctaccggcggcgaaaatggttttcaagaggtacgtggagatagggagagttgctcttgtgaactacggaaaagaccatggcaagctcgtcgttatcgtcgacgttgttgaccaaaacagagctttggtggatgcccctgatatggagaggatccaaatgaatttcaagaggttgtctcttacagacatcgtgattgagatcaaccgagtgcccaagaagaaggctttgatcgaggctatggagaaagctgacgtgaagaacaagtgggagaagagctcctggggtaggaagcttattgtccagaagcgtagggctagcctcaatgacttcgataggttcaagatcatgttggccaagatcaagaaagctggtgttgtcaggcaagaacttgcaaagctcaagaaggagatcactgcttgagtatta

SEQ ID NO: 756 - DNA, 667 bp, Cicer arietinum
aaaaaccctagttgcctctctgcttcagcttcggtcgtagaatccccgtccgagaaaatgcctttcaagaggtacgttgagattggaagagttgctcttgtcaactacggaaaagactatggtaaactcgttgttatcgttgatgtcatcgaccaaaccagagctcttgttgatgctccggatatggagaggtctcctttgaatttcaagaggctctcactcactgacatcaagattgatattaagagggtcccaaagaagaaggatctcatcaaagccatggaggctgctgatgttaagaacaagtgggagaagagctcatggggaagaaaacttattgtgaggaagactagggcatccctcaatgattttgataggttcaagataatgttggcaaagatcaagagggcagccgttgttaggcaagagcttgctaagctgaagaagaccgcatcttaggcatattaatggttaatttttgaatttttcaatgaatttcttttgattagtacaccttagtttgttatatgagattttgtgtaatcattgagtgacttccaagaatggtttgtttcgagagctcatattagtgaattgatgttagttctttatgatttcatattttggttttcaagatgttctcagactaatagaaatcttaagccgc

SEQ ID NO: 757 - DNA, 669 bp, Cicer arietinum
tcacccttctcagtgtgtgcctttctgcaattccacagccgaaaatgcctttcaagaggtacgttgagatcggaagggttggtcttgtcaactacggaaaggactatggaaagctcgttgtcatcgtcgatgtcatcgaccaaactagggcacttgttgatgcacctgatatggagaggtcaccattgaattttaagagactttctctcactgatatcaagattgatattaagagagttcctaagaagaaggatctcatcaaggccatggaagctgctgatgtgaagggcaagtgggagaagagctcttggggtagaaaactgattgtcagaaagagaagggcagccctcaatgattttgataggttcaagattatgttggcaaagattaagagggctgctgtcgttaggcaagaacttgctaagctgaagaagactgcagcttaagcatttattttcaaattttgttatctatttccttccatttagtacaacttggattttggtttttgtatcactaagtttggtaaatgtttcgagaaatttatatttatgttaaagagattatatcagtactcaattctccattgtttttgaatgcttatttttgaatgttggtttattagataatcgataaagcaagctagagcttgaaattttatttgtgtta

SEQ ID NO: 758 - DNA, 676 bp, Helianthus annuus
attcctaataatcgtaaaccctaactttcatcatcttcatcgttaccgccacattcttcatcggcgatctccaaaatgccgttcaagaggtacgttgagatcggaagaatcgcactggtcaactacggcaaggattatggaaaacttgttgtcattgtcgatgttattgatcaaaatagggcacttgttgatgctcctgacatggtaagggctcaaatgaacttcaaaagactgacactcactgacatcaagatcgacattaaaagagttccaaataagaaaacccttgttgctgcattggaagccgctgatgttaagaacaagtgggaaagcagttcttggggaaggaagcttatcgttcaaaagaagagggcttcgctaaatgattttgataggttcaagattatgttggccaagataaagaaggctggagttgtaaggcaagaactagcaaagcttaagaaggagaccacagcatgatatggtctaaatatcaagattttgatgtagtttatttgaatttgatgagttattatgattttgtgttgggactgaatgaaatatatgtttcatttttggatttccattttgttgctttaatgtttgtattttgtacattatagattgattattgataaacttttttatgcatcagggctataattctaagattatc

SEQ ID NO: 759 - DNA, 664 bp, Eutrema halophilum
agctgctgctcgttcacgttttatttttcactcggagcttcgaccttccacagcaaccggcggcgaaaatggttttcaagaggtacgtggagatagggagagtggcacttgtgaactacggaaaggatcatggaaagctcgttgtaatcgtcgacgtcgttgaccagaacagggcattagtagacgcccctgatatggagaggatccagatgaatttcaagaggttgtctcttacagatatcgtgattgagatcaaccgtgtgccaaagaagaaggctttaatcgaggcaatggaaaaggctgacgtgaagaacaagtgggagaaaagctcatggggaaggaagcttatcgtgcagaagcgtagggctagcctcaacgattttgataggttcaagatcatgttggccaaaatcaagaaagctggtcttgtcaggcaagagcttgcaaaactcaaaaaggagatcactgcctgataaaattgaatattatctgcaagtctgtttttttttattttgggttggtaaattagtgtttttgcaaatctcagcatcattatctactcaattatcggatgttactttttaagtttgaaaccttgtttggaaaactcgagttgctatttgatcttgctctcatttctagaggtccattggctttcttataa

SEQ ID NO: 760 - DNA, 689 bp, Artemisia annua
ggggagttatatttcatctcacactgccgcagcaacctttcttctcgtcgccacacatctccgaaaatgccgttcaagaggtacgttgagatcggaagaatcgcacttgtcaactacggacctgattatggaaagcttgttgtcatcgttgatgtcatcgaccaaaacagggctcttgttgatgcaccagacatggtgaggggtcagatgaacttcaaaaggctaaccctcacagacatcaagatcgacatcaagagagtcccaaacaagaagactcttcttgctgctttggaggctgctgatgtcaagaacaagtgggagaacagctcttggggacgaaagcttatcgtgcagaagaagagagcttcactcaatgattttgacaggttcaagatcatgttggctaagattaagaaggctggagttgtaaggcaagagttagcaaagcttaagaaggaaactacagcttaattccatcattttgttttaattataaaagattttgttgaaccgttgaggaatccattttgttgcttagaagcttgtggttttatcctttttctctacatgtattaatggaaaacctagttgcgagtcttgaaacttttatctgttgcatgtgtcttgaaacttttatctgttgcatgtgttttgaaatgcttgttggtattgatatcgtttatgtttca

SEQ ID NO: 761 - DNA, 658 bp, Brassica juncea
gccggcgaaaatggttttcaagaggtacgtggagatcgggagagtggctcttgtgaactatggaaaagaccatggaaagctcgttgttatcgtcgacgtcgttgaccagaacagggctttggtagacgcacctgacatggagagaatccagatgaacttcaagaggttgtctcttaccgacatcgtgattgagatcaaccgagtgccaaagaagaaggctttgatagaggccatggagaaggctgacgtgaagaacaagtgggagaagagctcgtggggtaggaagctcattgttcagaagcgtagggctagcctcaatgatttcgacaggttcaagatcatgttggccaagatcaagaaagctggtgttgtcaggcaagagcttgcaaaactcaagaaggaaatcactgcctgatcagattgaggactatctgcatctctgtttttcgattttgattggtagttagtgcttttacaagactgtctactctattgtcggatcttaaattaaagtttgaatgaaaccttgtttggaagacttcattttgttgttcgatcttgctctcttcactaaagacatgtttactttctagccacgtcttaattcgattcacattctttccaaaaaaaaatcactgactgatcagattgaggacta

SEQ ID NO: 762 - DNA, 640 bp, Brassica juncea
cgccttcagcttctgttgctctcttccactttgcttcaaccttcaaagcttccgccgcgaaaatggttttcaagaggtacgtggagatcgggagagtggctcttgtgaactatggaaaagaccatggaaagctcgttgttatcgtcgacgtcgttgaccagaacagggctttggtagacgcacctgacatggagagaatccagatgaacttcaagaggttgtctcttaccgacatcgtgattgagatcaaccgagtgccaaagaagaaggctttgatagaggccatggagaaggctgacgtgaagaacaagtgggagaagagctcgtggggtaggaagctcattgttcagaagcgtagggctagcctcaatgatttcgacaggttcaagatcatgttggccaagatcaagaaagctggtgttgtcaggcaagagcttgcaaaactcaagaaggaaatcactgcctgatcagattgaggactatctgcatctctgtttttcgattttgattggtagttagtgcttttacaagactgtctactctattgtcggatcttaaattaaagtttgaatgaaaccttgtttggaagacttcattttgttgttcgatcttgctctcttcactaaagacatgtttactt

SEQ ID NO: 763 - DNA, 634 bp, Brassica juncea
aagctaccgccggcgaaaatggttttcaagaggtacgtcgagatcgggagagtcgctcttgtgaactatggaaaggaccatggaaagctcgttgtcatcgtcgacgtcgttgaccagaacagggctttagtagatgcccctgacatggagagaatccaaatgaacttcaagaggttgtctcttactgacatcgtgattgagatcaaccgagtgcccaagaagaaggctttgatcgaggccatggaaaaggctgacgtgaagaacaagtgggagaagagctcatggggtaggaagctcatcgttcagaagcgtagagctagcctcaatgattttgacaggttcaagatcatgttggctaaaatcaagaaagctggtgttgtcaggcaagagcttgcaaaactcaagaaggagatcactgcctgatctacttgaggattatctacaactctgtttttcgattttgaattggtagttagtgtttttgaaagtgtcaacatcattatctactctatttttggatgttaatttcaagtttgaatgaaaccttgtttggaatacttcattttgatgtttgattctcctctattcactaaaaacatgtttatttccgaaaatagagtagttagtgtttttg

SEQ ID NO: 764 - DNA, 662 bp, Brassica juncea
aagctaccgccggcgaaaatggttttcaagaggtacgtcgagatcgggagagtcgctcttgtgaactatggaaaggaccatggaaagctcgtcgtcatcgtcgacgtcgttgaccagaacagggctttagtagatgcccctgacatggaaaggatccaaatgaacttcaagaggttgtctcttactgacatcgtgattgagatcaaccgagtgcccaagaagaaggctttgatcgaggccatggaaaaagctgacgtgaagaacaagtgggaaaagagctcatggggtaggaagctcatcgttcagaagcgtagggctagcctcaatgattttgacaggttcaagatcatgttggctaaaatcaagaaagctggtgttgtcaggcaagagcttgcaaaactcaagaaggagatcactgcctgatctactcgaggattatctacaactctgtttttcgattttgaattggtagttagtgtttttgaaagtgtcaacatcattatctactctatttttggatgttaatttcaagtttgaatgaaaccttgtttggaatacttcattttgatgtttgattctcctctattcactaaaaacatgtttatttccgaaaatagagtagttagtgtttttgaaggggtcaacatccttatctactctat

SEQ ID NO: 765 - DNA, 655 bp, Brassica oleracea
gacgcttacgctgttgctcgtcccacttcgcttcccacctttccaacctaccggcggcgaaaatggttttcaagaggtacgtggagatagggagagttgcccttgtaaactacggaaaagaccatggaaagcttgtcgtcatcgtcgatgtcgtcgaccagaacagagctttggtagatgcccctgatatggagaggatccaaatgaatttcaagagattgtctcttactgatattgttattgagatcaaccgagtgccgaagaagaaggctttgattgaggccatggagaaggctgacgtgaagaacaagtgggagaagagctcatggggtagaaagctgatcgttcagaagcgtagggctagcctcaatgacttcgataggttcaagatcatgttggccaaaatcaagaaagctggtgttgtcaggcaagaacttgcaaagctcaagaaggagatcactgcttgagttatattatctgcgaatctgttattgtattttgggttttggattactagcgttttgcaacttatcaaactctgttagtttcagttttgaaacctccttcacaactttcatctttcgtttaatgttaaaaaaccatttgcgacttctatgtttttgcggcaacagtgatcatcgatggttctaattag

SEQ ID NO: 766 - DNA, 614 bp, Brassica oleracea
ggccttcagctgccgttgctccttcactttgcatctaccttcaaatccaccgccgcgaaaatggtgttcaagaggtacgtggagattgggagagttgcacttgtcaactacggaaaagatcatggaaagcttgtcgtcatcgtcgacgtcgttgaccagaacagggctttggtagatgctcctgatatggagagaatccagatgaacttcaagaggctgtctcttaccgatatcgtgattgagatcaacagagtgcctaagaagaaggctttgatcgaggccatggaaaaggctgacgtgaagaacaagtgggagaagagctcatggggtaggaagctcattgttcagaagcgtagggctagcctcaatgacttcgacaggttcaagatcatgttggcccaaatcaagaaagctggcgttgtcaggcaagagcttgctaaactcaagaaggtgatcactgcttgatcagattgagtactatctgcttatctgttttttttttgtacttttgattggcaattagtgtttttacgaatctcaacatcaatatctatctacactgttgtcggattttgaaaccttgtttcttaaaatttagtttgttatttcatctt

SEQ ID NO: 767 - DNA, 707 bp, Brassica rapa
aggtgtaagacgccttcagctgctgttgctctcctcctctttgcttctacattccaagctaaagcggcgaaaatggtgttcaagaggtacgtagagattgggagagttgctcttgtgaactacgggaaagatcatggaaagctcgtcgtcatcgtcgacgtcgttgaccagaacagagctttggtagatgctcctgatatggagagaatccagatgaacttcaagaggctgtctcttaccgatatcgtgattgagatcaacagagtgcctaagaagaaggctttgatcgaggccatggaaaaggctgacgtgaagaacaagtgggagaagagctcatggggtaggaagcttattgttcagaagcgtagggctagcctcaatgactttgacaggttcaagatcatgttggccaaaatcaagaaagctggcgttgtcaggcaagagcttgcaaaactcaagaaggagatcactgcttgatcagattgagtactatctgcttatctgtttttttttgtatttttgattggcaattagtgtttttacgaatctcaacatcaatatctatctacactgttgtcggattttgaaaccttgtttcttaaaatttagtttgttatttcatctttacctttcttttacaaaagttccatttgcttattgccgttttctctaatctcttcgtttaatattattatacttaaaagaga

SEQ ID NO: 768 - DNA, 638 bp, Brassica rapa
ctgctgttgctctcctcctctttgcttctacattccaagcaaaaccggcgaaaatggtgttcaagaggtacgtagagattgggagagttgctcttgtcaactacggaaaagatcatggaaagcttgtcgtcatcgtcgacgtcgttgaccagaacagagctttggtagatgctcctgatatggagagaattcagatgaacttcaagaggctgtctcttaccgatatcgtgattgagatcaacagagtgcctaagaagaaggctttgatcgaggccatggaaaaggctgacgtgaagaacaagtgggagaagagctcatggggtaggaagcttattgttcagaagcgtagggctagcctcaatgactttgacaggttcaagatcatgttggccaaaatcaagaaagctggcgttgtcaggcaagagcttgcaaaactcaagaaggagatcactgcttgatcagattgagtactatctgcttatctgtttttttttgtatttttgattggcaattagtgtttttacgaatctcaacatcaatatctatctacactgttgtcggattttgaaaccttgcttcttaaaaattagtttgttatttcatctttacctcttcttttacaaaagttccatttgctt

SEQ ID NO: 769 - DNA, 616 bp, Brassica rapa
ctcgtcccacttcgcttcctacctttccaacctaccggcggcgaaaatggttttcaagaggtacgtggagatagggagagttgcactagtcaactacggaaaagaccatggaaagctcgtcgtcatcgtcgacgttgttgaccagaacagggctttggtagatgcccctgatatggagaggatccaaatgaatttcaagagattgtctcttactgatatcgttattgagatcaaccgagtgccgaagaagaaggctttgatcgaggcaatggagaaggctgacgtaaagaacaagtgggagaagagctcatggggtaggaagctgatcgttcagaagcgtagggctagcctcaatgacttcgataggttcaagatcatgttggccaaaatcaagaaagctggtgttgtcaggcaagaacttgcaaagctcaagaaagagatcactgcttgagttatattatctgcgaatctgttattgtattttgggttttggattactagcgttttgcaacttatcaactctgttagtttcagttttgaaacctccttcacaactttcatctttcgtttaatgttaaaaaaccttttgcgacttttatgtttttacggcaacagt

SEQ ID NO: 770 - DNA, 608 bp, Brassica rapa
ggaacattcaagctaccgccggcgaaaatggttttcaagaggtacgtggagatcggtagagtggctcttgtgaactatggaaaagaccatggaaagctcgttgttatcgtcgacgtcgttgaccagaacagggctttggtagacgcacctgacatggagagaatccagatgaacttcaagaggttgtctcttaccgacatcgtgattgagatcaaccgagtgccaaagaagaaggctttgatagaggccatggagaaggctgacgtgaagaacaagtgggagaagagctcgtggggtaggaagctcatcgttcagaagcgtagggctagcctcaatgatttcgacaggttcaagatcatgttggccaagatcaagaaagctggtgttgtcaggcaagagcttgcaaaactcaagaaggagatcactgcctgatcaagctgaggactatctgcatctctgtttttcgatttattggtagttagtgcttttacaagagactgtctactctattgtcggatcttaaattaaagtttgaatgaaaccttgtttggaagacttcattttgttgttcgatcttgctctcttcactaaagacatgtttaccttct

SEQ ID NO: 771 - DNA, 635 bp, Brassica rapa
ggaacattcaagctaccgccggcgaaaatggttttcaagaggtacgtggagatcgggagagtggctcttgtgaactatggaaaagaccatggaaagctcgttgttatcgtcgacgtcgttgaccagaacagggctttggtagacgcacctgacatggagagaatccagatgaacttcaagaggttgtcacttactgacatcgtgattgagatcaaccgagtgccaaagaagaaggctttgatagaggccatggagaaggctgacgtgaagaacaagtgggagaagagctcgtggggtaggaagctcatcgttcagaagcgtagggctagcctcaatgatttcgacaggttcaagatcatgttggccaagatcaagaaagctggtgttgtcaggcaagagcttgcaaaactcaagaaggaaatcactgcctgatcagattgaggactatctgcatctctgtttttcgattttgattggtagttagtgcttttacaagactgtctactctattgtcggatcttaaattaaagtttgaatgaaaccttgtttggaagacttcattttgttgttcgatcttgctctcttcactaaagacatgtttactttctagccacgtcttaattcgattcacattc

SEQ ID NO: 772 - DNA, 649 bp, Brassica rapa
ctcgtcccacttcgcttcccaccttccaaacctaccggcggctaaaatggttttcaagaggtacgtggagatagggagagttgctcttgtcaactacggaaaagaccatggaaagctcgtcgttatcgtcgacgttgttgaccagaacagggctttggtagatgcccctgatatggagaggatccagatgaatttcaagagattgtctcttactgatatcgttattgagatcaaccgagtgccgaagaagaaggctttgatcgaggccatggagaaggctgacgtgaagaacaagtgggagaagagctcatggggtaggaagctgatcgttcagaagcgtagggctagcctcaatgacttcgataggttcaagatcatgttggccaaaatcaagaaagctggtgttgtcaggcaagaacttgcaaagctcaagaaggagatcactgcttgagttatattatctgcgaatctgttattgtattttgggttttggattactagcgttttgcaacttatcaactctgttagtttcagttttgaaacctccttcacaactttcatctttcgtttaatgttaaaaaacttttgcgacttccatatctttatgacaacagttaaaaagtgatggttctaattttgaaatgaaaaa

SEQ ID NO: 773 - DNA, 627 bp, Phaseolus coccineus
agattgtgttccaccaccacgcatcctccgtctatccctcgctgctgcagtcgaagccgaaaatgcctttcaagaggtacgtcgagatcggaagggttgctctcgtcaactacggcaaggaatatggcaagctcgtcgtcatcgtcgacgtcattgaccagaacagagcactcgtcgacgccccagatacggtgaggtcccaagtcaacttcaaaaggctttccctaaccgatattaagatagacattaagagggttcccaagaagaaagatcttgttaaagccatggaggctgctgatgttaagaacaaatgggagaaaagctcatggggcaggaaactcattgtcaaaaagcgaagggcagccctcagtgacttcgataggtttaagctaatgttggccaagattaagagggcagctgtggtaaggcaagaactctctaagctgaaaaagagcgcgtaggcattattttacgatataaccttcaagttttgttatgagttttctttactttgggtatgggattttatgtatcattgagacacggtgaaaagtttcatcttcagatatttatgatataacttaaatctagttgattttatattatttatgattgacaattgttttt

SEQ ID NO: 774 - DNA, 586 bp, Brassica napus
aagctaccgccggcgaaaatggttttcaagaggtacgtggagatcgggagagtggctcttgtgaactatggaaaagaccatggaaagctcgttgttatcgtcgacgtcgttgaccagaacagggctctggtagacgcacctgacatggagaggatccagatgaacttcaagaggttgtctcttactgacatcgtgattgagatcaaccgagtgccgaagaagaaggctttgatcgaggccatggagaaggctgacgtgaagaacaagtgggagaagagctcgtggggtagaaagctcatcgttcagaagcgtagggctagcctcaatgatttcgacaggttcaagatcatgttggccaaaatcaagaaagctggtgttgtcaggcaagagcttgcgaaactcaagaaggagatcactgcctgagattatctgctgcatctctgtttttcgattttgaattggtagttagtgtttttgaaagtgtcaactccgttatctactctattgtcggatgttaaaatttcaagtttgaatgaaaccttgtttggaagacttcattttgttgtttgatcaggtcttaattcga

SEQ ID NO: 775 - DNA, 579 bp, Centaurea maculosa
tatcgccacgtctcctcatcctccacggcgctctgcaaccgaagaacgcctgaaaatgccgttcaagaggtacgtcgagatcggaagagttggactcgttaactacggaaaggattatggaaaactcgtcgtcatcgtcgacgtcattgatcaaaacagggctcttgttgatgcccctgacatggtgaggagccaattgaacttcaagaggctaacactcacagacatcaagatcgacatcaaaagagttccaaacaagaaaactcttgttgctgctttagaggctgccgatgtgaagaacaagtgggaaaatagctcgtggggaagaaagctcatcgttcaaaagaagagagcctcacttaacgattttgataggttcaagatcatgttggcaaagataaagaaggctggagtcgttaggcaagagctagctaagcttaagaaggagaccacagcgtgatttgttatttgtggtcgaattgttttcgagtagattcttgttgtttttgtaggagcttgtgtttaatctttttacaagtgattgttggaattttggccaattcaattttgaactctttg

SEQ ID NO: 776 - DNA, 772 bp, Castanea mollissima
cttacccttctttcatttcctctgcctcgcttccgcctctctcactctcacacacctcacgaacccaaaatgcctttcaagagatacgtagagatcgggcgggttgccctcgtcaactacggcgaagactatggcaagctcgtcgtcatcgtcgatgtcatcgaccagaacagagctcttgttgatgctcctgatatggaaaggtcccaaatgaatttcaagaggctttctctcactgacattaaaattgacattaagagggttcctaagaagaaggaattgctggatgctatggagaaagctgatgtcaagaagaagtgggagagtagttcctggggcagaaaactcattgtccagaagagaaggcaaaatctgactgactttgataggttcaagcttatgttggcaaaaattaagagggctggactggtcaagcaggagctagcaaaactgaaaaaggagaatgccgcataagcatagttttatctggatttcccaattttgttttgaactttctgcagttgtacttttggattgctagcctgtcttcaatcaattcagagtttcacaacagcttgagtttttatgtatttctcacaaactttaatgatagtcatttttattgctagacatttcttttttatcaagatgcttatgtagtttcatcgtttaatcttaatttgtgaggtattgggttttctgcttttctccaaggtggtaatatgcttttgtagggtcaattatggggcccattattttttttttaaaaaaa

SEQ ID NO: 777 - DNA, 609 bp, Cichorium intybus
gcgggggctttatatcttcatcgctacgcctgtcttcctcggtgatctgtatacaggaacgccgaaatgccgttcaagaggtacgttgagatcgggagaatcgccctcgtcaactacggaaaggattacggaaagcttgtagtcatcgtcgatgttatcgatcaaaaccgggcgcttgtagatgctcctgacatggtaaggggccaaatgaacttcaagagactgacactcaccgacatcaagattgacattaacagagtcccaaagaagaaaacccttgttgctgcattggaagccgctgatgtcaagaacaagtgggagagcagttcatggggaagaaaacttattgttcagaagaagagggcttcacttaacgactttgataggttcaagatcatgttggcaaagataaagaaggctggagttgttaggcaagaactagccaagctaaagaaggagactacagcatgatgtggtttttaaagtcttttgtttgaatatcaagattttggtgttgtttatttgaatgttgatgaattattttgttgcttatgatattgtgttcaccttattctacaatgaaatatttatttcatttttgtcaaaaaa

SEQ ID NO: 778 - DNA, 577 bp, Trifolium pratense
cttgaatctcacaaaccctagcgaaaatgcctttcaagagattcgttgagattggaagggttgctcagatcaactatggaaaagactatggtagactcgttgttatcgttgatgtcatcgaccaaaccagagctcttgttgatgctcctgacatggagagatctccgataaatttcaagaggctctcactcactgacatcaagattgagattaagagagtccccaagaagaaggatctcatcaaagccatggaagctgcagatgttaagaacaagtgggaaaagagctcgtggggcaggaaattgattgtgaggaagagaagggcagccctcaatgactttgacaggttcaagatcatgttggcaaagatcaagagggcagctgttgtaaggcaagaacttgctaagttgaagaagaccgcagcttaggctttaattaatgatcaatttttgaattttcctatgatttcttttgattagtacacttcggtttgttatatgaaattatatgtaatcgttgagtgactccttagaaaggtttgttttaagagctcatattttagtggattgatgtcact

SEQ ID NO: 779 - DNA, 744 bp, Medicago truncatula
gataaacactcttccaaccttagtttcagctgcgagcgagtgcctcagaaaatcgaaaatgccgttcaagaggtttgttgagatcggaagagttgcacttgtcaactatggcccagattatggcaagctcgttgtcatcgttgatgttatcgaccaaactagggctcttgttgatgcacctgacatggagagagtcccaatcaatttcaagaggctttctctaactgatatcaagattgatatcaagagggttcctaagaagaaggatctcgtcaaagccatggaagctgcagatgtgaagaacaagtgggagaagagctcctggggaaggaaattgattgttaagaagaggagggctgcccttaacgattttgataggttcaagattatgttggcaaagattaagagggctggtgttgttaggcaagaacttgctaagctgaggaagaccgcagcttaggcattccttcatgatacaattttcaaattttgttgttgatttccttctatttagtacaacttggatgtttgagtgttttttatcaccaagacagttagttaaatgtttgatcctaagatatttgtgttacgagatttatgttggtactcagttttccatttttgcttttgattgcatattttttaatgtcggtcttttgataatatataatcaagcaagcaagagctagaggttttattgttattaggtttgcttattttttaatgttggttctgttcttgttt

SEQ ID NO: 780 - DNA, 743 bp, Medicago truncatula
ataaacactcttccaaccttagtttcagctgcgagcgagtgcctcagaaaatcgaaaatgccgttcaagaggtttgttgagatcggaagagttgcacttgtcaactatggcccagattatggcaagctcgttgtcatcgttgatgttatcgaccaaactagggctcttgttgatgcacctgacatggagagagtcccaatcaatttcaagaggctttctctaactgatatcaagattgatatcaagagggttcctaagaagaaggatctcgtcaaagccatggaagctgcagatgtgaagaacaagtgggagaagagctcctggggaaggaaattgattgttaagaagaggagggctgcccttaacgattttgataggttcaagattatgttggcaaagattaagagggctggtgttgttaggcaagaacttgctaagctgaggaagaccgcagcttaggcattccttcatgatacaattttcaaattttgttgttgatttccttctatttagtacaacttggatgtttgagtgttttttatcaccaagacagttagttaaatgtttgatcctaagatatttgtgttacgagatttatgttggtactcagttttccatttttgcttttgattgcatattttttaatgtcggtcttttgataatatataatcaagcaagcaagagctagaggttttattgttattaggtttgcttattttttaatgttggttctgttcttgttt

SEQ ID NO: 781 - DNA, 668 bp, Nuphar advena
  misc_feature (4)..(5): n is a, c, g, or t
attnncacgcttcctcctcgttgcatctctctctggttgaaccacaaaccctcaaccatgccgttcaaaaggtatgtagagatcggtagggtggcgatgatcaactacgggaaggaatacggcaggcttgtcgtgatcgtcgatgtcatcgaccagaaccgagctcttgttgatgcacctgatatggtgagaagtcagatgaattttaagagacttgcactaactgatatcaagatcgacattccgaggattcctaaaaagaagtccttgattgcagcaatggaggctgcagatgtgaaaaacaagtgggaaagcagctcttggggcaggaagctgattgtgcagaaaaagagagctgcactcaatgattttgacaggttcaaggttatgttggcaaagatcaagagagctagcttgatcaggcaggagctctcaaagctgcaaaaggagagtggggcgtgagaagtgctgaattcaattttggatttatgggctctttcttagttcatagggaactgttgagaagagttcaacttcgtaatcactttgttatttgctgtgttttggatttaaaacaaaaggggttatcctcttttttccctgggaaggactaccattttgtatttcaatatgcctttgttcaattttagaaaactttttcgttgttt

SEQ ID NO: 782 - DNA, 873 bp, Quercus alba
accctcttttcatttcctctgcttcgcttccgcctctctcactctcacacacctcacgaacccaaaatgcctttcaagagatacgtagagatcgggcgggttgccctcgtcaactacggcgaagactatggaaagctcgtcgtcatcgtcgatgtcatcgaccagaacagagctcttgttgacgctcctgatatggaaaggtcccaaatgaatttcaagaggctttctctgaccgacattaaaattgacattaagagggttcccaagaagaaggaattgctggatgctatggagaaagctgatgtcaagaagaagtgggagagtagttcctggggcagaaaactcattgtccagaagagaaggcaaaatctgaccgactttgataggttcaagcttatgttggcaaaaattaagagggctggactggtcaagcaggagctagcaaaactgaaaaaggagaatgccgcataagcgtagttttatctggatttcccaattttgttttgaactttctgcagttgtacttttggattgctagcctgtcttcaatcaattcagagtttcacagcagcttgagtttttatatatttctcacaaactttaatgatagtcatttttattgctagacgtttctttttttatcaagatgtttatgtagtttcatcatttaatcttaatttgtgactctttgggttttctgctcttctccaaggtgggggtgtgcttttgtagggtcatttatgaggcccatgatttgttttaatgcgatagtaggtttatcagcctatgttatgatctgaatttgtagctttgttcagttgccctttgtcatatgatatgtttgaatgaaaccaattctaggatacgtgtcgt

SEQ ID NO: 783 - DNA, 628 bp, Raphanus sativus
  misc_feature (271)..(271): n is a, c, g, or t
  misc_feature (444)..(444): n is a, c, g, or t
gcttcgaacattcaagctaccgccggcgaaaatggttttcaagaggtacgtcgagatcgggagagtcgcccttgtgaactatggaaaagaccatggaaagctcgtcgtcatcgttgacgtcgtggaccagaacagggctttggtagacgcccctgacatggagagaatccagatgaacttcaagaggctgtctcttactgacatcgttatcgagattaaccgagtgccaaagaagaaggcgttgatcgaggccatggagaaggctgacgtnaagaacaagtgggagaagagctcgtggggtaggaagctcattgttcagaagcgtagggctagcctcaacgattttgacagattcaagatcatgttggccaaaatcaagaaagctggtgttgtcaggcaagagcttgcaaaactcaagaaggagatcactgcctgatcaacttnaggattctctgtttttcgattttgaatttggtagttagtgttttttgaaagtgtcaaacatcatttatctactctgctgtcagatgttaagttcaagtttgaatgaaaccttgtttggaagacttcattttgttgtttgatcgcactctcttcactaaaagcatgtttattttctatttagtct

SEQ ID NO: 784 - DNA, 630 bp, Raphanus sativus
actttgcttcgaacattcaagctaccgccggcgaaaatggttttcaagaggtacgtcgagatcgggagagtcgctcttgtgaactatggaaaagaccatggaaagctcgtcgtcatcgtcgacgtcgtcgaccagaacagggctttagtagatgcccctgacatggagaggatccagatgaacttcaagaggttgtctcttactgacatcgtgatcgagatcaaccgagtgcctaagaagaaggcattgattgaggccatggagaaagctgacgtgaagaacaagtgggagaagagctcctggggtaggaagctcatcgttcagaagcgtagggctagccttaatgattttgacagattcaagatcatgttggccaagatcaagaaagctggtgttgtcaggcaagaacttgctaaactcaagaaggagatcaccgcctgatcatattgaggattatccgcaactctgtttttctatttcgaattggtagttagtgtttttttgaaagtggcaaacatcattatctactttattgtcggatgttaatttcaattttgaatgaaaccttgtttggaagacttcattttgttgtttggtcgtactctcttcactaaaaacatgtttattttc

SEQ ID NO: 785 - DNA, 647 bp, Raphanus sativus
aacattcaagctaccgccggcgaaaatggttttcaagaggtacgtcgagatcgggagagtcgcgcttgttaactatggaaaggaccatggaaagctcgtcgtcatcgtcgacgtcgtggaccagaacagggctttggtagatgcccctgacatggagaggatccaaatgaacttcaagagattgtctctcactgacatcgtgatcgagatcaaccgagtgcctaagaagaaggctttgattgaggccatggagaaagctgacgtgaagaacaagtgggagaagagctcatggggtaggaagctcatcgttcagaagcgtagggctagcctcaacgatttcgacagattcaagatcatgttggccaaaatcaagaaagctggtgttgtcaggcaagagcttgcaaaactcaagaaggagatcactgcctgatcaacttgaggattatctacttctctgttttttcgattttgaattggtagttagtgtttttgaaagtgtcaaacatcatttatctactctactgtcggatgttaagttcaagtttgaatgaaaccttgtttggaagacttcattttgttgtttgatcgcattctcatcactaaaagcatgtttattttctaattagtctttattcgaaaaaaaaaaa

SEQ ID NO: 786 - DNA, 624 bp, Raphanus sativus
tttttgcttctaaccttctaagcgaaaatggtgttcaagaggtacgtggagattgggagagttgcacttgtgaactacggaaaagaccatggaaagctcgtcgtcattgtcgacgtcgttgaccagaacagggctttggttgacgccccagacatggagaggatccagatgaacttcaagaggttgtctctcaccgatatcgtgattgagatcaacagagtcccaaagaagaaggccttgatcgaggccatggagaaggctgacgtgaagaacaagtgggagaagagctcatggggtaggaagcttattgttcagaagcgtagggctagcctcaatgatttcgacaggttcaagatcatgttggccaaaatcaagaaagctggcgttgtcaggcaagagcttgcaaaactcaagaaggagatcactgcttgatccaattgagtattatctgcgtgtcttttttttctttgtattttggattggcaagtagtgtttttgggaagtctcagcatcattatctacactgttgtcggatcttaattccaagtttaaaaccttcgaaatatttagtttgttatttcatatttagctctatttaccaaagttccatttgctttgttaaaa

SEQ ID NO: 787 - DNA, 953 bp, Raphanus sativus
gcttaagctgttgctcgtcccactttgctctctcaccttccaaccttaccggcggcgaaaatggttttcaagaggtacgtggagatagggagagttgctcttgtcaactacgggaaagaccatggaaagctcgtcgttatcgtcgacgttgttgaccagaacagagctttggtagatgcccctgatatggaaaggatccagatgaatttcaagaggttgtctcttacggacatcgtgattgagatcaaccgagtgccgaagaagaaggctttgatcgaggctatggagaaagctgacgtgaagaacaagtgggagaagagctcatggggtaggaagcttatcgttcagaagcgtagggctagcctcaatgacttcgataggttcaagatcatgttggccaaaatcaagaaagctggtgttgtcaggcaagaacttgcgaagctcaagaaggagatcaccgcttgagttactatctgcgaatcttgttattgtattttgggttttggatttactagcgttttgcaatttatcaactctgttgaatggatgttagtttcagttttgaaacctttacaactttcatctttcgtttaatgtcaaagatcctttacgacttcaatgtctatacgacaacagttttctcgtatgatctaagaccatctccaatgtattttgctattttcacttctaaaatagaggaactctattataactctattattctataatagaggtgagatatgctccaatgtatttctctataatagcaatctctattttatagagtaaaaaatagaggaatgctatttcttcttctataaatagaggaaaaagtacaggtaggttggagcaatttcacctctaaatgctattatagaggtgaaaatagcaatgggttggagatgctctaatattgttctaataacgaaatgatgtttaagactttattacca

SEQ ID NO: 788 - DNA, 651 bp, Raphanus sativus
ggagccgaagctgttgctcgtcccactttgctctgtcaccttccaaccacaccggcggcgaaaatggttttcaagaggtacgtggagatagggagagttgcacttgtcaactacgggaaagaccatggaaagctcgtcgttatcgtcgacgttgttgaccagaacagagctttggtagatgcccctgatatggagaggatccagatgaatttcaagaggttgtctcttacggacatcgtgattgagatcaaccgagtgccgaagaagaaggctttgatcgaagctatggagaaagctgacgtgaagaacaagtgggagaagagctcatggggtaggaagcttatcgttcagaagcgtagggctagcctcaatgatttcgataggttcaagatcatgttggccaaaatcaagaaagccggtgttgttaggcaagaacttgccaagctcaagaaggagatcactgcttgagttgctatctgtgaatcgtttattgtatttttttgggttttggatttactagcgttttgcaatttatcaactctgttgaattagtttcagttttgaaacctttacaactttcatctggcgtttaatgtcaaagaacctttacaacttccatatctctatacgacaacagttcttttcatgatc

SEQ ID NO: 789 - DNA, 647 bp, Raphanus sativus
  misc_feature (582)..(582): n is a, c, g, or t
gggacgcttcagccgttaccgtcccacttcgctctatcaccttccaacctcaccggcggcgaaaatggttttcaagaggtacgtggagatagggagagttgcccttgtcaactacgggaaagaccatggaaagctcgtcgttattgtcgacgttgttgaccagaacagagctttggtagatgcccctgatatggagaggatccagatgaatttcaagaggttgtctcttacggacatcgtgattgagatcaaccgagtgccgaagaagaaagctttgatcgaggctatggagaaagctgacgtgaagaacaagtgggagaaaagctcttggggtaggaagctgatcgttcagaagcgtagggctagcctcaatgatttcgataggttcaagatcatgttggccaaaatcaagaaagctggtgttgtcaggcaagaacttgccaagctcaagaaggagatcaccgcttgagtactatctgcgaatcttgttattgtattttgggttttggatttactagcgttttgcaatttatcaactttgttgaatggatgttagtttcagttttgaaaccttttacaacnttcatcattcgtttaatgtcaaagatcctttacgacttcaatgtctataggacaacagttttctc

SEQ ID NO: 790 - DNA, 650 bp, Raphanus sativus
  misc_feature (224)..(224): n is a, c, g, or t
gggggccttcagctgctcttgctctcctcaactttttgcttctaaccttctaagcgaaaatggtgttcaagaggtacgtggagattgggagagttgcacttgtgaactacggaaaagaccatggaaagctcgtcgtcatcgtcgacgtcgttgaccagaacagggctttggtagacgcccctgacatggagaggatccagatgaacttcaagaggttgtctctnaccgatatcgtgattgagatcaacagagtcccaaagaagaaggctttgatcgaggccatggagaaggctgacgtgaagaacaagtgggagaagagctcatggggtaggaagcttatcgttcagaagcgtagggctagccttaatgattttgacaggttcaagatcatgttggccaaaatcaagaaagctggcgttgtcaggcaagagcttgcaaaactcaagaaggagatcactgcttgatcaaattgagtatttatctgcgtgtctttttttctttttgtattttggattggcaattagtgtttttggaaatctcagcatcattatctacactgttgtcggatcttaattccaagtttaaaaccttcgaaatatttagtttgttatttcatatttagctctctttactaaagttccatttgcttt

SEQ ID NO: 791 - DNA, 616 bp, Helianthus annuus
caacctttcttccggcgcctgcacttttacgcctccgaaaatgccattcaagaggtacgtcgagatcggaagaattgctcttgtcaactatggaaaggattatggaaagcttgtcgtcatcgttgacgtcattgatcaaaacagggctcttgttgatgcacctgacatggtgaggggccaaatgaatttcaaaaggctaacactcacagacatcaagattgacatcaaaagagtcccaaataagaaaactctaattgctgctttggaggctgctgatgtcaagaacaagtgggagagcagttcttggggaagaaagcttattgtgcagaggaagagagcatcacttaatgattttgaccggttcaagatcatgttggccaagattaagaaggctggagttgtaaggcaagagctagcaaagcttaagaaggaaaccacagcctaataatggcattttgtttttgatacaaaagatttttctcaactgttgaggaagctattattggttgcttagaagtttgtgttttacctgtttttgttctttatcaatgtatcaaaggagacctaatggcaagttttaaacttatgttttggttacaatttttatgaaaatgtt

SEQ ID NO: 792 - DNA, 642 bp, Thellungiella halophila
tgagctgctgctcgttcacgttttatttttcactcggagcttcgaccttccacagcaaccggcggcgaaaatggttttcaagaggtacgtggagatagggagagtggcacttgtgaactacggaaaggatcatggaaagctcgttgtaatcgtcgacgtcgttgaccagaacagggcattagtagacgcccctgatatggagaggatccagatgaatttcaagaggttgtctcttacagatatcgtgattgagatcaaccgtgtgccaaagaagaaggctttaatcgaggcaatggaaaaggctgacgtgaagaacaagtgggagaaaagctcatggggaaggaagcttatcgtgcagaagcgtagggctagcctcaacgattttgataggttcaagatcatgttggccaaaatcaagaaagctggtcttgtcaggcaagagcttgcaaaactcaaaaaggagatcactgcctgataaaattgaatattatctgcaagtctgtttttttttattttgggttggtaaattagtgtttttgcaaatctcagcatcattatctactcaattatcggatgttactttttaagtttgaaaccttgtttggaaaactcgagttgctatttgatcttgctctcatttct

SEQ ID NO: 793 - DNA, 781 bp, Rhizophora mangle
cacttcctgcattttgcagccctccgcctctgaccttgaagatgcctttccaaagatacgttgagatcgggagggtggctctcatcaactatggcaaggactatggaaagctcgttgtcatcgtcgatgtcgtcgaccagaaccgagctttagttgatgccccagatatggtgaggagccaaatgaacttgaagaggctttcgcttactgatatcaagattgatatcaacagggttccaaagaagaagaacttgattgaagctatggagaaagctgatgttaagaataggtgggaaaacagcgcttggggcagaaagctgattgttaagaaaagaagggcggttctcaatgattttgataggttcaagttaatgttggttaaaatcaagagggctggattagtaaggcaggagcttgcaaaattgaagaaagggaatgccgcttagaagtttccattatatggagttcccaattttgttattgaaagtttcaaaagtttcttttgaactgtcatccttttgtcttctgattgattgtttctttagataaaaaagcacttttcatgaaaccttctatttatggcagattctgtaactggttctatgatgcagctttgcttcttattgtattgttgtcactttgctacttatgtggagtctttctgtagttgtgttcatttgctgctcaaaagaagcactgcaagagcccttgttttccttgcttggaaagattgtggtttgtgtttagaaattgggttaatcttgggtggaagcatattcta

SEQ ID NO: 794 - DNA, 583 bp, Panax ginseng
ccgcctctctgcaggacgtataaacctcaacaaacatgccgttcaagcgttacgttgagatcgggagagttgcgctcgtgaactacggcaaagactacggcaagctcgttgtcatcgtcgatgttatcgatcagaatcgagctcttgtggacgcccctgatatggtgagaggccaaatgaattttaagaggctcacactaacagatatcacaattgacatcaaaaggaccccaaagaagaaggcactggttgaagcaatggaggctgcagacgttaagaacaagtgggagaacagctcatggggaaggaagcttattgttcagaaacgaagagcaacccttactgatttcgataggttcaagctcatgttggcaaaaataaagaaggctgggttggtcaggcaagagcttgcaaagctaaagaaggagaccactgcataaatattaggatatttaaaagtcaagacagttttgctatgaattttccccaagttatactattggataccttgctttataagatctgtatttcgttccatttttcatcgtaaagatttcggctggctggctggctgaactctgat

SEQ ID NO: 795 - DNA, 831 bp, Linum usitatissimum
gagtatcttctcaaccaaaacctcctataagagcctcctatcctcccagtaaaccctaatttgctctcaacttctgttcctctcgtctttctgcgggccgtcgtcacttcttagcaggcacacacctcaccagagcacaagatgggtttcaaaagatacgtcgagatcggacgggttgctctgatcaactacgggaaggactatggaaagctcgttgtcattgtcgatgtcgtcgaccaaaatcgggctctagttgattcacctgatatggttaggagccaaatcaatttcaagaggcttactctcactgacatcaagattgagattaacagagttcccaggaagaagactcttatcgaagccatggagaaggctgatgttaaaggaaagtgggagaacagctcttggggctgcaagttgatcgttaagcagaggagggcagctctcaccgactttgacaggttcaaggttatgttggcaaagatcaagagaggaggattgatcaagcaagagcttgccaagctgaagaagaccgccgcttaggattgaccgacccttaccatttcgtcaaattttgttgttggtagactgcaagctgttacgaatggagattttatttggttttgttttcatagacattgcctattttggaagaaattttcttaatgtgatgtgaccgtttctgtagaagctaagaacgcaaaatggcttaggttgtgtgttaaagattactagtattgtttgttctcttgttcttttcaactttctaatctgccccttgtagctccgtgtaagggctcaaaatttatcatcttcagggtgacttcgctt

SEQ ID NO: 796 - DNA, 537 bp, Arnica chamissonis
ctgcaactggtcgcttgaaaaaatgccgttcaagaggtacgttgagatcggaagaatagccctcgttaactatggaaaggattacggaaagctcgtagtgatcgtcgatgtcatcgatcaaaacagggctcttgttgattctcctgacatggtaagaggccaaatgaactttaagaggctaacactcacagacatcaaaatcgacattaaaagggttccaaacaagaaaactcttattgctgccatggaggctgctgatgtcaaaaacaagtgggaaaacagctcgtggggaagaaaactcattgttcaaaagaagagagcctcgctcaacgattttgatagattcaagattatgttggcaaagataaagaaggcgggagtcgttaggcaagagctagccaagctaaagaggagaccgcttgattattgagatcttggtgtcgtttatttgatttgcggtttgggtagatcaatgttgtttcttaggagtttatgattgaccttttacaagggattaaagagatgttttagagtttt

SEQ ID NO: 797 - DNA, 793 bp, Artemisia annua
tactccgacggggatagccacttgaactcccctctcatcggcgctctgcaaaaaacactctcctcaaaacaccaaaaacaaaaatgccgttcaagaggtacgttgagataggaagaattgcacttgtcaactatggtcctgattacggaaagcttgttgtcatcgttgacgtcatcgatcaaaacagggctcttgttgatgctcctgacatggtgaggggtcaaatgaacttcaagaggctaacactcacagacatcaaaattgacatcaaaagagttccaaacaagaagactcttgttgctgctttggaagccgctgatgtcaagaacaaatgggaaagcagctcatggggaagaaaactcattgttcaaaagaagagagcctcacttaacgatttcgacaggttcaagattatgttggcaaagattaagaaagcgggagtcgttaggcaagagctagccaagcttaagaaggaggctgcataagattttggtgcatttttatttgaattgttgttgagtagaccagtgttggttattaggagtttgtgttttgaccttctacagtggattaaagggttgtttagaattttgtttgattcagttttgaaccttcatgtttgcttcttgtatctttattctatgttctgtctctttttaatgatttcagctctctgagtaagccttggttacgcactgtggtttgttattagtgcgtaagcgcaagcaacttcaaatacttaacaaaatgaagaatatccagagataaaaattgtatctacttagatttgcaa

SEQ ID NO: 798 - DNA, 571 bp, Brassica juncea
gcgaaaatggtgttcaagaggtacgtagagattgggagagttgctcttgtcaactacgggaaagatcatggaaagcttgtcgtcatcgtcgacgtcgttgaccagaacagagctttggtagatgctcctgatatggagagaattcagatgaacttcaagaggctgtctcttaccgatatcgtgattgagatcaacagagtgcctaagaagaaggctttgatcgaggccatggaaaaggctgacgtgaagaacaagtgggagaagagctcatggggtaggaagcttattgttcagaagcgtagggctagcctcaatgattttgacaggttcaagatcatgttggccaaaatcaagaaagctggcgttgtcaggcaagagcttgcaaaactcaagaaggagatcactgcttgatcagattgagtactatctgcttatctgttttttttgtatttttgattggcaattagtgtttttacgaatctcaacatcaatatctatctacactgttgtcggattttgaaaccttgtttcttaaaatttagtttgttatttcatctttacctcttctttt

SEQ ID NO: 799 - DNA, 606 bp, Brassica juncea
agctgctgttactctcctcctctttgcttctacattccaagctaaagcagcgaaaatggtgttcaagaggtacgtagagattgggagagttgctcttgtcaactacgggaaagatcatggaaagcttgtcgtcatcgtcgacgtcgttgaccagaacagagctttggtagatgctcctgatatggagagaattcagatgaacttcaagaggctgtctcttaccgatatcgtgattgagatcaacagagtgcctaagaagaaggctttgatcgaggccatggaaaaggctgacgtgaagaacaagtgggagaagagctcatggggtaggaagcttattgttcagaagcgtagggctagcctcaatgattttgacaggttcaagatcatgttggccaaaatcaagaaagctggcgttgtcaggcaagagcttgcaaaactcaagaaggagatcactgcttgatcagattgagtactatctgcttatctgtttttttttgtatttttgattggcaattagtgtttttacgaatctcaacatcaatatctatctacactgttgtcggattttgaaaccttgtttcttaaaatttagtttgttatttcatc

SEQ ID NO: 800 - DNA, 554 bp, Brassica juncea
gcgaaaatggtgttcaagaggtacgtggagatcgggagagttgctcttgtgaactacggaaaggaccatggaaagctcgtcgtcatcgtcgacgtcgttgaccagaacagggctttggtggacgcccctgacatggagaggatccagatgaacttcaagaggttgtctcttaccgatatcgtgattgagatcaacagagtcccaaagaagaaggctttgatcgaggccatggagaaggctgatgtgaagaacaagtgggagaagagctcatggggtaggaagctcatcgtgcagaagcgtagggctagcctcaatgattttgacaggttcaagatcatgttggccaaaatcaagaaagctggcgttgtcaggcaagagcttgcaaaactcaagaaggagatcactgcttgatcgaatttttgtattatctgcgtatcttgttttggtattttggactggaaattaatgtttttgcaagtctcaacatcaatatctactctgttgtcagattttagtttcaagtttaaaccttgtttcgaaaatttagtttgtta

SEQ ID NO: 801 - DNA, 559 bp, Brassica juncea
ttgctctcttccactttgcttcaaccttcaaagcttccgccgcgaaaatggtgttcaagaggtacgtggagatcgggagagttgctcttgtgaactacggaaaggaccatggaaagctcgtcgtcatcgtcgacgtcgttgaccagaacagggctttggtggacgcccctgacatggagaggatccagatgaacttcaagaggttgtctcttaccgatatcgtgattgagatcaacagagtcccaaagaagaaggctttgatcgaggccatggagaaggctgatgtgaagaacaagtgggagaagagctcatggggtaggaagctcatcgtgcagaagcgtagggctagcctcaatgattttgacaggttcaagatcatgttggccaaaatcaagaaagctggcgttgtcaggcaagagcttgcaaaactcaagaaggagatcactgcttgatcgaatttttgtattatctgcgtatcttgttttggtattttggactggaaattaatgtttttgcaagtctcaacatcaatatctactctgttgtcagattttagttt

SEQ ID NO: 802 - DNA, 600 bp, Brassica napus
gaacattcaagctaccgccggcgaaaatggttttcaagaggtacgttgagatcgggagagtggctcttgtgaactatggaaaggaccatggaaagctcgtcgttatcgtcgacgtcgttgaccagaacagggctttggtagacgcacctgacatggagaggatccagatgaattttaagcggttgtctcttacggacatcgtgattgagatcaatcgagtgccaaagaagaaggctttgatcgaggccatggagaaggctgacgtgaagaacaagtgggagaagagctcgtggggtaggaagctcatcgttcagaagcgcagggctagcctcaatgatttcgacaggttcaagatcatgttggccaaaatcaagaaagctggtgttgtcaggcaagagcttgcgaaactcaagaaggagatcactgcctgatcagattgaggattatcttctgcatctctgtttttcgattttgaattggtagttagtgtttttgaaagtgtcaactccgttatctactctattgtcggatgttaaaatttcaagtttgaatgaaaccttgtttaggagaaaaaaaaaaaaaacaaaaaaagaacgagcc

SEQ ID NO: 803 - DNA, 674 bp, Brassica napus
ggcgaaaatggttttcaagaggtacgtggagatcgggagagtggctcttgtgaactatggaaaagaccatggaaagctcgttgttatcgtcgacgtcgttgaccagaacagggctctggtagacgcacctgacatggagaggatccagatgaacttcaagaggttgtcacttactgacatcgtgattgagatcaaccgagtgccaaagaagaaggctttgatcgaggccatggagaaggctgacgtgaagaacaagtgggagaagagctcgtggggtaggaagctcatcgttcagaagcgcagggctagcctcaatgatttcgacaggttcaagatcatgttggccaaaatcaagaaagctggtgttgtcaggcaagagcttgcgaaactcaagaaggagatcactgcctgatcagattgaggattatcttctgcatctctgtttttcgattttgaattggtagttagtgtttttgaaagtgtcaactccgttatctactctattgtcggatgttaaaatttcaagtttgaatgaaaccttgtttggaagacgtcgttttgttgtttgatctttactctttcgctaaaaaatatctattttctgatcatgtctttaatcaattcacactttttgtataacttttgaattagtctcaagttgagactaactgaag

SEQ ID NO: 804 - DNA, 783 bp, Citrus clementina
gtggagataggaagagttgctctcgttaattacggcaaggactatgggaagcttgtggtcatcgtcgatgtccttgatcaaaacagggctcttgttgatgcccctgatatggtgaggagccaaatgaacttcaagaggctttctctcacggatattaagattgacatcaatcgagttcctgggaagaagtctttgattgaagccatggagaaggctgatgtgaaaaacaaatgggaaaacagctcctggggcaagaagctgattgtccagaaaaggagagtggcactgaatgattttgataagttcaagctcatgttggcaaagatcaagaagggtggacttattcgacaggagcttgcaaaactcaagaaggagaatgcagcatagaatttctctcttgtgttcccctttctggtttttaattcttacagcttcaatttgattctattaatgtattgattaatatgagaaaacatcaacttggcatttttgggtggggtgtgcaaggtgatctgcacgaccgcgagagcttggtgaaagccatcaagcaagtggatgtggtgatatcaacggttggcagcatgcagctagcagatcagaccaagctcatcactgccattaaggaagttggcaatgttaagatttgatcaatgtgtttgaagtgtttattcctcaacttcacttatatcctaacccatacagtctattgaatggagaagctgctggtgtgataacgcaattatactactcatattcaaagagtgaaaggcagtcatccttctc

SEQ ID NO: 805 - DNA, 479 bp, Fagopyrum esculentum
tttacttgtttccgttctctgttccggctggtggctcatccaaatctcagcaaaaatgccgttcaagagattcgtcgagatcggaaggatcgctctcatcaactacggtaaggattatggccagctcgtcaccatcgtcgacgtcattgatcaaaacagagctcttgttgatgcccctaacatggtaaggtgccaaatgaacttcaagaggctcacacttacagacatcaagattgacatccctaggataccaaagaaaaagacacttatcgaggctatggaagctgctgacgtgaagaacaagtgggagagcagctcttggggaaggaagttgatagttcagaagaaaagagctgcactcaacgactttgacaggttcaagatcatgttggccaaaatcaagaaagctggtgcagtgaggcaggaactcgcaaagttgaaaaaggcaacggcctagttcattgtctgttgattttcag

SEQ ID NO: 806 - DNA, 760 bp, Linum usitatissimum
tcaagttctgttcctctcgtctttctgccggcagtcgtcacttcttcgcaggcacacacctcgccggagctgaagatgggtttcaaaagatacgtcgagatcggacgcgttgctctgatcaactacgggaaggactacggaaagctcgttgtcattgtcgatgtcgtcgaccaaaatcgggctctagttgattcacctgatatggttaggagccaaatcaacttcaagaggcttactctcaccgacatcaagattgagattaacagagttcccaggaagaagactcttatcgaagccatggagaaggctgatgttaaaggaaagtgggagaacagctcttggggccgcaagttgatcgttaagcagaggagggctgctctcaccgacttcgacaggttcaaggttatgttggcaaagatcaagagaggaggattgatcaagcaagagcttgccaagctgaagaagactgctgcttaggaccgacccatttcgtcaaattttgttgttggtaaactgcaacctgttacgaagggagagtttatttggttttgttttcacagatacattgcctatttggaaggaaattttcttaatgtgatgaccgtttctgtagaagctaagaatgcaatatggttttggttgtgtgttaaagattactagtactgtttgttctcttgttctattgaaccctcgaatctgcaccttgttgctctatgaaggggctcaaatttatcattttcaggtgacttcgtttacagag

SEQ ID NO: 807 - DNA, 539 bp, Lippia dulcis
cacattcacttctttgcagcagaaaatggtgttcaagaggtacgtcgagatcgggcgggtcgccctcgtcaactacggaaaggactatggcaagctcgtcgtcatcgtcgacgtcatcgaccaaaacagggctcttgttgactcccctgatatggtcagaagacagatgaacttcaagaggctatctcttacggacatcaagattgacatcaagagggtgccaaagaagaagactcttgttgcagctatggaggctgctgatgttaaggggaaatgggaaagcagctcatggggacgaaagttgattgttcagaacagaagggctgccctcaatgattttgaccgatttaagcttatgttggccaaaatcaagaaagcgggtgttgtccgacaagagcttgccaaagttaagaaagaaattcctgcatgagtattatagtattttggcttaggattttgatacctgtatctgtttcttatgctgcccttgctattgaaatccaagagttaaatttttatttcatattctttggcggaca

SEQ ID NO: 808 - DNA, 909 bp, Trigonella foenum-graecum
ccgaatagaggcccattcttttaccctctttataaaatatcacaaaaccctaattttgataacactcctctctaacctttgtttctgctgcgagtgcctccgacaaacgaaaatgccgttcaagaggttcgtcgagatcgggagagttgctcttgtcaactacggcaaagactatggcaaactcgttgtcattgttgatgttatcgaccaaactagggctcttgttgatgcacctgacatggaaagagtcccaatcaatttcaagaggctttctctaactgatatcaagattgatatcaagagagtccctaagaagaaggatctcgttaaggccatggaagctgctgatgtgaagaacaagtgggagaagagctcatggggaagaaaattgattgttaagaagaggagggctgcccttaatgattttgataggttcaagattatgttggcaaagattaagagggctgctgttgttaggcaagaacttgctaagctgaggaagaccgcagcttaggcattacttcatgatacaattttcaaattttgttattgatttccgtctatttagtacaatttggatgtttgagtgttttgtatcactaagacagtttgataaatgtttgatcctaagatatttttgtgttacgatatttatgttagtactcagttttccattttttccttttgattgcatatcttttaatgttggtcttctgataatatatgaccaagcaagcgagagctagcggttttattgttattaggtttgcatttttttttttgttggttctgttcttatttacaaatctgttggtagtttcaaatggcaacttcattttctaattcatgacatgtactataccttcacaaatgctccaatactaaaatattctccaatttctttatttg

SEQ ID NO: 809 - DNA, 663 bp, Vinca minor
ctcttctcccttctctcggtttcacctccctccgccgcagatcgacgaaaatgccgttcaaaaggtacgtggagatcggaagggtcgctctcgtcaactatggagaggattacggcaagcttgtcgtcatcgtcgacgtcatcgaccaaaacagggctctggttgattcccctgacatggtaagaagccaaatgaacttcaagaggcttgcacttacagatatcaagattgacattaaaaggatcccaaacaagaagtctttggttgctgctatggaggctgctgatgtcaagaacaagtgggagaacagttcctggggtaggaagcttattgtgcaaaagaaaagagcctccctcaatgattttgatcgattcaagctcatgttggcaaaaatcaagaaagctggagttgtgaggcaggagcttgcgaagcttaagaagcaggcagcataagaaggcttttcttctgaattttaaatttgatatagttttggatttggtaaaattgtagaagagaaacatgatttttattcaatcgttttggatgcatttacgaagtcttgtattattatcatattgatgggtttacaattgacatgctttttcgaggcttctagggttctttcttttgcctagtgttatgtgaacatttaaagcttaattc

SEQ ID NO: 810 - DNA, 837 bp, Amborella trichopoda
tcaacacaaaaccctaattttcagaagtagcgggaccccggcttcttccaaaaccgttgcttgcaagagcaagcgaaaccctagttttcgaagatctagttctctgcaacttctccttttcgtgacatcaaagctccaatcatgcctttcaagcgatacgtggaaattgggagagttgctcttgtgaattatggaaaggattatggaatgcttgttgtgattgtggatgttatcgaccagaatcgggctttggttgatgctcccaaaatgattcggacacaaatgaacttcaagcggctttcactgaccgatattaagattgatattcctagggtgccgaaaaagaagtctctgattgcagcaattgaagcagctgatgtgtacaagaagtgggagaacagctcatggggaaggaagctgattgtgcagaaacagagagcatccctcactgatttcgacaggttcaaggtcatgctggcgagaatcaagagagctggcttgataaggcaagagctaagtaaattgaagaagcaaagcgccagctaagtgcttgagggaaaattttgtttgctgcatttctattattttctggtgattttcaatgttttgtagaacctttcaagcgagtattgtggatctctctttcctggacctctggttcgtttatggaagttattttttttatggaacttgactaagagcctcaatggttgtggccttattttatttggaaaagctttgcagttttttccgtttcattgtgagtagattttttatggaaaagtatacaaacagagggcatttacttttaatacaaagagatgacaatcatttttg

SEQ ID NO: 811 - DNA, 688 bp, Brassica rapa
acctagacgcttacgctgttgctcgtcccacttcgcttcccaccttccaaacctaccggcggcgaaaatggttttcaagaggtacgtggagatagggagagttgctcttgtcaactacggaaaagaccatggaaagctcgtcgttatcgtcgacgttgttgaccagaacagggctttggtagatgcccctgatatggagaggatccagatgaatttcaagagattgtctcttactgatatcgttattgagatcaaccgagtgccgaagaagaaggctttgatcgaggccatggagaaggctgacgtgaagaacaagtgggagaagagctcatggggtaggaagctgatcgttcagaagcgtagggctagcctcaatgacttcgataggttcaagatcatgttggccaaaatcaagaaagctggtgttgtcaggcaagaacttgcaaagctcaagaaggagatcactgcttgagttatattatctgcgaatctgttattgtattttgggttttggattactagcgttttgcaacttatcaactctgttagtttcagttttgaaacctccttcacaactttcatctttcgtttaatgttaaaaaacttttgcgacttccatatctttatgacaacagttaaaaagtgatggttctaattttgaaatgaagattaagaccttattcccttt

SEQ ID NO: 812 - DNA, 674 bp, Brassica rapa
ctctgcttcgaacattcaagctaccgccggcgaaaatggttttcaagaggtacgtggagatcgggagagtggctcttgtgaactatggaaaagaccatggaaagctcgttgttatcgtcgacgtcgttgaccagaacagggctttggtagacgcacctgacatggagagaatccagatgaacttcaagaggttgtcacttactgacatcgtgattgagatcaaccgagtgccaaagaagaaggctttgatagaggccatggagaaggctgacgtgaagaacaagtgggagaagagctcgtggggtaggaagctcatcgttcagaagcgtagggctagcctcaatgatttcgacaggttcaagatcatgttggccaagatcaagaaagctggtgttgtcaggcaagagcttgcaaaactcaagaaggaaatcactgcctgatcagattgaggactatctgcatctctgtttttcgattttgattggtagttagtgcttttacaagactgtctactctattgtcggatcttaaattaaagtttgaatgaaaccttgtttggaagacttcattttgttgttcgatcttgctctcttcactaaagacatgtttactttctagccacgtcttaattcgattcacattctttccaaattttgaatcaatctattccaaag

SEQ ID NO: 813 - DNA, 692 bp, Brassica napus
cagctgctgttgctctcctcctctttgcttctacattccaagcaaaaccggcgaaaatggtgttcaagaggtacgtggagattgggagagttgcacttgtcaactacggaaaagatcatggaaagcttgtcgtcatcgtcgacgtcgttgaccagaacagggctttggtagatgctcctgatatggagagaatccagatgaacttcaagaggctgtctcttaccgatatcgtgattgagatcaacagagtcccaaagaagaaggctttgatcgaggccatggaaaaggctgacgtgaagaacaagtgggagaagagctcatggggtaggaagctcattgttcagaagcgtagggctagcctcaatgacttcgacaggttcaagatcatgttggccaaaatcaagaaagctggcgttgtcaggcaagagcttgctaaactcaagaaggagatcactgcttgatcagattgagtactatctgcttatctgtttttttttgtatttttgattggcaattagtgtttttacgaatctcaacatcaatatctatcacactgttgtcggattttgaaaccttgcttcttaaaatttagtttgttatttcatctttacctcttcttttacaaaagttccatttgcttattgtctttttctttaatttcttcgttttaagttataataactttaaagaga

SEQ ID NO: 814 - DNA, 630 bp, Lactuca sativa
cgcggggatgtattcatcccaccgtctctgctctcctaggcgctgagcaactggtcgcctgaaaaatgccgttcaagaggtacgtggagattggaagagtagccctcgtcaactacggaaaggattatggaaagctcgttgtgatcgtcgatgtcatcgatcaaaacagggctcttgttgattctcctgacatggtgaggggccaaatgaacttcaagaggctaacactcacagatatcaagatcgacatcaacagagttccaaacaagaaaactctcattgctgctttggaggctgcagatgttaagaacaagtgggaaagcagttcatggggaagaaagctcattgttcaaaagaagagagcatctcttaatgattttgataggttcaagattatgttggcaaagataaagaaggctggtgttgttaggcaagaactagccaagcttaagaaggagactgcatgatcttgtcatttgtgctcaagattttgctacagtttatttgaattgttgttgagttgaccagttttggattctaggtgcttatgtttgaccttttacaaatgattgttagaaactttttccaattcaattttgaacttctatatttgcttcatgttttgtgttt

SEQ ID NO: 815 - DNA, 797 bp, Lactuca sativa
cctaactataaaagggactctccgtcaaaaaccctaattttcatcgtattcatccacaccgtctctgctctcctaggtgctgagcaactggtcgcctgaaaaatgccgttcaagaggtacgtggagattggaagagtagccctcgtcaactacggaaaggattatggaaagctcgttgtgatcgtcgatgtcatcgatcaaaacagggctcttgttgattctcctgacatggtgaggggccaaatgaacttcaagaggctaacactcacagatatcaagatcgacatcaacagagttccaaacaagaaaactctcattgctgctttggaggctgcagatgttaagaacaagtgggaaagcagttcatggggaagaaagctcattgttcaaaagaagagagcatctcttaatgattttgataggttcaagattatgttggcaaagataaagaaggctggtgttgttaggcaagaactagccaagcttaagaaggagactgcatgatcttgtcatttgtgctcaagattttgctacagtttatttgaattgttgttgagttgaccagttttggattctaggtgcttatgtttgaccttttacaaatgattgttagaaactttttccaattcaattttgaacttctatatttgcttcatgtttttttttattttttttttattttttttattttttgcaaattgccaagtcaaaatagttaaatatggataggaggttggtcgtctaggtcatatttcaaacaccgttcatattctgaaagaaaacataacataagtcaa

SEQ ID NO: 816 - DNA, 566 bp, Vaccinium corymbosum
cctcatcctcgcagaccaaaatgccgttcaagcgttacgtcgagatcgggagggtggctctggttaactacggcaaatattgggtagtacttcgttcgttatcgtcgacgttatcgaccaaaacagggctcttgtggatgcccctgacatggtgagatgccagatgaactttaagaggctttctctcactgacatcaccattgacatcaaaagggccccaaagaagaaaacactgattgctgcaatggaggctgcagatgttaagaacaagtgggagaacagctcctggggcagaaagctgattgtgcataaaagaagggccgctcttaatgattttgataggttcaagctcatgttggcaaaaatcaagagggtggactgatcagaaaagagcttgcgaagctagaaaaagcagaatgcagcctaggcataacgtttctatgatcatgcccgtaattttggtacgtatttttcgaaggttgtactgatggctagttttgatttgtttctttctaatttacagtttgagaactgtctgtattctattaagagatcccagaatttgg

SEQ ID NO: 817 - DNA, 417 bp, Citrus clementina
ttgataattgaaagtttatatgtggagataggaagagttgctctcattaattacggcaaggactatgggaagcttgtggtcatcgtcgatgtccttgatcaaaacaaggctcttgttgatgcccctgatatggtgaggagccaaatgaacttcaagaggctttctctcacggatattaagattgacatcaatcgagttcctaagaagaagtctttgattgaagccatggagaaggctgatgtgaagaacaaatgggaaaacagctcctggggcaagaagctgattgtccagaaaaggagagcggcactgaatgattttgataagttcaagctcatgttggcaaagattaagaagggtggacttattcgacaggagcttgcaaaactcaagaaggagaatgcagcatagaatttctct

SEQ ID NO: 818 - DNA, 550 bp, Brassica juncea
gcgaaaatggtgttcaagaggtacgtggagattgggagagttgcacttgtcaactacggaaaagatcatggaaagctcgtcgtcatcgtcgacgtcgttgaccagaacagagctttggtggatgctcctgacatggagaggatacagatgaacttcaagaggctgtctcttaccgatattgttattgagatcaacagagtgcctaagaagaaggccttgatcgaggccatggagaaggctgacgtgaagaacaagtgggagaagagctcatggggtaggaagcttatgttcagaagcgtagggctagcctcaatgattttgacaggttcaagatcatgttggccaaaatcaagaaagctggagttgttaggcaagagcttgcaaaactcaagaaggagatcactgcttgatcgaattcagtattatctgcgtatcttgtttttgtattttggattgacaattagtgtttttgaaaatttcaacatcaatgtctacactgttgtcgaatattagttccaagtttaaaaccttgtttcgaaatatttagttt

SEQ ID NO: 819 - DNA, 459 bp, Brassica juncea
gcgaaaatggttttcaagaggtacgtggagatagggagagttgcccttgtcaactacgggaaagaccatggaaagctcgtcgttatcgtcgacgttgttgaccagaacagagctttggtagatgcccctgatatggagaggatccaaatgaatttcaagaggttgtcgcttacagatattgtgattgagattaaccgagtgccgaagaagaaggctttgatcgaggctatggagaaagctgacgtgaagaacaagtgggagaagagctcatggggtaggaagcttattgttcagaagcgtagggctaacctcaatgattttgataggttcaagattatgttggccaaaatcaagaaagctggtgttgtcaggcaagaacttgcaaagctcaagaaggagatcactgcttgagtatattatctgcgaatttgttattgtattttgagttttggattacta

SEQ ID NO: 820 - DNA, 598 bp, Bupleurum chinense
cagcagcagccatgcctttcaagcgttatgttgaaatcgggagagtcgccctcgtcaattatggcaaagactatggcaaactcgttgtcatcgtcgatgtagtcgatcagaatcgagctcttgttgattcgccggatatggttagatgccaaatgaatttcaagaggcttacactaaccgatatcactattgacattaagaggaccccgaagaagaaggtgctgattgaagcaatggaagctgcagatgtcaagaacaagtgggaaaacagctcttggggaagaaaactgattgttcagaaaagaagagctgctcttaccgattttgataggttcaagctcatgctggccaagataaagaaagctagtttggtcagggaagagcttgcgaagctgaagagagaggttaaagcataattacattagagttgttctgttatgaaattttcaccatctggtgttttggtgtttcattctcttgcactgatgcatactttgtttctctttggtatgccaagattgtttagatacatttttaaattgatgtgccgtgataattatgcagtgggtgtcccaatcatggaccataatttggtaaa

SEQ ID NO: 821 - DNA, 535 bp, Centaurea maculosa
gcggggatcttatcagctccgcctcgatagttcttcattcttctcggcgctctacatctagggcttgaaaatgccgttcaagaggtacgttgaaatcggaagaatcgcacttgttaactacggaaaggattatggaaagctcgtcgttatcgttgatgttatcgatcaaaacagggctcttgttgactcacctgatatggtgagaggccagatgaatttcaaaaggctaacactcacagacatcacgatcgacatcaaaagagtcccaaacaagaaaactctgatcgctgccttggaggctgctgatgtcaagaacaagtgggagagcagttcttggggaagaaagcttatcgtgcagaagaagagagcatctcttaatgatttcgataggttcaagatcatgttggccaagataaagaaagctggagttgtcaggcaagagcttgcaaagcttaagaaggaaacaacagcttaatatctttgattttgttctactacttattacagacttttattgaggaaaccattgttggtt

SEQ ID NO: 822 - DNA, 605 bp, Helianthus annuus
cgaaaatgccgttcaagaggtacgttgagatcggaagagtcgcacttgtcaactacggcaaggattacggaaagctcgtagtcatcgttgatgtcattgatcaaaatcgggctcttgttgatgcacctgacatggttaggggtcaaatgaactttaaaaggctaacgcttaccgacattaagattgatattaaacgggtcccaaataagaaaactttggttgctgctttggaggctgctgatgtgaagaacaagtgggagagcagttcgtggggtagaaagcttatcgtgcagaagaagagagcgtcacttaatgattttgataggttcaagatcatgttggctaagataaagaaggctggagttgtaaggcaagaactttcaaagctgaagaaggaaaccacatgctagtgtcataatttttgttctaattatttaagattttgttgatgctggttgcttacatttttttcatcttgtattaaaatggcaagttttaaacttatgcttttgtttacgtttgctacgagaatgatctgctgctgtcaatttggtagatcaagtatggaacacataaccatatcaatgcacgtgaacctttgaata

SEQ ID NO: 823 - DNA, 614 bp, Eutrema halophilum
atgtgtgtgactccggtttatctcttcctggaatcaaaccggttttctgtaaaccattcttattggtatccgatagtaggtttctggttttcttctcctcttaagaaaaaccctagaacttctcttttgcgcctctcgtctcttcttcccttcaagcgttcagctcaaccgaagaaaatggttttcaagagatacgtcgagataggacgagtggctctcgtcaacttcggaaaagactatgggaagctcgtcgtcatcgtcgatgtcgtcgaccaaaacagggctcttgtggacgcccctgacatggagagaatccagatgaacttgaagaggctgtctcttaccgatatcgtgattgatatcaacagagtgccgaagaagaagaatctgattgaggcaatggagaaagctgatgtgaagaacaagtgggagaagagttcatggggcaggaagctgatagtgcagaagagaagagctgccctcaatgactttgatcggttcaagatcatgttggccaaaatcaagagggctggtgtggtgaggcaggagcttgcaaagctcaagagagagagcaccgcttgatgttttcaaaaatgttcctatgctttcagatt

SEQ ID NO: 824 - DNA, 470 bp, Eutrema parvulum
tcacttcgattttcctccatttgtgttcatatattttgcctgtccgtgtacaggttttcaagagatacgtcgagatagggcgagtagctcttgtaaacttcggaaaggaccatgggaagctcgtcgtgattgtcgacgtcgtcgaccaaaacagggctcttgtggatgcccctgacatggagagaatccagatgaacttcaagaggctgtctcttaccgatattgtgattgatatcaacagagtgcctaagaagaagaatctgattgaggcaatggagaaagctgatgtcaagaacaagtgggagaagagttcatggggtaggaagctgatagtgcagaagagaagagctgccctcaatgactttgataggtttaagatcatgttggccaaaattaagagggcgggtgttgtgaggcaggagcttgcaaagctgaagaaagagatcaccgcgtaatgatttttctaatga

SEQ ID NO: 825 - DNA, 697 bp, Citrullus lanatus
agtttctatcctgtgaattgtctatgaattctgtgttctttttattggttctgtagcctttcaagaggttcgttgagatcggaagggtcgccctcgtcaactacggcgaagactatggaaagctcgtcgtcattgtcgatgtcattgaccagaacagagctttggtggatgctcctgatatggtcaggtctcaaatgaactttaagagactttctcttactgatattaaaattgacattaagagggtccctaggaagaaggaactcattgaagctatgaaggctgctgatgttcagaaaaagtgggaggatagctcttgggggaggaaactgcttgtcaagaagaggagggcatccctgaatgattttgataggttcaagctaatgttggccaagataaagagagctggattggtcaggcaggagcttgcaaagctgaaaaagagtgaatcttagaaagcgcatttctttagcttcaaattttgttagagaacaatttatcgggtgtggtttgttatcccttttgtttcttaagcccttgagactggggggtgtatctgaagtgcatggaattttggacatcaagtgtagtggatttttcccaatgtgccaacattaatcgaagttaattaaaaatacatacttgaatctgctggtgttttcctacttaagtgttaaatcagatttttgaactactt

SEQ ID NO: 826 - DNA, 669 bp, Arabidopsis thaliana
cctctgctgtcgctcgtctacatttacactcggagcttagaccttccaatctaccggcggcgaaaatgggtttcaagaggtacgttgagatcgggagagtagcacttgtgaactacggagaagatcatggaaagctcgtcgttatcgtcgacgttgttgaccagaacagagctttggtggatgcccctgatatggagaggatccagatgaacttcaagaggttgtctcttaccgatattgtcattgacatcaaccgtgtgccaaagaagaaggctttgatcgaggcaatggaaaaggctgatgtgaagaacaagtgggagaaaagctcatggggtaggaagcttatcgtgcagaaacgtagggctaaccttaacgactttgataggttcaagatcatgttggccaagatcaagaaagctggtgttgtcaggcaagagcttgcaaaactcaagaaggagatcactgcctgatcaaatattatctacaattctgttgtctttcttttttgattttggattcggaaattagtgtttttggaactatcaatatcagtatgtgctcaattatcagacattattcaagtttgaaaccttgtttgcaaaactcaaagttttttgttcttttgatcttagtcttattttcgtttatatggttctatgttatgattct

SEQ ID NO: 827 - DNA, 619 bp, Brassica oleracea
ggcttcgaacattcaagctaccgccggcgaaaatggttttcaagaggtacgttgagatcgggagagtggctcttgtgaactatggaaaggaccatggaaagctcgtcgttatcgtcgacgtcgttgaccagaacagggctttggtagacgcacctgacatggagaggatccagatgaattttaagcggttgtctcttacggacatcgtgattgagatcaatcgagtgccaaagaagaaggctttgatcgaggccatggagaaggctgacgtgaagaacaagtgggagaagagctcgtggggtaggaagctcatcgttcagaagcgcagggctagcctcaatgatttcgacaggttcaagatcatattggccaaaatcaagaaagctggtcttgtcaggcaagagcttgcgaaactcaagaaggagatcactgcctgatcagattgaggattatcttctgcatctctgtttttcgattttgaattggtagttagtgtttttgaaagtgtcaactccgttatctacttgtcggatgttaaaatttcaagtttgaatgaaaccttgtttggaagacttcattttgttgtttgatcaggccttaattcgattcacatttttcc

SEQ ID NO: 828 - DNA, 613 bp, Centaurea maculosa
  misc_feature (58)..(58): n is a, c, g, or t
  misc_feature (60)..(60): n is a, c, g, or t
  misc_feature (406)..(406): n is a, c, g, or t
  misc_feature (490)..(490): n is a, c, g, or t
  misc_feature (560)..(560): n is a, c, g, or t
  misc_feature (570)..(570): n is a, c, g, or t
  misc_feature (589)..(589): n is a, c, g, or t
  misc_feature (600)..(600): n is a, c, g, or t
  misc_feature (605)..(605): n is a, c, g, or t
gcggggatcttatcagctccgcctcgatagttcttcattcttctaggcgctctaatcngngcttgaaatgccgttcaagaggtacgttgaaatcggaagaatcgcacttgttaactacggaaaggattatggaaagctcgtcgttatcgttgatgttatcgatcaaaacagggctcttgttgactcacctgatatggtgagaggccagatgaatttcaaaaggctaacactcacagacatcacgatcgacatcaaaagagtcccaaacaagaaaactctgatcgctgccttggaggctgctgatgtcaagaacaagtgggagagcagttcttggggaagaaagcttatcgtgcagaagaagagagcatctcttaatgattttgataggttcaagatcatgttggcnaagataaagaaagctggagttgtcaggcaagagcttgcaaagcttaagaaggaaacaacagcttaatatctttgattttgttcnactacttattacagacttttattgaggaaaccattgttggttgcttagaagcttgtgtttttattctctnttcatgtatnaaaggaaacctaatgccanttttgaacttntgttntggtcgct

SEQ ID NO: 829 - DNA, 621 bp, Taraxacum officinale
gcggggggacactatctgcatcacttcagcttcttctcggcgcaccacatccaggactccaaaatgccgttcaagaggtacgttgagatcggaagaatcgcccttgtcaactacggaaaggattatggaaagctcgttgttatcgtcgatgtcatcgatcaaaacagggctcttgtcgattcacctgacatggtgaggggtcaaatgaatttcaagaggctaacacttacagacatcaaaatcgacattaacagagtcccaaacaagaaaactcttgttgctgctttagaggctgctgatgttaagaacaagtgggagaacagctcttggggaagaaagcttattgtccagaagaaaagagcctcacttaatgattttgacaggttcaagatcatgttggcaaagattaagaaagctggagttgtaaggcaagagttagccaagcttaagaaggaaaccacagcttaatatattcatcattttgtctttaattattaaagattttgttgaggaatatccattgttggttgattagaagctttgtgttttttgtgctttacctttctttttgtattaattaaaagaaaccattttgcaagcctaaaaaaaaaaaaaaaaaaa

SEQ ID NO: 830 - DNA, 692 bp, Cucumis melo
ctcctcacagttgctaacccttagccaccaaaaatgcctttcaagcggtatgttgagatcgggaggattgccctcatcaactatggtgaggattacgggaagcttgttgtaatcgttgatgtaattgaccagaaccgggctttggtcgatgcccctgatatggagcgttctcaaatgaactttaagagactctccttgaccgatatcaaaattgatattaagagggtcccgaagaagaaggaactgattgaagccatgaaagctggggatgttcagaagaaatgggagaatagctcttggggcagaaaattgattgttaagaagagaagagcctcactcaatgacttcgacaggttcaagcttatgttggcgaagattaagagggctggattggttaggcaagagcttgcaaagttgaagaaggccgaggcttagaggttcatttttcgaagggattttctcattttgctctttcgactttcttttaacttctataggtcgttgatttatagttcaaacttttttgtagtagtattattgcattaagtcattgtgttccaccaacttcttccatttttaatcttattacgccaatttcttatttggatttcaatatcgtcacaactttatcaccctctaggtaaaagatccttgttttaattcgattggttgcgggtattggtttttaaaaa

SEQ ID NO: 831 - DNA, 815 bp, Arachis hypogaea
ggggacgtcgtcctttataaaactaactacaaagcgcaatacaaaaccctagctttctctgttctcactcgcctcctcgctccgcctctctccaacacaaaaatgccgttcaagaggttcatcgagatcgggagggtggccctcatcaactacggcaaagaacacggcaggctcgtcgtcatcgtcgacgttatcgaccagaacagagctctggttgatgcacctgacatggttaggtcacaagtgaacttcaagagactgtcattgacggacctcaaggttgacataaagagggtgccgaagaagaaggaactgattaaagccatggaggatgctgatgtcaagaacaagtgggagaagagttcctggggaagaaagctcattgttaggaagactagggctaaccttaatgattttgataggttcaagctcatgttggtcaaaatcaagaaggctgctgttgttaggcaagagcttgcaaagttgaagaagacctcagcttaggcgttgttttttatagaaaaatgttcaaattttgttatggattactttcatttacaactactacacctttgattgttgtgagctttttattttttgttataaggtatcattagttagacacttcgagtttttactattcagattcttaatcttagggaattcatcatgtgaggtgctttctattgttgcttcaatatatcagtgttgatcttttccaacctttttatgtcagatgttagtcgctggtttaaaattgtctattttaaaattaaaatgtgataaacatggaactgatttatatggtttggtat

SEQ ID NO: 832 - DNA, 639 bp, Raphanus sativus
  misc_feature (166)..(166): n is a, c, g, or t
  misc_feature (188)..(188): n is a, c, g, or t
  misc_feature (196)..(196): n is a, c, g, or t
  misc_feature (214)..(214): n is a, c, g, or t
  misc_feature (217)..(217): n is a, c, g, or t
  misc_feature (395)..(395): n is a, c, g, or t
  misc_feature (496)..(496): n is a, c, g, or t
  misc_feature (534)..(534): n is a, c, g, or t
gcttcgaacattcaagctaccgccggcgaaaatggttttcaagaggtacgtcgagatcgggagagtcgctcttgtgaactatggaaaagaccacggaaagctcgtcgtcatcgttgacgtcgtggaccagaacagggctttggtagacgcccctgacatggagagnatccagatgaacttcaagaggntgtctctnactgacatcgttatcganatnaaccgagtgccaaagaagaaggcgttgatcgaggccatggagaaggctgacgtgaagaacaagtgggagaagagctcgtggggtaggaagctcatcgttcagaagcgtagggctagcctcaacgatttcgacagattcaagatcatgttggccaaaatcaagaaagctggtgtcgtcnggcaagagcttgcaaaactcaagaaggagatcactgcctgatcaacttgaggattatctgcttctctgtttttcgattttgaatttggtagttagtgtttnttgaaagtgtcaaacatcatttatctactctgctgtcngatgttaagttcaagtttgaatgaaaccttgtttggaagacttcattttgttgtttgatcgcactctcttaactaaaagcatgtttattttctgattagtcttta

SEQ ID NO: 833 - DNA, 625 bp, Juglans hindsii x Juglans regia
ggggacatttcctcttcttcaagctccgcctctctctcacgatcccagaatgcctttcaagagatacgtcgagattgggagggttgccctcgtcaactatggcgaagactacggcaaactcgtcgtcattgtggatgtcattgaccagaaccgtgctctcaccgattctcctgatatggagagatctcaaatgaatttcaagcggctatctctgacagaccttaaaattgacatcaagagggtccctaagaagaaggaattgcttgaagctatggagaaagctgatgttaaaaagaagtgggagagtagttcctggggcagaaaactaattgttcagaagagaagggcttctctcactgactttgataggttcaaacttatgttggcaaagattaagagggcgggactggtaaggcaagagcttgcgaaactgaaaaaggcgaatgcttcttaagcataatttttacatggattttccgtttttgttatgaattttgtgacgttggcctttggattggtagtatgtaatgaattcagagtttcagagcagcttgatttttttatatgtttctgacaagacttgatctgtagtcagttttctgttaaacctttttctgatctggac

SEQ ID NO: 834 - DNA, 717 bp, Cucumis sativus
tcccctccatcggcgccgctgcttttcacagttgctaacccttagccaccaaaaatgcctttcaagcggtatgttgagattggaaggattgccctcatcaactacggtgaggattacgggaagcttgttgtaatcgtcgatgtaattgaccagaatcgggctttggtcgatgcccctgatatggagcgttctcaaatgaactttaagagactctccttgaccgatatcaaaattgatattaagagggtcccgaagaagaaggaactgatcgaagccatgaaagctggggatgttcagaagaaatgggagaatagctcttggggcagaaaattgatcgttaagaagagaagagcctcactcaatgacttcgataggttcaagcttatgttggcgaagattaagagggctggattggttaggcaagagcttgcaaagttgaagaaggccgaggcttagaggaggttcatttttcgaaaggattttctccttttgctctttcgactttcttttaacttctataggtcgttgatttatagttcaaacttttttgtagtagtattattgcattaagtcattgtgtttcaacttcttccattttaatcttattacgccaatttcttatttggatttctatattgttacaactctatcaccctctaggtaaaaaaaaggtccttgttgttttaattcaattgattgcgggtattggtttttatt

SEQ ID NO: 835 - DNA, 670 bp, Panax ginseng
gggggggcaaaccctaattacttgttttatccctcccgcctcattcgcgttaagctgctaccagatcgctgaaaatgccgctcaagaggtacgtggagatcggaagggtggctctggttaactacgggaaagactatggaaaagttgtggtcatcgtcgacgttatcgatcagaacagggctcttgttgatgcacctgacatggttaggagccaattgaacttaaagcgggttaccctcactgacatcacgattgacattaaaagggtaccaaagaaaaagactctggttgctgctatggaggctgctgatgttaagggcaaatgggagaacagttcatggggcaggaagctgattgtgcagaagagaagggcatcacttaatgattttgataggttcaagctcatgttggcaaagatcaagaaagctggagttgttaggcaggaactagccaagcttaaaaaggagaccacagcctgagctcgagagcttcttaaattttgtgatgattttgttatagtttattgttttgttggtaagatgttgttttggtgcttgcattgcctgccggattgtattagtccatggattaagagataactcctctgtatttgcctatgaatcagatctatctaaaacagttattctaaaaaaaaaaaaaaaaaacatgt

SEQ ID NO: 836 - DNA, 697 bp, Amborella trichopoda
  misc_feature (149)..(149): n is a, c, g, or t
  misc_feature (695)..(695): n is a, c, g, or t
acccggcttcttccaaaaccgttgcttgacaagagcaagcgaaaccctagttttcgaagatctagttctctgcaacttctccttttcgtgacatcaaagctccaatcatgcctttcaagcgatacgtggaaattgggagagttgctctngtgaattatggaaaggattatggaatgcttgttgtgattgtggatgttatcgaccagaatcgggctttggttgatgctcccaaaatgattcggacacaaatgaacttcaagcggctttcactgaccgatattaagattgatattcctagggtgccgaaaaagaagtctctgattgcagcaattgaagcagctgatgtgtacaagaagtgggagaacagctcatggggaaggaagctgattgtgcagaaacagagagcatccctcactgatttcgacaggttcaaggtcatactggcgagaatcaagagagctggcttgataaggcaagagctaagtaaattgaagaagcaaagcgccagctaagtgcttgagggaaaattttgtttgctgcatttctattattttctggtgattttcaatgttttgtagaacctttcaagcaagtattgtggatctctctttccgggacctctggttcgtttatggaagttatttttattatggaacttgactaagagcctcaatggttgtggccttattttattngg

SEQ ID NO: 837 - DNA, 744 bp, Amorphophallus konjac
cgccgcttcgtcgtctcctccatccttcttcgcgctcgctcctccccttgccagttgcaatggtgttcaagcggtacgtggagatcgggagggtggccctcgtcaactacggcaaggagtatggcaggctcgtcgttatcgtcgacgtcgtcgaccagaaccgagttcttgtggattatctggacatagtgcgaggacaaatgaacctcaaaaggctccagctaactgattttaagattgacattcctagagtccccaaaaagaagactctgattgctgcactggaagaagctgacataaagaacaagtgggagagcagttcctggggtaggaagctgattgtgcagaagcgtagagctgctcttacagactttgaaaggttcaaggtcatgctagcaaagatcaagaggggtgctgctatcaggcaagagcttgccaagttgaaaaaacagagcgtagattaggatcgttacgagatttaagacagcttgatgttggtacgagggtggagttgatgtacctgaatggtaggtcaatggcagatatttcaacttattctctttgatgtgtcgtttacagacattttttagtggtgagatttgctcaaggtttaaaatgcttttgcaccgtgtttaagcatgtgtttacgagaagttatacctgtagttttccattaatgtggctacgctgcaactgatagaattagtggatgggctggtgtactaacctttggggactttacgg

SEQ ID NO: 838 - DNA, 450 bp, Arnica chamissonis
ggactccaaaatgccgttcaagaggtacgtcgagatcggaagaatcgctcttgtgaactatggaaaggattatggtaaagctagtagtcatcgttgatgtcatcgatcaaaacagggctcttgttgatgcacctgacacggtgaggggccaaatgaattttaagaggctaacactcacggacatcaagattgacatcaaaagagtcccaaataagaaaactctagtcgctgctttggaggctgccgatgtcaagaacaagtgggagagcagttcttggggaagaaagcttatcgtgcagaagaagagagcatcacttaatgatttcgataggtttaagatcatgttggcaaagattaagaaggctggagttgtgaggcaagagctagcaaagcttaagaaggaaaccccagcctagtaatgacattttgcttttattattgaagtttccg

SEQ ID NO: 839 - DNA, 643 bp, Cirsium arvense
tcgataagtatgaaaaaaattcaatatgtttcttttatcatcattgtttcaattctccacggcgctctgcaactgaacgtctgaaaatgccgttcaagaggtacgttgagattggaagagttggtctcgttaactacggaaaggattatggaaagctcgtagtgatcgttgacgtcattgatcaaaacagggctcttgtagatgctcctgacatggtgaggagtcaattgaactttaagaggcttacacttacagacatcaagattgacatcaaaagagttccaaacaagaaaactcttgttgctgctttggaggctgctgatgtcaagaacaagtgggaaagtagctcgtggggaagaaaactcattgttcaaaagaagagagcctcacttaacgattttgatcgcttcaagattatgttggcaaagattaagaaagcgggagtcgttaggcaagagctagccaaacttaagaaggagaccacagcatgatatgttatttacggtcaaattgtcggtttgtaggagcttatgcttaatcttttacaagtgattgttagaattttggccaattcaattttgaacttgtttgtttgttgtcaaaaagaaaaaagtaccgactgcagataatgaaaaatcaaacc

SEQ ID NO: 840 - DNA, 1167 bp, Citrus clementina
atccaaattgtcaaaaagtggcctcttgcctcattcattcatctcctcgctcctccggcagagccttgaatatcttcaaaaatggtaaccactagttcttcttcttcagagagattctgtggggcttacaagtgagaacaatgagttgaaattccgacttcaggccatggagcaacaggctcaactcaaagatgttatgcatcctactttgtgcttgatttggcagctttaaacgaggcattgggtgcagaagaacggaaactgaagctcgttgctgcagaggtcaatggagaggcccaactttcaagccgcatggctcagaagctttccattaatcatcagatgttccagatgcagcatcagtagcagaaccaagatgcaggagcagcctcagcgtggccaactgcaacctgaccagcaaagtcatgaggctgctatgcatgactggaagtaataggccggccatgtcggctaatagtagtgtagcagtatacgtaggctcaaaagtatcgttcaatagttatttatatataagtgaaccttgactattgttcttgttttcttggttggtttcttgtgtatagacaatggagaatccaactaactttgcttgttcatccatttgcccggaatgatgttccaattttagaaataaataattgtgtttgctcagaatatttacaatattaaattaaccaacacagtgattaattgacttgaaactcttgtagtttttttttcaacaagtagttgataattgaaagtttatacgtggagataggaagagttgctctcgttaattacggcaaggactatgggaagcttgtggtcatcgtcgatgtccttgatcaaaacagggctcttattaatgcccctgatatggcgaggagccaaatgaacttcaagaggctttctctcacagatattaagattgacatcaatcgagttcccaggaagaagtctttgattgaagccatggagaaggctgatgtgaagaacaaatgggaaaacagctcctggggcaagaagctgattgttcagaaaaggagagcggcactgaatgattttgataggttcaagctcatgttggcaaagatcaaaaagggtggacttattcgacaggagcttgcaaaactcaagaaggagaatgcagcatagaatttctct

SEQ ID NO: 841 - DNA, 706 bp, Cucurbita pepo
tcggcgccgctgctctccacagttgtaaacctcccacaagccgcaagaatgccgttcaagaggtacgtcgagatcgggagggttgccctcgtcaactacggtgaagattacggaaagcttgttgtaatcgttgatgtcattgaccagaatcgggctctggttgatgcccctgatatggagaggtctcaaatgaattttaagagactttccctgacagatatcaaaattgatattaagagggtccctaagaagaaggagttgattgaagcaatgaaagccggggatgttcagaagaaatgggaggatagctcttggggaaggaaattgattgttaagaagagaagagcctctctcaatgacttcgacaggttcaagcttatgttggcgaagattaagagggctggattggttagacaagagctctccaagttgaagaaggccgaggcttagaggttcattttttcaacggattctctcattttgctgtcatctttcatttaaactactgtaggtcttggttttttgttccaaacttttggtagcagtctgtgttcaacttctcacatttaaattatagtacgccaatttcttatttggatttcaattgtcacagctttatcaccctctatttataaggtccttgtttaaattggcttgaatgatagttctggtttttcatttctttaagaaagtcactttactgtga

SEQ ID NO: 842 - DNA, 725 bp, Cucurbita pepo
ttgatattgcactaagatctggtagcaatcatatactttctgaactgcttactaaatgaaagttcaagcaagtgaagcagacattaaacaaacaaacaaacaaatagaaaacagaaggcatatgcagttgtactcactacacttggatgtccaaaactccatgcacttcagaagcaacccaaattctcaagtgcttgagaagcaaaagggagaacaatccacaacatttaaattgatctctaacaaaatttgaggataaagaaatgtgctttctaagattcactctttttcagctttgcaagctcttgtctcaccaatccagctctctttatcttggccaacattagcttgaacctatcaaaatcgttaagggatgcccttcgtttttaacgagaagttttcgcccccaagagctatcctcccacttttctgaacatcagcagccttcatggcttcaatgagctccttcttcctagggaccctcttaatgtcaattttaatgtcagtaagagaaagtctcttgaagttcatttgagacctgaccatatcaggagcatccaccagagctctgttctggtcaatgacatcgacaatcacaacaagcttcccgtagtcttcgccatagttgacgagagcgaccctcccgatctcaacatacctcttgaacggcatcttccggttgtagggttttacagagacgggcgacgagcctagggttctttcct

SEQ ID NO: 843 - DNA, 932 bp, Cucurbita pepo
tgaacagaacagtcgggttttctcatccagagtcttatttggatctacatgggaagaacaaaccctaattgcgacatcgtataatcttctctcatcgccttgcccatctgtggaaaccctagcagtacgaagatgccgttcaagaggtacgttgagatcgggagagtcgctctcgtcaactatggcgaagactacggaaagcttgtcgtcattgtcgatgttattgaccaaaatagagctttggtagatgctcctgatatggtcagatctcaaatgaacttcaagagactttctcttactgacattaaaattgacattaagagagtccctagaaagaaggaactcattgaagctatgaaggctgctgacgttcagaagaagtgggaggatagctcttggggaagaaaactactcgtgaagaaaagaagggcatcacttaatgattttgataggttcaagctaatgttggctaagataaagagagctggattggtgaggcaagagcttgcaaagctgaaaaagagtgaatcttagaaagtgtatttctctagcgtcaaattttgttactagttgaagttatcagttttggattttgttcaattctgtttctcaagcctcaggagttcggggctgttcggggttgttttgaggtttatggaattctggacatctagtgtagcgagtttttacttgatttcttcacaagatgcctacatcactccaattaagcaagcatgtatctgaatctgctgagtgctgatgttttctgctcaactgttaaaatcgggtttctgtggctatggatatggttttcgatttctatttgcttttctgaattttatgtctggattcccttgagtgccccattcattgatgaaatattagatactgcagttgtgctacaaattaagatgattcaagcatggtttcat

SEQ ID NO: 844 - DNA, 796 bp, Cucurbita pepo
ctcttataaggagcaggaagaccactttcttccgtctctcctctatcgcgccgctgctctcacagttgcttacgtcaaacaagcagcgaaaatgccgtttaagaggtatgtcgagatcggaagggttgccctcgtcaactacggtgaagactacggaaagctcgttgtcatcgttgatgttatcgaccagaatcgggctctggttgatgcccctgatatggagcgatctcaaatgaactttaagagactctccctgacagatatcaaaattgatattaaaagggtccctaagaagaaggagctgattgaagccatgaaagctggggatgttcagaagaaatgggaagatagttcatggggcagaaaattgattgttaagaagagaagagcctctctcaacgacttcgacaggttcaagcttatgttggccaagattaagagggcaggattggttaggcaagagctttcgaagttgaagaaggccgaggcctagaggttcatttttcaatggattttcccattttgctgtcaactttctttaacatctataagtcgttgatttatagatccaaactttttgtagcagtatcattgcctttaagtcattgtgttcaacttcgtccatttttaatcttaatacgccaatttcttatttggattttaattgttattactttatcatcctctttgtaaaaggcccttatgtttaattggcttgaatgcgaattctggtctttcatttgttgcagaaagtgatactagaaggtgagagttattatgagttaattgttaggaa

SEQ ID NO: 845 - DNA, 782 bp, Cucurbita pepo
gttcaaagaggaaagaaccctaggctcgtcgctcgtctctgaaagaccctacaactcgaatatgccgttcaagaggtacgtcgagatcgggagggtcgctcttgtaaactacggcgaagactatggaaagctcgttgtcattgtcgatgtcattgaccagaacagagctttggtagatgctcctgatatggtcaggtctcagatgaacttcaagagactttctcttactgacataaaaattgacattaagagagttcctaggaagaaggaactcattgaagctatgaagggtgcagatgttcaaaaaagtgggaggatagctcttgggggagaaaactgcttgtcaagaaaaggagggcagctcttaatgattttgataggttcaagctaatgttggccaagataaagagaggtggattggtcaggcaagagcttgcaaaactgaaaagagtgaagcttagagtaatcgcatttcttctgtagcttcaaattttgttagagaacaatttatgaggtgtggattgttatcccttttgttcctccagcccttgagagttggggtgtatctcaagtacatgagagtttagtgagttttatacagagttgggttaaccccaatgtgccagcattagtcgaatttaattaatatatatattgttaggaatcactgcttttcacatcgcaatggtatgatattatccaccttgagcataagctctcatggttttgcttgggctttcccaaaaggcctcgtaccaatagagattgtattcttcccctac

SEQ ID NO: 846 - DNA, 564 bp, Scabiosa columbaria
gttcatttctcttcacttttgccctgcgcctctctcaaagccaaacctaggaaggaaaaatgccgttcaagcgttacgttgagatcgggagggtagcattggtgaactatggaaaggattacggaaagctcgtagtcatcgttgatgtcatcgaccagaatcgcgctctagttgattcccctgatatggtgagatgccaaatgaatttcaagagactaaccctaactgacatcacaattgatatcaagcgtacccccaagaagaaggttcttatcgaagcaatggaggctgcagatgtgaagaacaagtgggagaatagctcatggggacgaaagtttattgttcagaaaagaagagctgctcttaccgattttgatcgcttcaagcttatgcttgcaaagatcaagaaagctagcttggttaggcaggagcttgcaaagctgaagaaggagaccgcttgaagcgacagtatttctagatattctatatcagagtttagctcaattttgttataaatttgtcaaaacttgtttgctcttccctctccttcaccctcaaaccccc

SEQ ID NO: 847 - DNA, 429 bp, Scabiosa columbaria
ctaaaatgccgtttaagcgtttcgttgagatcgggagggtcgcccttgtcaactatggcgaagactatggaaagctcgtcgtcattgtcgatgttattgaccagaacagagctcttgtggattcacctgatatggtgagatgtcaaatgaactttaagcggctcacgcttacggatatagtaattgacatcaagagaaccccaaagaagaaggctctcctcgaggccatggaagctgcagatgtcaagaacaagtgggagaatagttcgtggggtcgcaagttcattgttcaaaagagaagggcagctctcactgattttgacaggttcaagctcatgttggccaagatcaagaaagcaagtttggttagacaagaacttgcaaagttgaaaaaggagactgctgcttaaacatctgaaatggagccaa

SEQ ID NO: 848 - DNA, 553 bp, Scabiosa columbaria
attcacttctcttcgcttttgctctgcgcctctctgctccagccaaaccctaggaagaaaaaatgccgttcaagcgttacgttgagatcgggagggtagctctggtgaactacggaaaggattatggaaagctcgtagtgatcgttgatgtcattgaccagaatcgcgcccttgtggattcccctgacatggtgagatgccaaatgaatttcaagagactaactctaactgacatcacaattgatatcaaaaggacccccaagaagaaggttctgatcgaagcaatggaggccgcagatgtgaagaacaagtgggagaatagctcatggggacgaaagttcattgttcagaaaagaagagccgcccttaccgattttgatcgctttaagcttatgcttgcaaagatcaagaaagcaagcttggttaggcaggagcttgctaagctgaagaaggagagtgcttaaatcctcattgttcctagatatgcaatatcagactttagttcaattttttgttatgaacatcttgttttgttttctcctttccttgtaaa

SEQ ID NO: 849 - DNA, 632 bp, Helianthus annuus
ctcggcgctcaacatccaggacttcgaaaatgccgttcaagaggtacgttgagatcggaagagtcgcacttgtcaactacggcaaggattacggaaagctcgtagtcatcgttgatgtcattgatcaaaatcgggctcttgttgatgcacctgacatggttaggggtcaaatgaactttaaaaggctaacgcttaccgacattaagattgatattaaacgggtcccaaataagaaaactttggttgctgctttggaggctgctgatgtgaagaacaagtgggagagcagttcgtggggacgaaagcttattgtgcagaagaagagagcgtcacttaatgattttgataggttcaagatcatgttggctaagataaagaaggctggagttgtaaggcaagaactttcaaagctgaagaaggaaaccacatgctagtgtcatattttttgttctaattatttaagattttgttgatgctggttgcttacttttttttcattttgtattaaaatggcaaattttaaacttatgcctttgtttacgtttgctacgagaatgatctgctgctgtcaatttggtagatcaagtatggaacacataaccatatcaatgcacgtgaacctttgaatacgt

SEQ ID NO: 850 - DNA, 548 bp, Vinca minor
cgacgaaaatgccgttcaagaggtacgtggagatcggtagggttgctctcgtcaactatggagaggattacggcaaactcgtcgtcatcgttgacgtcatcgaccagaacagggctctagttgattcccctgacatggtaagaagccaaatgaacttcaagaggcttgcactaactgatatcaagattgacatcaagaggatcccgaacaagaagtctttggttgctgctatggaggctgctgatgtcaagaacaagtgggagaacagttcatggggtagaaagctgatcgtgcaaaagaaaagagcctccctgaacgattttgatcgattcaagctcatgttggcgaaaatcaagaaagctggagtagtgaggcaggagctctccaagcttaagaagcaagcagcataagacagattttcttctgtaatttttttttatagttcggtatttggtaaaattgtatcttaattttactaggtgaagggatgtggaaaagaaacatgcttttctttcattcgatgtggatgcatttcaaagttttgtatc

SEQ ID NO: 851 - DNA, 450 bp, Triticum aestivum
cgctccagccgcttcaccgcgccgccaccgccaccgcgaggatgccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtccccaagaagacagccctgatcaaggcgatggaggaagctgatgtgaagaccaagtgggagaacagctcatggggcaagaagctgattgtccagaagaggagagcatcgctcaatgactttgataggtcaaaacatgctggcgaagataagaagggcggtgctatcaagcaagactcgccaactgaagaagctccacggcttaaggatcccttcc

SEQ ID NO: 852 - DNA, 703 bp, Helianthus annuus
ttctcggcgctcgacattcaggacttcgaaaatgccgttcaagaggtacgttgagatcggaagagtcgcacttgtcaactacggcaaggattacggaaagctcgtagtcatcgttgatgtcattgatcaaaatcgggctcttgttgatgcacctgacatggttaggggtcaaatgaactttaaaaggctaacgcttaccgacattaagattgatattaaacgggtcccaaataagaaaactttggttgctgctttggaggctgctgatgtgaagaacaagtgggagagcagttcgtggggacgaaagcttattgtgcagaagaagagagcgtcacttaatgattttgataggttcaagatcatgttggctaagataaagaaggctggagttgtaaggcaagagctttcaaagctgaagaaggaaaccacatgctagtgtcatattttttgttctaattatttaagattttgttgatgctggttgcttgcatttttttcatcttgtattaaaatggcaagttttaaacttatgcttttgtttacgtttgctacgagaatgatctgctgcggtctgcttggtagatcaagtatggaacgcataaccataccacagcatgtgaacttttgaatatgtacatgcagtggtattgattatatacgaccacctatagtatctatgttatacctggcgaactggtcgctt

SEQ ID NO: 853 - DNA, 583 bp, Sorghum bicolor
atcccggcatcccgcaatgtcagctcccaacagtgatagcaacatgcagcagctagtccctatagcaccaccaggaaaggcttctggtgctgacagtgggaaggagctggttgtggcggatcctggaggtaagagttcaggaggtgtaaaactgcgagaggacgaggaggacctggaggtgaagctcaggcgcatcatggagaatgtccctgtgcgtgtcagtaacacatcagggtcctctgctggctctggctctggtgatttccaccaggtaagtatcggcaaatgcggaggagagagcaggaccggctagctcgaatggatgctgactaccagaagagaaaagagatggctgagtttgaactgcggagggaggagaggatcaaagctgctgaggagcggacagccaagaagcgcctgaaacggcaaaagaagaagcagcgtaagaaagagaagcgagctaaaactggtaataatggtggtgaagatcctaacagagtggattcgtctgatgatgatgaaggttcagatgacgatgacaagtccaagcaatgacacgccaatttgcatctgaagatgattt

SEQ ID NO: 854 - DNA, 1217 bp, Zea mays
agtcacggacacatggtgtgtttggttggatctcgtcccggtctttcacctccaacaaaacacatcctaatcgactcgcgaccccgtttcccggagagccgcgacggtgcgacgccgaactccctaaccctaagtccctaagcgtaggcggcggggggcggcggtgcgaggcaagctgcacagcaacacgggccacgggcgcggcctccgcctccgcctccacgcttctgctgctaggctgcaagggcggcggcgcggcgcggtgggcggcggacagctggccaggtccagcccagtagtccaggtgacgaggtccgcactccgcaacggttctggcgttctgcagctgaggatagacgagagaggaagtgaggatttatattagtgatttacaaggcaacttgaaagacagcagggttgcatcccacaatgtcagctcccaacagtgatagcaacatgcagcagctagtccctatagcaccaccaggaaaggcttctggtggtgacagtgggaaggagctggttgtggcagatcctgcaggtaagagatcaggaggtgtaaaactgcgagaggatgaggaagacctggaggtgaagctcaggcgcatcatggagaatgtccctgtgcgtgtcagtaacacatcagggtcatctgctggctctggctctggtgatttccaccagtatcggcaaatgaggaggagagagcaggaccgtctagcacgaatggatgcggactaccagaagagaaaagagatagctgagttcgaactgcggagggaggagaggatgaaagcagctgaggagcggacagccaagaagcgcctgaaacggcaaaagaagaaacagcgtaagaaagagaagcgagctaaaactggtgataatggtggtgaagaacctaacagagtggagtcgtctgacgatgacgaaggctcagatgacgatgacaagtccaagcaatgacacgtcaatttcgcacctgaagatgatttcggactctctggttgtctgggcaatgaaacaaacgtctgtacggttgttgtaacaggttacagggcgaatctggtgctgtttctgtaagaggatatgatattctgagcagagatggatagcactagataatttgctgttagtgttcatcattcagagaagtgacctgcgtcagtaccttttgttcaggtctatattatatcagctgccttttttggctccatttt

SEQ ID NO: 855 - DNA, 1235 bp, Zea mays
gacacccttcctctcgtcgcccacggcccacctcacagtcacggacgccttcgcggtgagccgcgacggctccctaacgtaaacgccggcggcgcgcgcggaaagctgcacggcagcacgggcgcggcctcgtctccgcgcctgggctgcaagggcggcggctcggcgcggtgggaggcggggggcggccatccggtcaggtccagcccaggactccaggtgaccaggtcggcaggtccgcgctccgcaacggttctggcgttctgcggctgagtacagacgacagaggaattggggatttacattagcgatttacaaggcaacttggaagacaagcagggtttcatcccgcaatgtcagctcccaacagcgatagcaacatgcagcagctagtccctatagcaccaccaggaaaggcttctggtggtgacagtgagaaggggctggttgtggtggatcttgcaggtaagagatcaggaggtgtaaaactacgagaggatgaggaagacctggaggtgaagctcaggcgcatcatggagaatgtccctgtgcgtgtcagtaacacatcagggtcctctgctggctctggctctggtgatttccaccagtatcggcaaatgaggaggagagagcaggaccggctagctcgaatggatgctgactaccagaagagaaagaagatggctgagttcgaactgcggagggaggagaggatgaaagcagctgaggagcggacagccaagaagcgcctgaaacggcaaaagaagaagcagcgtaagaaagagaagagagctaaaacgggtaataacggtggtgatgaacctaacagagtggagtcttctgatgacgatcacggttcggatgacgatgatgagtccaagcaatgacacgtcagttgcatctgaagatgatttcggacactggttgtctgggcattgaactaacgtctgtatggccgttgtaacaggttacaggccgaatctggtgctctatctgtaagaggacgtgatattttgagcagagaatgatagcactagataatttcatgttagtgttcatcattaaggtcttattcgtttacacaaattcagctctacattagcatggattgatgtgaggtatggatttatctaatctaaacctagattaaatctatgatgtgattccataccttgtaaccgaacaagtcctaagagagctagaatcatatcgtgtgcctgcgcgcttagtgggaa

SEQ ID NO: 856 - DNA, 1047 bp, Panicum virgatum
gaaaaggccatcgagcgcagcgggagaagaggatttcctgccacgggcagcggcggcggcggcgacgtaggggagcgtcggagcgagccccttgggcggcggccactggagcgtctggaagaggagttgaggaggatccagcagtggcaccgcgtgcccggtctctgggctccagctcgagtttgaaagacaacttgagttgtagcctgcaatggcaactcccaacagagatagcaacatgcagcagctagtccctatagcaccaccaggaaaggcttctggcagtgacactgggaaggagctggttgtggttgatcctgcaggaaagggctcaggaggagtaaaactgcgagaggatgaggaggacctggaggtgaagctcaggcgtatcatggagaatgtccctgttcgtgtcagtaacacatcagggtcatctgctggatctggctcaggtgatttccaccagtatcggcaaatgaggaggagagagcaggatcggcttgcacgaatggatgctgactaccaaaagaggaaagagatggctgagtttgaactgcggagggaggagaggcttaaagcagctgaggagcggacggccaaaaagcgcctgaaacgccaaaagaagaagcagcggaagaaagagaagcgaactaaaactggtaatggtggtgaagaacctaacagagtggagtcttctgatgacgatgaaggttcggatgatgatgatggcaagtctaagcaatgacacgccaattgcatttgaaggtgctttttagactgtcactgtagctttgacggagggctacttgcttgttgaagaaggatgcctgtgcgttcctccctggttgatcgtgggcaatgaactaacatctggtttggccgttgtaataggctgagtcaagaggatatgtataacatttagagctgagatggagagcactagaaagttttctgttagtattcctcattcggggaactgccttgcatcagtaccttttgatcagctattaacattttaatcggagatggaaagcactagagagtttc

SEQ ID NO: 857 - DNA, 1290 bp, Panicum virgatum
gaggattcctgccacgggcggcggcggcgacgacgtagggagcgtcggagcgaggagccccttgggcgggggccactggggcgtctggaagaggagttaaggaggatccagctggggcaccgcgtgcccggtctctgggctccagctcgaggcagcttgaaaggcaacttgagttgtatcctgcaatggcaactcccaacagagatagcaacatgcagcagctagtccctatagcaccaccaggaaaggcttctggcagtgacactgggaaggagctggttgtggttgatcctgcaggaaagggctcaggaggagtaaaactgcgagaggatgaggaggacttggaggtgaagcttaggcgcatcatggagaatgtccctgttcgtgtcagtaacacatcagggtcatctgctggatctggctctggtgatttccaccagtatcggcaaatgagaaggagagagcaggatcggcttgcacgaatggatgctgactaccaaaagaggaaagagttagctgagtttgaactgcggagggaggagaggcttaaggcagccgaggagcggacggccaaaaagcgcctgaaacgccaaaagaagaagcagcggaagaaagagaagcgaactaaaaccggtaatggtggtgaagaacctaacagagtggaatcatctgatgacgatgaaggttcagatgatgatggcgagtccaagcaatgacacggcagttgcatttgaagatgctttttagactgtcatcataaatttgatggagggctacttgcttcttgaagaaggaagcctgtgtgttcctccctggttaatcgtgggcaatgaactaacatctggtttgcctgctgtaataggctgagtcaagaggatctttatagcattcagactgagatggagagcactgcctgttagtattcctcattcggggaactgccttgcattagtaccttttgatcagctattattagtcggagatggaaagcactagatagtttcttgcctgttgtaataggttgagtcaagagagctgagatgaagagcactgctgttagtattcctcattcggggaactgccttgcatcagtaccttttgatcacctattgacattttaatcagagatggaaagcactagatagtttccagttagtgttcctcgtccacagttgccttgcatcagttcctttcatcatccccatgtatgcttgtggcatgttgtttgtatcactgtcagttattcgtgtatttctcaaaatcttgtaaaatgtgtgttcttttttcctg

SEQ ID NO: 858 - DNA, 1137 bp, Setaria italica
tccggatcgaatcctccacgactccacggcgcggggagagctagcggcgcgggggagagctggcggcgcgcgaggcggcggcgcaaggtgacggcgtggcggcgcggcgcaccccaacggcgaccctctccgccgtcttctcaccggcagattgaaagacaagtagagttgtatcctgcaatgacaactccgagcagagatagcaacatgcagcagctagtccctatagcaccaccaggaaaggcttctggcagtgacactgggaaggagctggttgtggttgatcctgcaggaaagggctcaggaggagtaaaactgcgagaggatgaggaggacctggaggtgaagctgaggcgcatcatggagaatgtccctgttcgtgtcagtaacacatcagggtcatctgctggatctggctctggtgatttccaccagtatcggcaaatgaggaggagagagcaggaccggctatcacgaatggatgctgactaccaaaagaggaaagagatggctgagttcgaattgcggagggaggagaggcttaaagcagctgaggagcggacagccaagaagcgcctgaaacgccaaaagaagaagcagcggaagaaagagaagcgaactaaaactagtaatggtggtgaagaacctaacagagtggagtcatctgatgatgaagaaggttcagatgacgatgacaagtctaagcaatgatccttcaattacatttgaagatgcttttagactccaggtcaccattcagacggagcaccgcttgcttgttgaagaagaaagcatgtgcgttcctccctggttggctgtggacaatgaactagcatctggtatgcctgttgtaataggctaatgcctgttgtaataggctaagacaggtcctgtgtctgttagaggatataacattttgagcagagatgggacgcattagaaagtttgctgtttgtgttcctcgttcggagaatgccttgtatcagtaccttttgatcagctataacattttgggcagcgatggagagcactagatagtttactgttagtgttcctcgatcagagaattgccatgcatttgtaaacttcatctccatattttatgcatctgcatgtatttgtatcagtctttttttt

SEQ ID NO: 859 - DNA, 593 bp, Setaria italica
aggcagattgaaagacaagtagagttgtatcctgcaatgacaactccgagcagagatagcaacatgcagcagctagtccctatagcaccaccaggaaaggcttctggcagtgacactgggaaggagctggttgtggttgatcctgcaggaaagggctcaggaggagtaaaactgcgagaggatgaggaggacctggaggtgaagctgaggcgcatcatggagaatgtccctgttcgtgtcagtaacacatcagggtcatctgctggatctggctctggtgatttccaccaggtaagtatcggcaaatgaggaggagagagcaggaccggctatcacgaatggatgctgactaccaaaagaggaaagagatggctgagttcgaattgcggagggaggagaggcttaaagcagctgaggagcggacagccaagaagcgcctgaaacgccaaaagaagaagcagcggaagaaagagaagcgaactaaaactagtaatggtggtgaagaacctaacagagtggagtcatctgatgatgaagaaggttcagatgacgatgacaagtctaagcaatgatccttcaattacatttgaaga

SEQ ID NO: 860 - DNA, 1246 bp, Sorghum bicolor
ataatatttattaaatttttgtaactaaacaaggccttatccgtggaatctttcaaacattcagtagtggcgtagatacaggtgttcggtagcccatgaaagctctcccacggccagcccaagacagccctgggcccggcccggtccggcccccgagagctcccgtgactccttccgcctggccgtggccggcggccgcctcccgctcggcgctcgctactcggtagccccccactgtcgaagtcgccccacgagcggacagcggacggccgctacgtacggcggcggcgcggcgcctaggcgagtcggcgacagcacgtccgcgcaccagctgcgacggctccaggcgagagggtcgcgaccgccccgccggcgccggcccccgaccgccccttctgctgtcgggagctcttctgcagccggcaggcagcaccccgccccattttgatttgattttccagggagaaaggcgagtccttttgcgcctaagcttggacgccagtcttgagttcgttaaggtcgacctcacaccagcgaggccaaggcgtactgcatacatcacacctcagaaatcagacctcaaaggcaacttggaagacaagcagggttgcaccctgcaatgtcagccctcaacagtgatagcaacatgcagcagctagtccctatagcaccaccaggagaggcttcttgtggtggtgacagtgggaaggagctggttgtggtggatcctgcaggaaagagttcaggaggtgtaaaactgcgagaggatgaggaggaactagaggtgaagctcaggcgcatcatggaaaatgcccctgtgcgtgtcagtaacacatcaggctcctctgctggctctggctctggtgatttccaccagtaccggcaaatgaggaggcgagagcaggaccggatagcgcgaatggatgctgactaccagaagagaaaagagatggctgagtacgaactacggagggtggagaggctgaaagcagccgaggagcggacagccaagaagcgcctgaaacggcaaaagcagaagcagcgtaaaaaagagaagcgagctaaaactgataataatggtggcgaaaaacctaacagagtggagtcatctgatgaggatgaaggttcagatgacgacgatggcaagtctacacgttaatttcatttgaagacaaatttgtctagtatattgcctgtgctaatgctacagtgacattgtttttatatatttttatgaaattatttt

SEQ ID NO: 861 - DNA, 896 bp, Sorghum bicolor
gagggtcgcgaccgccccgccggcgccggcccccgaccgccccttctgctgtcgggagctcttctgcagccggcaggcagcaccccgccccattttgatttgattttccagggagaaaggcgagtccttttgcgcctaagcttggacgccagtcttgagttcgttaaggtcgacctcacaccagcgaggccaaggcgtactgcatacatcacacctcagaaatcagacctcaaaggcaacttggaagacaagcagggttgcaccctgcaatgtcagccctcaacagtgatagcaacatgcagcagctagtccctatagcaccaccaggagaggcttcttgtggtggtgacagtgggaaggagctggttgtggtggatcctgcaggaaagagttcaggaggtgtaaaactgcgagaggatgaggaggaactagaggtgaagctcaggcgcatcatggaaaatgcccctgtgcgtgtcagtaacacatcaggctcctctgctggctctggctctggtgatttccaccagtaccggcaaatgaggaggcgagagcaggaccggatagcgcgaatggatgctgactaccagaagagaaaagagatggctgagtacgaactacggagggtggagaggctgaaagcagccgaggagcggacagccaagaagcgcctgaaacggcaaaagcagaagcagcgtaaaaaagagaagcgagctaaaactgataataatggtggcgaaaaacctaacagagtggagtcatctgatgaggatgaaggttcagatgacgacgatggcaagtctacacgttaatttcatttgaagacaaatttgtctagtatattgcctgtgctaatgctacagtgacattgtttttatatatttttatgaaattatttt

SEQ ID NO: 862 - DNA, 1184 bp, Setaria italica
cgagagcttagccgacgaagagaaatttctgccacggccgccggcggcggccacgacgtagggagcgagccccttgggcggccgctggggcttctgtgagaggcgttaaggaggatccagcaggggcaccgcgtgcccggtctttgggctctagctcgaggcagcttgaaagacaagtagagttgtatcctgcaatgacaactcacagcagagatagcaacatgcagcagctagtcccaatagcaccaccaggaaaggcttctggtagtgacactggcaaggagctggttctggttgatcctgcaggaaagggctcaggaggagtaaaactgcgggaggatgaggaggacctggaggtgaagctcaggcgcatcatggagaatgtccctgttcgtgtcagtaacacatcagggtcctctgctggttccggctccggtgatttccaccagtatcggcaaatgaggaggagagaacaggaccggctagcacgaatggatgctgactaccaaaagaggaaagagatggctttgttcgaaatgcgaaaggaggagaggctgaaagcagctgaggagcggacagccaagaagcgcttgaaacgccaaaagaagcagcggaagaaagagaagcgaactaaaactagtaatggaggtgaagaatctaacagaatggagtcatctgatgatgatgaaggttcggatgatgatgagaagttgaagcaatgacatgtcaattgcatttgaagatgcttttagactgccatcatgcatttgactgtggtctacttgcttcttgaagaaggaagcctgtgcgttcctccctgcttaattgtggccttgtgggcactttaactcacgtctggtatgcccatcgtaataggagtcgggaggaagcagatatggagagcactagaaagttttctgttagtgttcttcagagattcgccttgcatgttgcatcagcacctcttgatcagctattaccattttgagcagagatggaaaacactacatagtttcctgttagtgttccccgttcagagaattgacttgcaccagactttttcatcatctctatagatgcgtctggcatgcatttgtatcgctgtgttttttgcttcatatacttcatgtatttcttaaaatcttgtaaaattatgtcttttttagaatgtagtttgatctgct

SEQ ID NO: 863 - DNA, 1443 bp, Pennisetum glaucum
gcttggtaaattgttttacttttgctacaggggcaatccagcaatggtagccgctggggtcagcaatgcagaagaacagcaatggacagtactttgcatagagttagcagaattttatcggggtctgctgaccccaatagaaagccttagctccgtccctgctttgctaacgtcaacgtatttcatttatttctaacagtggatgttgaacttcttgtggcaatcatattcttattgcttttacatgtaattgcgaacttcaatacttccaatattcagctccgtgcatgatttaacacgctcatcaaaatacattattgtgcgttgtgtgtgcaccatctggtattttaagcctaaaggaactaggaatttcaatttgcgtagtatgaacctgatgtccgaatgtgaccatgcttgatggaaattggaaacacaatattcatatacattgtcatttgtttatgttcaggcagcttgaaagacaagtagagtgtgtcctgcaatgacaactcccgatagagatagcaacatgcagcaactagtccctatagcaccaccaggaaaggtttctggtggtgactctgggaaggagatagttgtggttgatcctgcgggaaagggctcaggaggagtaaaactgcgagaggatgaggaagaccttgaggtaaagctcaggcgcatcatggagaatgttcctgttcgtgtcagtaacacgtcagggtcctctgctggatctggctctggtgatttccatcagtatcggcaaatgaggaggagagagcaggaccggatagcacgaatggacgctgactaccaaaagaggaaagagatggctgagttcgaattgcggagggaggagaggcttaaagcagctgaggagcggacagccaagaagcgcctgaaacgccaaaagaagaagcagcggaagaaagagaagcgaactaaaactagtaatggcggtgaagaaccaaacagagtggagccgggcggtgaagaaccaaagggagtggagtcatctgatgatgatgaaggttcggatgttgatgacaagtctaagcaacgatgattcaattgcatttgaagatgcttatagactccaggtcaccattcggatggagcactgcttgcttgttgaagaaggaagtctgcgcgtccctccctggttgcctgtggacaatgaactaacatcttgtatgcccgttgtaatacggtctgttaagaggatacaacattttgagcagtgaatggggtgctttagaaagtttgttgtttgtgttcctcgccttgtatccataccttttgatcagctataacattttgggcactagataatttcctatcactgtcattgttactaggtcagagaattgtcctgcatctgtatacttcatctctatatgtgcgtctggcttgtgtttgtatcactgccttttgttttgtcat

SEQ ID NO: 864 - DNA, 1034 bp, Oryza sativa
ccctaatcgaatcgatcgacacacgaaacacaagttcgaggagagaaaaccaaaccctagctaggctaaggcggagtggagaacccccgccgttgccggcggcggaggcagcggcggcggcgcgcggagaacactccgtcgcggtcgattccgtatcaacaatgtcagatcctggaagggatagcaacatgcagcagctcatcccgatagcacctccaccaaaggcttcttctggtaccactggcaaggagctcgtggtcgtggatggtacgggaaaggcttcaggaggagtcaagctacgggaagacgaggaggacctggaggtgaagctcaggcgcatcatggagaacgtccctgtccgtgtcagcaacacctccggatcctctgctggttctggctctggtgatttccaccagtatcggcaaatgaggaggagagaacaggaccgtcttgcaaggatggatgctgattaccagaagaggaaacagatggctgagtttgaattgaggagggaggaaaggctaaaagaagcagaggagcggacagcaaagaagcgcctgaaacgccaaaagaagaagcagcggaagaaagagaagaaacgatctaaaactaataatggtggcgagcaacctaacggaggggagtcgtctggtggtgatgaggattcagacgatgaagataagccataggcaagtggcacacatcaatcggatttgaagttgctattagactactgttgaaccatttcttggagattacttctgaagtagagctttgagcatgaactaatattggcaggctgcaggcccccttgtagttttttcttggaaacactcttaagatgagatgtggcttgttttccttgctctgataaagtgactatggagtatggatggatagatgaatcattttctggttaccttgtttgtttcttctgaattatcatgtctggggctccctgtcccttacaatagcttactcgtgacatttaaatgaatgaaatttaactgtttagcaatttgagagctggctaa

SEQ ID NO: 865 - DNA, 1034 bp, Oryza sativa
ctaatcgaatcgatcgacacacgaaacacaagttcgaggagagaaaaccaaaccctagctaggctaaggcggagtggagaacccccgccgttgccggcggcggaggcagcggcggcggcgcgcggagaacactccgtcgcggtcgattccgtatcaacaatgtcagatcctggaagggatagcaacatgcagcagctcatcccgatagcacctccaccaaaggcttcttctggtaccactggcaaggagctcgtggtcgtggatggtacgggaaaggcttcaggaggagtcaagctacgggaagacgaggaggacctggaggtgaagctcaggcgcatcatggagaacgtccctgtccgtgtcagcaacacctccggatcctctgctggttctggctctggtgatttccaccagtatcggcaaatgaggaggagagaacaggaccgtcttgcaaggatggatgctgattaccagaagaggaaacagatggctgagtttgaattgaggagggaggaaaggctaaaagaagcagaggagcggacagcaaagaagcgcctgaaacgccaaaagaagaagcagcggaagaaagagaagaaacgatctaaaactaataatggtggcgagcaacctaacggaggggagtcgtctggtggtgatgaggattcagacgatgaagataagccataggcaagtggcacacatcaatcggatttgaagttgctattagactactgttgaaccatttcttggagattacttctgaagtagagctttgagcatgaactaatattggcaggctgcaggcccccttgtagttttttcttggaaacactcttaagatgagatgtggcttgttttccttgctctgataaagtgactatggagtatggatggatagatgaatcattttctggttaccttgtttgtttcttctgaattatcatgtctggggctccctgtcccttacaatagcttactcgtgacatttaaatgaatgaaatttaactgtttagcaatttgagagctggctaaca

SEQ ID NO: 866 - DNA, 738 bp, Pseudoroegneria spicata
  misc_feature (731)..(731): n is a, c, g, or t
ggcgcgtgagacgacgaaccccagcgaccagcagcgcaagtgagccatgctagcctcgccggcgctcgccggcgccacccactccttcccggccttcgcgtcgggcagccgcagcatccacctcccgtccgcctccgcgccctcgcactcgccggcgcggcgggccgccctggtcgtcctcgccaaggccaaggtgtccacgcccaatgccgaccgcatcgcccgccatgaccgcctccgcaagaaggttagcggcaccacagagagaccaagactcagtgttttccggtcaaacaagcatctgtatgctcaggtgatcgacgatacaaagtcatgcactctggcttcagcctcaacaatgcacaaatctctttcaaaggagcttgagtactctgctgggccaacaactgaagtggcacaaaagattggtgaagtgattgccaagtcctgcttggagaaaggaatcaccaaagtggtctttgaccgagggggtttcctctaccatggccgcatcaaagctctagccgatgctgctagagagaacgggcttgagttctgaattttctgttgatattttcaggatcgcatgtaatattctctctttttttcccgtctattgaacaaagttctttctgtagtcatttgggtcgttctgcagacatgacccctctttaattttatctgctctttgtatcaacattgaatcagccttgcaaatggaagattcattntctgtct

SEQ ID NO: 867 - DNA, 733 bp, Triticum aestivum
ccacgcgtccggagacggcgaaccccagcgaccagcagcgcagcgcaagtgagccatgctagcctcgccggcgctcgccggcgccacccactccttcccggccttcgtgtcgggcagccgcggcatccacctcccgtccgtgtccgcgccctcgcactcgccggcgcggcgggccgccctggtcgtcctcgccaaggccaaggtgtccacgcccaatgccgaccgcatcgcccgccacgaccgcctccgcaagaaggttagcggcaccacagagaggccaagactcagcgttttccgctcaaacaagcatttgtatgctcaggtgatcgacgatacaaagtcgtgcactctggcttcagcctcaacaatgcacaaagctctttcaaaggagcttgagtactctgctgggccaacaactgaagtggcacaaaagattggtgaagtgattgccaagtcctgcttggagaaaggaatcaccaaagtggtctttgaccgagggggtttcctctaccatggccgcatcaaagctctagccgatgctgctagagagaacgggcttgagttctgaattttctgttgatattttcaggatcgcatgtaatattctcttttctttcccgtttattgaacgaagttctttctgtagtcatttgggttgttctgcagacatggcccctcccctctcttatgttatctgatctttgtatcaacattgaatcagccttgcaaatgg

SEQ ID NO: 868 - DNA, 813 bp, Triticum aestivum
ccacgcgtccgagacgacgaaccccagcgaccagcagagcagcgcaaagtgagccatgctagcctcgccggcgctcgccggcgccacccactccttcccggccttcgtgtcgggcagccgcggcgtccacctcccgtccgcctccgcgccctcgcactcgccggcgcggcgggccgccctggtcgtcctcgccaaggccaaggtgtccacgcccaatgccgaccgcatcgcccgccacgaccgtctccgcaagaaggtgagtggcaccacagagaggccaagactgagcgttttccgctcaaacaagcatttgtatgctcaggtgatcgacgatacaaagtcatgcactctggcttctgcctcaacaatgcacaaagctctttcaaaggagcttgagtactctgctgggccaacaactgaagtggcacaaaagattggtgaagtgatagccaagtcctgcttggagaaaggaatcaccaaagtggtctttgaccgagggggtttcctctaccatggccgcatcaaagctctagccgatgctgctagagagaatgggctcgagttctgaattttcctgttgatatttccagggtcgcatgtaatattctctcttttttcccgtctgtttgaacaattctttctgtagtcattggagtcgctctgcagacatggcccctctttaatgttatctgatctttgtatcaacattgaatcagcgttgcaaatggaagattcattttctgtctatttctgcactttggcttctgcccatgcaaccttgtaaaccaacacttggaaatggagtattcagtc

SEQ ID NO: 869 - DNA, 1005 bp, Triticum aestivum
gcagcttaaagaaacgcgagacggtggataggataaggcgagccattaggcgcgtgagacgacgaaccccagcgaccagcagcgcagcgcaagtgagccatgctagcctcgccggcgctcgccggcgccacccactccttcccggccttcgtgtcgggcagccgcggcgtccacctcccgtccgcctccgcgccctcgcactcgccggcgcggcgggccgccctggtcgtcctcgccaaggccaaggtgtccacgcccaatgccgaccgcatcgcccgccacgaccgcctccgcaagaaggttagcggcaccacagagaggccaagactcagcgttttccgctcaaacaagcatttgtatgctcaggtgatcgacgatacaaagtcgtgcactctggcttcagcctcaacaatgcacaaagctctttcaaaggagcttgagtactctgctgggccaacaactgaagtggcacaaaagattggtgaagtgattgccaagtcctgcttggagaaaggaatcaccaaagtggtctttgaccgagggggtttcctctaccatggccgcatcaaagctctagccgatgctgctagagagaacgggcttgagttctgaattttctgttgatattttcaggatcgcatgtaatattctcttttctttcccgtctattgaacaaagttctttctgtagtcatttgggttgttctgcagacatggccccctctttaatgttatctgatctttgtatcaacattgaatcagccttgcaaatggaagattcattttctgtttatttctgcaatttggcttctgcccatgcaaccttgtaaaccaacacttggaaatggagtattcagtctgcgagcttgggcaaaataactgagaagaatcatgcacttaagcagatttaatagtttagtactgctagttggaagagagaacagaaacaggtgcgatatctgtaaacctctttgttattggcatgtcaaatactgagtacagaatt

SEQ ID NO: 870 - DNA, 708 bp, Secale cereale
acgaaccccagcgaccagcagagcagcgcaagtgagccatgctagcctcgccggcgctcgccggcgccacccactccttcccggccttcgtatcgggcagccgcggcgttcacctcgcgtccgcctccgcgccctcgcactcgccggcgcggcgggccgccctggtcgtcctcgccaaggccaaggtgtccacgcccaatgccgaccgcatcgcccgccacgaccgcctccgcaagaaggttagcggcaccacggagaggccaagactcagcgttttccgctcgaacaagcatttgtatgctcaggtgatcgacgatacaaaatcgtgcactctggcttcagcctcaacaatgcacaaagctctttcaaaggagcttgagtactctgctgggccaacaactgaagtggcgcaaaagattggtgaagtgattgccaagtcctgcttggagaaaggaatcaccaaagtggtctttgaccgagggggtttcctctaccatggccgcatcaaagctctagccgatgctgctagagagaacgggcttgagttctgaattttctgttggtattttgacgatcgcatgtaatattctcttttctttcccgtctattgaacgatgttctttctgtagtcatttgggttgttctgcagacatggcccctctttaatgttatctgatctttgtatcaacattgaatcagccttgcaaa

SEQ ID NO: 871 - DNA, 815 bp, Triticum aestivum
gagacggcgaaccccagcgaccagcagcgcagagcgcgcaagtgagccatgctagcctcgccggcgctcgccggcgccacccactccttcccggccttcgtgtcgggcagccgcggcgtccacctcccgtgcgcctccgcgccctcgcactcgccggcgcggcgggccgccctggtcgtcctcgccaaagccaaggtgtccacgcccaatgccgaccgcatcgcccgccacgaccgcctccgcaagaaggttagcggcaccacggagaggccaagactcagcgttttccgctcaaacaagcatttgtatgctcaggtgatcgacgatacaaagtcgtgcactctggcttcagcctcaacaatgcacaaagctctttcaaaggagcttgagtactctgctgggccaacaactgaagtggcacaaaagattggtgaagtgattgccaagtcctgcttggagaaaggaatcaccaaagtggtgtttgaccgagggggtttcctctaccatggccgcatcaaagctctagccgatgctgctagagagaacggacttgagttctgaattttctgttgatattttcaggatcgcatgtaatattctcttttctttcccgtctattgaacaaagttctttctgtagtcatttgggttgttccgcggacatggcccctctttaatgttatctgatctttgtatcaacaatgaatcagccttacaaatggaagattcattttctgtttatttctgcaatttggcttctgccgaagcagccttgtaaaaccaacactttgaacatgaacattcagagtgccgatt

SEQ ID NO: 872 - DNA, 655 bp, Secale cereale
  misc_feature (10)..(10): n is a, c, g, or t
  misc_feature (37)..(37): n is a, c, g, or t
  misc_feature (39)..(39): n is a, c, g, or t
  misc_feature (80)..(80): n is a, c, g, or t
  misc_feature (98)..(98): n is a, c, g, or t
  misc_feature (152)..(152): n is a, c, g, or t
  misc_feature (191)..(191): n is a, c, g, or t
  misc_feature (398)..(398): n is a, c, g, or t
  misc_feature (604)..(604): n is a, c, g, or t
gaccagcagngcagcgcaagtgagccatgctagcctngncggcgctcgccggcgccacccactccttcccggccttcgtntcgggcagccgcggcgtncacctcgcgtccgcctccgcgccctcgcactcgccggcgcggcgggccgccctngtcgtcctcgccaaggccaaggtgtccacgcccaatgcngaccgcatcgcccgccacgaccgcctccgcaagaaggttagcggcaccacggagaggccaagactcagcgttttccgctcgaacaagcatttgtatgctcaggtgatcgacgatacaaagtcgtgcactctggcttcagcctcaacaatgcacaaagctctttcaaaggagcttgagtactctgctgggccaacaactgaagtggcncaaaagattggtgaagtgattgccaagtcctgcttggagaaaggaatcaccaaagtggtctttgaccgagggggtttcctctaccatggccgcatcaaagctctagccgatgctgctagagagaacgggcttgagttctgaattttctgttggtattttgacgatcgcatgtaatattctcttttctttcccgtctattgaacgangttctttctgtagtcatttgggtgttctcagacatgcccctctttaattta

SEQ ID NO: 873 - DNA, 737 bp, Avena sativa
tcattaggcgcgtgagacgaagagccccattgacgagcagcgcagtgcgcaagtgagccatgctagcctcaccggcgctcgccggcgccacccactccttcccggccttcgtgtcaggaaaccacctcccatccgcctacgcgccctcgcactcgccggcgcggcgggccgccctcgtcgtcctcgccaaggccaaggtgtccacgccccaggccgaccgcatcgcccgccatgtccgcctccgtaagaaggttagcggcaccacagagaggccaagactcagtgttttccgctcaaacaagcatttatatgctcaggtgatcgatgatacaaagtcgtgcactctggcttcagcctcaacaatgcacaaatctctttcaaaggagcttgagtactctgctgggccaacaactgaagtggcacaaaagattggtgaagtgattgccaagtcttgcttggagaaaggaattaccaaagttgttttcgaccgagggggtttcctctaccatggccgcatcaaagcgctagctgatgctgctagggagaatgggcttgagttctgaatcttccgaatttctgttgatatttccaggatcgcctgtaatattctcttttttcccctgtctgttgaacaaagttatttttgtagtcatttgagttgctatgcagacattgccactctttaattttatcttactttgtatcaaccttgcaaatggaagatctattttccgttt

SEQ ID NO: 874 - DNA, 723 bp, Avena sativa
cattaggcgcgtgagacgaagaaccccagtgacgagcagcgcagtgcgcaagtgagccatgctagcctcaccggcgctcgccggcgccacccactccttcccggccttcgtgtcaggaaaccacctcccgtcggcctacgcgccctcgcactcgccggcgcggcgtgccgccctcgtcgttctcgccaaggccaaggtgtccacgccccaggccgaccgcatcgcccgccatgtccgcctccgtaagaaggttagcggcaccacagagaggcccagactcagtgttttccgctcaaacaagcatttatatgctcaggtgattgatgatacaaagtcttgcactctggcttcagcctcaacaatgcacaaatctctttcaaaggagcttgagtactctgctgggccaacaactgaagtggcacaaaagattggtgaagtgattgccaagtcttgcttggagaagggaattaccaaagttgttttcgaccgcgggggtttcctctaccacggccgcatcaaagcgctagctgatgctgctagagagaacgggcttgagttctgaatcttctgttgatatttccagaatcgcttgtaatattcgccttttttctctcgcatgccgaacaaagttcattttgtagtcatctgagtcgctctgcagacattgccactccttaattttatctgatctttgtgtcaaccttgcaattggaagatatattt

SEQ ID NO: 875 - DNA, 935 bp, Secale cereale
gcgtgagacgacgaaccccagcgaccagcagagcagcgcaagtgagccatgctagcctcgccggcgctcgccggcgccacccactccttcccggccttcgtatcgggcagccgcggcgttcacctcgcgtccgcctccgcgccctcgcactcgccggcgcggcgggccgccctggtcgtcctcgccaaggccaagttcggagccgatgcgacgcatcgccgcacgaccgcctccgcaagaaggttagcggcaccacggagaggccaagactcagcgttttccgctcaaacaagcatttgtatgctcaggtgatcgacgatacaaagtcgtgcactctggcttcagcctcaacaatgcacaaagctctttcaaaggagcttgagtactctgctgggccaacaactgaagtggcacaaaagattggtgaagtgattgccaagtcctgcttggagaaaggaatcaccaaagtggtctttgaccgagggggtttcctctaccatggccgcatcaaagctctagccgatgctgctagagagaacgggcttgagttctgaattttctcttgatattttcaggatcgcatgtaatattctcttttctttcccgtctattgaacgaagttctttctgtagtcatttgggttgttctgcagacatggcccctctttaaagttatctgatctttgtatcaacattgaatcagccttgcaaatggaagatccgttttctgtctatttctgcactttggcttctgcccatgcaaccttgtaaaacaaacacttgcaagtggagcattcggtctgcgaggttgggcaaaataactgagaaaactcatgcacttatacagctttaatagtttatagtactgctagagaacagatacagatgagatatccgtaaacctatttctattggcatgtcacacagtaatgctga

SEQ ID NO: 876 - DNA, 1030 bp, Setaria italica
ataaccacgccgttgtgcgggagaagaagaaagctagtgaagactgaagagcagcgtcgcacaagtgagccatgctcgcctcgccggcgctcgccggcgcccactccttcgcggcgtccgtgtccggcaacctccgcatccccttaccttccgtccccgcgccctcgcccacgccggcgcgccgcgccgcgctgtccgtcgtcgccaaggtcaaggtgtccacgccccaggacgaccgcatcgctcgccatgtccgcctccgcaagaaggtgagtggcaccacggagaggccgaggctgagtgttttccgctcaaacaaacatctgtacgctcaagtcatcgatgatacaaagcaatgcactttggcttcagcttcaaccatgcacaaatctctctccaaggaattggaatactcggctggaccaacgattgaagtagcacaaaagatcggtgaagtgattgccaagtcttgcctggagaaaggaattaccaaagttgtcttcgaccgaggtggtttcctctaccacggccgcataaaagctcttgctgatgctgctagagagcacgggcttgagttctgaatatttactccaaatgtttgttcatattcccaggatcacctgtaatcttctctttcccccctgtacgttgaacagagtttgtagtcatccaccttgttctgcagagtgcggacttggccaaactttgatcgcatcagttttttgtaccagtcttgcattcaaaagcttctcaactcatctcccaccgttcgtactccctggtccacaccatattcatacatgatagtgttgatatgtgaaacattaggcctgttcgcttcagcttataagccggctgaaaagctgaaacggctgatttgttgtgagaggaaaacactgtttggtggctgataagccagctgaataagctgaagcgaacaggccgattgatcctctggatccgattcctaagtacaagggagttgaaacaggattgcacggtgtgccgtgtcggttctgctacagggaca

SEQ ID NO: 877 - DNA, 761 bp, Brachypodium distachyon
cgagccattaggcgcgtgagacgacgaagccaagtgaagagcgcgcgagtgattgagccatgctagcctcgccggcgctcgccggcgcccactccatcccggcgttcatgtcaggcaacctaggcgtccgcatgccggccatttccgcgctcccgcactcgccggcgcggcggtccaccctggtcgtcgtcgccaaggccaaggtgtccacgccccaggccgaccgcatcgcccgccatgtccgcctccgcaagaaggtcagtggcaccacagagaggccaagactcagtgttttccgctcaaacaagcatttatatgctcaggtgatcgatgatacaaagtcatgcactgtagcttcagcttcaacaatgcacaaatctctctcaaaggaccttgagtactccgctgggccaacaactgaagtggcacaaaagattggtgaagtgattgcaaagtcctgcttggagaaaggaatcaccaaagttgtttttgatcgaggaggtttcctctaccacggccgtataaaagctctggctgatgccgctagagagaacgggcttgaattctgaatcttctgaatgtttgttgatatttccaggatcggctgtaatattctccttctccccccctcctgctgaacgaagttctttttgtagtcatttgagttgctctgcagacatgtcactctgtaatttcacctgatctttgtatcagtgtcgactcaacctcgcaaatggaagatctattttgtgttgtgttaa

SEQ ID NO: 878 - DNA, 1015 bp, Brachypodium distachyon
attgtccggcagcttaaaaaacaccaggcagtggataggataaggcgacgagccattaggcgcgtgagacgacgaagccaagtgaagagcgcgcgagtgattgagccatgctagcctcgccggcgctcgccggcgcccactccatcccggcgttcatgtcaggcaacctaggcgtccgcatgccggccatttccgcgctcccgcactcgccggcgcggcggtccaccctggtcgtcgtcgccaaggccaaggtgtccacgccccaggccgaccgcatcgcccgccatgtccgcctccgcaagaaggtcagtggcaccacagagaggccaagactcagtgttttccgctcaaacaagcatttatatgctcaggtgatcgatgatacaaagtcatgcactgtagcttcagcttcaacaatgcacaaatctctctcaaaggaccttgagtactccgctgggccaacaactgaagtggcacaaaagattggtgaagtgattgcaaagtcctgcttggagaaaggaatcaccaaagttgtttttgatcgaggaggtttcctctaccacggccgtataaaagctctggctgatgccgctagagagaacgggcttgaattctgaatcttctgaatgtttgttgatatttccaggatcggctgtaatattctccttctccccccctcctgctgaacgaagttctttttgtagtcatttgagttgctctgcagacatgtcactctgtaatttcacctgatctttgtatcagtgtcgactcaacctcgcaaatggaagatctattttgtgttgtgttaattctcttcagccttctgaaaccagcactagcaaatagggacatccaatcatgattgcagcagtacgtgattgtgaagttccagggcaatacactgacagctcaatttggaacagaagatactcaatgttgtcaccatgggatacgcctgactgctgagtataaacgtgctgattgcacggatgcaccatctgctataaatgaaggc

SEQ ID NO: 879 - DNA, 896 bp, Panicum virgatum
acccacgcgtccggttgtgcgggagacgaagagggaaagtgaagagcagcgtcggactagtgagccatgctcgcctcgccggcgctcgccggcgcgcactccttcgcggcgtccgtgtccggcagcctccgcgtccccctaccttccgtccccgcgccctcgcccacgccggcgcggcgcgcagcgctgtccgtcgtcgccaaggtcaaggtgcctacgccccaggacgaccgcatcgcccgccatgtccgcctccggaagaaggtgagtggcaccacggagagacccagactgagtgttttccgctcaaacaagcatttgtacgctcaagtcattgatgatacaaagcaatgcactttggcttcggcttcaaccatgcacaaatctctctccaaggaattggaatactccgctggaccaacaatcgaagtagcacaaaagattggtgaagtgattgccaagtcttgcctggagaaaggaattaccaaagttgtcttcgaccgaggtggtttcctctaccacggccgcataaaagctcttgctgatgctgctagagagcacgggcttgagttctgaatctttaccccgaatgtttgttcatatttcaatgatcacctgtaatcttttcttttcaccccctcgatgttgaacagagtttgtagtcacctgccttgttttgcagagtgcagattgggccaaactttgatggcatcagatttttgccccagtcttgcattcaaaagcttctcaacatgatattatgaatctcccaccattcatgctctctggtccacaccatattcattcctgacattgatcctttggatccgaatcccaagtacagggaactgtaacaggaagatgatggcgaacatggaatattttctactctcttg

SEQ ID NO: 880 - DNA, 780 bp, Panicum virgatum
ggataaggccgtaaccaaagacgccgttgtgcgggagacgaagagggaaagtgaagagcagcgtcggactagtgagccatgctcgcctcgccggcgctcaccggcgcccactccttcgcggcgtccgtgcccggcagcctcagcatacccctaccttccgtccccgcgccctcgcccacgccggcgcggcgcgcagtgctgtccgtcgtcgccaaggtcaaggtgcccacgccccaggacgaccgcatcgcccgccatgtccgcctccggaagaaggtgagtggcaccacggagaggccgagactgagtgttttccgctcaaacaagcatttgtatgctcaagtcattgatgatacaaagcaatgcactttggcttcagcttcaaccatgcacaaatccctctccaaggaattggaatactccgctggaccaacgattgaggtagcacaaaagattggtgaagtgattgccaagtcttgcctggagaaaggaattaccaaagttgtcttcgaccgaggtggtttcctctaccacggccgcataaaagctcttgctgatgctgctagagagcacgggcttgagttctgaatatttacctcaaatgtttgttcatatttcaatgatcacctgtaatcttctcttttcaccccctctatgttgaacagagtttgtagtcacctgccttgttttgcagagtgcagactgggccaaactttgatcgcatcagatttttgttccagtctttgcattcaaaagcttctcaacacgatattatgaatc

SEQ ID NO: 881 - DNA, 1041 bp, Oryza sativa
ggtggataggataaggcaaagccattgggctcgtcggagagacaagtagagagcagcgtagtcgccgcacttagccatgctcgcctcgccggcgctcgccggcgcgcgcgccttcgcggcgaccgtgtccgggagcctcggcatccccattccggccatctccgcgccctcgccctcgcaggcgcggcggcgggcctctctcgtcgtcgttgcaaaggtcaaggtgtccactccccaggccgaccgcatcgcccgccatgtccgcctccgcaagaaggttagtggcaccacggagaggccaagactcagtgttttccgctcaaacaaacatttatatgctcaagtgattgacgatacaaagtcatgcactctggtttcagcttccacaatgcacaagtctctttcaaaggacttggaatactcggcagggccaacagttgaagtggcacaaaagattggtgaagtgattgccaagtcttgcttggagaaaggaattaccaaagttgtttttgaccggggtggtttcctctaccatggtcgcattaaagctctggctgatgctgctagagagaatgggcttgatttctgaaacctccaaatgtttgttcatatctccagaatcacttgttactttctttttcgcccacctgtcgaacagagtttttctttgtagtaatttgatttgctctgcaggcttggctactctttaattgtatatcaccccactatcagctcaccagttattgagtttgtctgcttcatgaagtttcttttaacgggcatattttcagtttaatagatcaatctgttgccatcctatcctacatgtgttgttttgaactctgttcgtgcaaaatggagcactcctacaacctgctactagagttctggcctgcaaaagcccaggcctgaaatggctaatgtgggcttcctggccaacattttgtgccaggcctcgtactcttgtcgaagctgtcaggtgctctggagtctggagcgcgttattcagattacaaaataaaaacgtgctaattgcactga

SEQ ID NO: 882 - DNA, 801 bp, Oryza sativa
aaagccattgggctcgtcggagagacaagtagagagcagcgtagtcgccgcacttagccatgctcgcctcgccggcgctcgccggcgcgcgcgccttcgcggcgaccgtgtccgggagcctcggcatccccattccggccatctccgcgccctcgccctcgcaggcgcggcggcgggcctctctcgtcgtcgttgcaaaggtcaaggtgtccactccccaggccgaccgcatcgcccgccatgtccgcctccgcaagaaggttagtggcaccacggagaggccaagactcagtgttttccgctcaaacaaacatttatatgctcaagtgattgacgatacaaagtcatgcactctggtttcagcttccacaatgcacaagtctctttcaaaggacttggaatactcggcagggccaacagttgaagtggcacaaaagattggtgaagtgattgccaagtcttgcttggagaaaggaattaccaaagttgtttttgaccggggtggtttcctctaccatggtcgcattaaagctctggctgatgctgctagagagaatgggcttgatttctgaaacctccaaatgtttgttcatatctccagaatcacttgttactttctttttcgcccacctgtcgaacagagtttttctttgtagtaatttgatttgctctgcaggcttggctactctttaattgtatatcaccccactatcagctcaccagttattgagtttgtctgcttcatgaagtttcttttaacgggcatattttcagtttaatagatcaatctgttgccatcct

SEQ ID NO: 883 - DNA, 741 bp, Cynodon dactylon
agccagtagcagagtcgctcaacagagccatgctcgcctcgccggcgctcgccggcgcccactccttctcggcgtccgtgtccggaagccttagcgtccccctaccttgcatctctgcgccctcgccagtgccggcgcggcgcgcgtcgctgtccgtcgtcgccaaggtcaaggtgtccacgccccaggccgaccgcatcgcccgccacacccgcctccgcaagaaggtaaatggcacaacggagagaccaaggctgagcgtcttccgctctaacaagcacctgtatgctcaagtcatcgatgatacaaagcaatgcactttggcttcagcatcaaccatgcacaaatctctctcccaggaattcgaatactctgctgggccaacaattgaaatagctcaaaagattggtgaagtgattgccaagtcttgcctggagaaaggaatcaccaaagttgtattcgaccgaggcggttttctgtatcatggccgcataaaagctttggctgatgctgctagggagcatggacttgaattctgaatcttcaagatatttgttcatatttccaggatcacatgtaatcttctcttctatgttgaacagagatcctttttagtcattcgccttgtcctgcagagggcggacgtggtcacatgttaaatgcatgagcttttgcaccatcttgtgttctgaagtttgtctaccttacagtgtccatatcgtatatcatagtatgatctgg

SEQ ID NO: 884 - DNA, 727 bp, Secale cereale
acgaaccccagcgaccagcagcgcagcgcaagtgagccatgctagcctcgccggcgctcgccggcgccacccactccttcccggccttcgtctcgggcagccgcggcgtccacctcccgtccgcctccgcgccctcgcactcgccggcaaggcgggccgccctggtcgtcctcgccaaggccaaggtgtccacgcccaatgccgaccgcatcgcccgccacgaccgcctccgcaagaaggtgagcggcaccacagagaggccaagactcagtgttttccgctcaaacaagcatttgtatgctcaggtgatcgacgacacaaagtcgtgcactctggcttcagcctcaacaatgcacaaagctctttcaaaggagcttgagtactctgctgggccaacaactgaagtggcacaaaagattggtgaagtgattgccaagtcctgcttggagaaaggaatcaccaaagtggtctttgaccggagggggtttcctctaccatggccgcatcaaagctctagccgatgctgctagagagaacgggcttgagttctgaattttctgttggtattttgacgatcgcatgtaatattctcttttctttcccgtctattgaacgaagttctttctgtagtcatttgggttgttctgcagacatggcccctctttaatgttatctgatctttgtatcaacattgaatcagccttgcaaatggaagatccgttttctg

SEQ ID NO: 885 - DNA, 499 bp, Secale cereale
gactgacgacgaaccccagcgaccagcagagcagcgcaagtgagccatgctagcctcgccggcgctcgccggcgccacccactccttcccggccttcgtatcgggcagccgcggcgttcacctcgcgtccgcctccgcgccctcgcactcgccggcgcggcgggccgccctggtcgtcctcgccaaggccaaggtgtccacgcccaatgccgaccgcatcgcccgccacgaccgcctccgcaagaaggttagcggcaccacggagaggccaagactcagcgttttccgctcaaacaagcatttgtatgctcaggtgatcgacgatacaaagtcgtgcactctggcttcagcctcaacaatgcacaaagctctttcaaaggagcttgagtactctgctgggccaacaactgaagtggcacaaaagattggtgaagtgattgccaagtcctgcttggagaaaggaatcaccaaagtggtctttgaccgtaggggtttcctc

SEQ ID NO: 886 - DNA, 615 bp, Eragrostis curvula
  misc_feature (65)..(65): n is a, c, g, or t
  misc_feature (93)..(93): n is a, c, g, or t
  misc_feature (95)..(95): n is a, c, g, or t
  misc_feature (114)..(114): n is a, c, g, or t
  misc_feature (116)..(116): n is a, c, g, or t
  misc_feature (218)..(218): n is a, c, g, or t
  misc_feature (304)..(304): n is a, c, g, or t
gcacgagggaagaaagcgagcgagcagcagagtcgcacaagggagccatgctcgcctcgccggcnctcgccggcgcccactcattcgcggcancngtgtccggcagcctccgantncccctaccttccatccctgcgccgtcgcccgcgcctgcacggcgcgcggcgctgtccgtcgtcgcaaaggtcaaggtgtccacgccccaggccgaccgcatngcccgccatacccgcctccgcaagaaggtaaatggcacgacagagagaccaaggctgagcgttttccgctctaacaagcatttgtncgctcaagtcatcgatgatacaaagcaatgcactttggcttccgcttcaaccatgcacaaatctctctccaaggaattcgactactcagctgggccaacaattgaaatagcgcaaaaaattggtgaggtgattgccaaatcttgcctggagaaaggaattaccaaagttgtatttgaccgaggtggtttcctctatcatggccgcataaaagctctggctgatgctgctagagagcatggacttgaattctgaatcttccaaatgtttgttcatatttccaggatcacaagtaatcttctcttttcccctg

SEQ ID NO: 887 - DNA, 782 bp, Saccharum officinarum
ggcgcaaagggagccatgctcgcctcgccggcgctcgccggcgcccactccttcgcggcgtccgtgtccggcaacctcctcatccccttaccttccatccccgcgccggcccgtcgcccggcgctgtccgtcgtcgccaaggtcaaggtgtccacgccccaggacgaccgcatcgcccgccatgtccgcctccgcaagaaggtaagtggcaccacagagaggccgaggttgagtgttttccgctcaaacaagcatctgtatgctcaagtcatcgacgacacaaagcaatgcactctggcttcagcttcaaccatgcacaaaactctctccaaggaattggaatactcggctgggccaacgattgaaatagcacaaaagattggtgaggtgattgccaagtcttgcttggagaaagggattaccaaagttgtcttcgaccgaggtggtttcctctaccatggccgcatcaaagctcttgctgattctgctagagagcacgggcttgaattctgaatcgtccaaatgtttgttcatatctccaggatcacctgtaatcttcccttttttctctacatgtcggacagagttcttttgtagtcatcccccttgttctgcagggggctacttttttttatcatgtcacgtttttgtaagagtcttgtgttctgatgcttctctaactgatattagtatccatctctcccgccatctgtactctatggtgcacatcatatattcatgtacgatagaatgatatgtggaacattgatcctttcgatctg

SEQ ID NO: 888 - DNA, 921 bp, Sorghum bicolor
ataacagagacgccgttgtgcgggagacacagaacgaagtgaagagcagcggcgcaaagggagccatgctcgcctcgccggcgctcaccggcgcccactcctttgcggcgtccgtgtccggcaacctcctcgtcaccttgccttccgtacccgcgcctgcccgtcgcgcggcgctgtccgtcgtcgccaaggtcaaggtgtccacgccccaggacgaccgcatcgcccgccatgcccgcctccgcaagaaggtaagtggcaccacggagaggccgaggttgagtgttttccgctcaaacaagcatttgtatgctcaagtcattgacgatacaaagcagtgcactctggcttcagcttcaaccatgcacaaaactctctccaaggaattggaatactcagctgggccaacaattgaaatagcacaaaagatcggtgaggtgattgccaagtcttgtttggagaaagggatcaccaaagttgtcttcgaccgtggcggtttcctctaccatggccgcatcaaagctcttgctgattctgctagagagcacgggcttgaattctgaatcgtccaaatgtttgttcatatctccaggatcacctgtaatcttctcttttctctccatgtgtcgaacagagttcttttgtagtcattcgccttgttctgcagggtgcagagatggccactctttgatcatgccacgtttttttgtaatagtcttgtgttctcatgcttctctacttgatgttatccattgcccgccgtctgtactctggtgcacatcatatataagtacgatagaatgatacccttcgccttgctctgatgcttctctacgataaaatgataccttttgtttggctgaaaagccatagctgaaagcattgttcgctcatttgttgtgagagaaaaatattgctgaa

SEQ ID NO: 889 - DNA, 1036 bp, Sorghum bicolor
taaacgctgtacagcggataggataaggccataacagagacgccgttgtgcgggagacacagaacgaagtgaagagcagcggcgcaaagggagccatgctcgcctcgccggcgctcaccggcgcccactcctttgcggcgtccgtgtccggcaacctcctcgtcaccttgccttccgtacccgcgcctgcccgtcgcgcggcgctgtccgtcgtcgccaaggtcaaggtgtccacgccccaggacgaccgcatcgcccgccatgcccgcctccgcaagaaggtaagtggcaccacggagaggccgaggttgagtgttttccgctcaaacaagcatttgtatgctcaagtcattgacgatacaaagcagtgcactctggcttcagcttcaaccatgcacaaaactctctccaaggaattggaatactcagctgggccaacaattgaaatagcacaaaagatcggtgaggtgattgccaagtcttgtttggagaaagggatcaccaaagttgtcttcgaccgtggcggtttcctctaccatggccgcatcaaagctcttgctgattctgctagagagcacgggcttgaattctgaatcgtccaaatgtttgttcatatctccaggatcacctgtaatcttctcttttctctccatgtgtcgaacagagttcttttgtagtcattcgccttgttctgcagggtgcagagatggccactctttgatcatgccacgtttttttgtaatagtcttgtgttctcatgcttctctacttgatgttatccattgcccgccgtctgtactctggtgcacatcatatataagtacgatagaatgatacccttcgccttgctctgatgcttctctacgataaaatgataccttttgtttggctgaaaagccatagctgaaagcattgttcgctcatttgttgtgagagaaaaatattgctgaatggctagtagatttggcagataagctcaagcgaatagggattgatgattggtgaaacaaaaaggaataaggattctggtgattgg

SEQ ID NO: 890 - DNA, 1301 bp, Zea mays
aatttgggtcaagcctttaaacgccgtacagcggataggataaggccatctcccataacggagagagacgaagagagcagaagcgaagagcagcggcgcaaaggaaagggagccatgctcgcctcgccggcgctcgccggcgcccactccttcgcggcgtccgtgtatggaaacatcctcgtcccctcgcctcccgtccccgcgccggcacgtcgcgcggcgctgtccgtcgtcgccaaggtcaaggtggccacgccccaggacgaccgcatcgcccgccacgtccgcctccgcaagaaggtaagtggcaccactgagaggccgaggttgagtgttttccgctcaaacaaacatctgtacgctcaagtcatcgacgacacaaagcaatgtactctggcttcagcttcaaccatgcacaaatctctctccaaggaatttgaatactcggctgggccaacgatcgaaatagcacaaaagatcggtgaggtgattgccaagtcttgcttggagaaagggatcaccaaggttgtcttcgaccgaggtggtttcctctaccatggccgcataaaggctctcgctgattctgccagagagcacgggcttgaattctgagtcgtccaggcgtttgttcatatctccaggatcacctgtaatcttctcttttttttctctctccatatgccaaacagagctgttttgtagtcactcgccttgttctacagggtgcaaagccatggcccatggccactcgttgaccatgtcacgtttttttcgtttggtaagagtcttgtgttctgacgcttctcgaattgatattataagctgatcgtggttgttagggtgtgtttgaatttactagagctaataattaattagctaaaaatataccagtagaattagctagctaacaaataattagctaactagtagctaatttactaaaaatagctaatagctaaactattagctaggatgtttggatgtctatagctaattttagtcactaactattatctctagtgcattcaaataccccttagaccaagagaatattttactagactaaggaggggtttgaatgcgctagagctaatagtgactaaaattagttagacatccaaacaccttatctaatagtttaactattacctattttaaagtaaattagttaatagtaagctatctatttgttagctagctaattttactagtaattttttagctaactaactattagctctagtgcattcaaacaccctctaaactttttcatggctttaatccaattgcgactgcgggtt

SEQ ID NO: 891 - DNA, 773 bp, Festuca arundinacea
gcctacgcgccctcgcactcgccggcgcggcgggcctccctggtcgtcctcgccaaggccaaggtgtccacgccccaggccgaccgcatcgcccgccatgtccgcctccgcaagaaggttagcggcaccacggagaggccaagactcagcgtcttccgctcaaacaagcatttatatgctcaggtgatcgacgatacaaagtcatgcactctggcttcagcctcaacaatgcacaaatctctttcaaaggacctagagtactctgctgggccaacaactgaagtggcgcaaaagattggtgaggtgattgccaagtcttgcttggagaagggaattaccaaagttgttttcgaccgagggggtttcctctaccacggccgcatcaaagcactagctgacgctgctagagagaatgggcttgaattctgaatgttctgtatttctgttgatatttccaggatcgcatgtaatattctctttttccaccccacctgttgaactaatttatttttgtagtcatttgagtcgctctgcagacatggctgctctttaaaaaaattctaatctttgaaccaacctttgcaaatggaacttttgttttctgtttatttctctaaaaaaaaaaaaaaaaaactcgacgatggttatgtagtagtagccttggcgtgtgtatcataatgaattttttccctacgtctgtgtgcttactagcaaagtgcgggtcgtgtagtagtatctgttgatcgagaatggaagaaaggctgggtttgcca

SEQ ID NO: 892 - DNA, 690 bp, Triticum aestivum
ccacgcgtccgactcacactactactgatctcagctagcctaggagtactcgagtttactaccagttcaattccttcggtacgaggctctctccggcgaagatgtctacggtgacccgcgcctacctcgaccagaggctcgccgccgccaagcgctgctccagagaggctgccatggcgggagcaaaggccgcggccgtcgccaccgtcgctgccgcagtgcccacactggcgagcgtgaggatgctgccgtgggccaaggcgcacctgaacccgaccgggcaggcgctcatcatctccaccgtggccgggatggcctacttcatcgtcgccgacaagaccatcctgtccatggccagaaagcactccttcgacgacgcgccagaccacctcaagaacacctccttccactaattagacacttgattagccatggcccaataaactgtgtacgcaggcccgtggcaacgtgtcggctgaaacatagtagtataatgttcagcgacagggccagcaggcgaggcgacgatggttgcagtgctgaaaggtggtgttcagcccttcaatttgtgcgagcaagcacttattatctgatgatgtatgtatgtaataatgtggccatgttctccatcttagtatcttcccggagatcttgaattaataacaactactagttctaataaaaaaaaaa

SEQ ID NO: 893 - DNA, 992 bp, Hordeum vulgare
cctcctcttatccagtgcaaagtgtagtggagtgctcccatttttatacgaccgacgaacgaggcgcggccacctgtgctgtgctctgctgcagcgaggcgccctcccgccggtaccaccgctcgctcgtctcaaaaccgtggtcttgattcccaccgtatcaagtccgtcttcctcccggcacgccggtttcgcggtttcatgcgaactacgtataaatctcgccggagcaccttgctctccccaccgcacctcactccacctactgctactactacttactcatctttttagctactgcacttggctttgctgctactgctcgttcacttccttccgatctcgtacaaccaagctttgctccggcgaagaagatgtctacggtgacccgcgcctacctcgaccagaggctcgccgcagctaagcgctgctccagagaggctgccatggccggagccaaggccgcggccgtcgccaccgtcgcagccgcagtgcccaccctggcgagcgtgaggatgctgccgtgggccaaggcgcacctgaacccgaccggccaggcgctcatcatctccaccgtcgccgggatggcctacttcatcgtcgccgacaagaccatcctctccatggccaggaagcattccttccaggacgcgccggagcacctcaagaacacctcattccactaattagacgccgtgattagctagggcgggcgcaataaactgatcgacggccgtacgtgtctgatgaatgtgtgaatgaatgatgatagactgtatagtgttcagtgacactgtgacaggggcagtgccgaatgatgtagtgcgcttctcctccttcatgtactttttcttttgttttcttccttcttcttcatgcacttatctgatgatgatgtgcagtaataatttatgtagccgtgtattatcttcaggagtattatcttattatcttgccagaggttcgtaactttacgtaaaacaattcgtaag

SEQ ID NO: 894 - DNA, 634 bp, Secale cereale
tcactactactgctgatacttcgctgctactactaccagctcacttccttcggatctcttgccggcgaagatgtctacggtgacccgcgcatacctcgaccagaggctcgccgccgccaagcgctgctccagagaggctgccatggcgggagccaaggccgcggccgtcgccaccgtcgcagccgcagtccccaccctggcgagcgtgaggatgctgccgtgggccaaggcgcacctgaaccccaccgggcaggcgctcatcatctccaccgtcgccgggatggcctacttcatcgtcgcggacaagaccatcctctccatggccaggaagcactccttcgacgacgcgccggaccacctcaaggacacctccttccactagttagatccattagtaatgcccaataaaccgtgtatgccaaagtgcatagcaagcgtacagtgatcagcaagggaggtcagggatgcgtaataaactgtgtacgccggccggcctctgcgtgtttgctgaaagatggtataatgttcagcgagaggggcgaccaggcgaagcgatgcttggatgtggcagtgcgcttctatgtaataatgtggccatgtttctgagatctttaattaataacatctagtcttc

SEQ ID NO: 895 - DNA, 667 bp, Triticum aestivum
actcacactactactgatctcagctagcctaggagtactcgagtttactaccagttcaattccttcggtaccaggctctctccggcgaagatgtctacggtgacccgcgcctacctcgaccagaggctcgccgccgccaagcgctgctccaaagaggctgccatggcgggagccaaggccgcggccgtcgccaccgtcgctgccgcagtgcccacactggcgagcgtgaggatgctgccgtgggcgaaggcgcacctgaacccgaccgggcaggcgctcatcatctccaccgtcgccgggatggcctacttcatcgtcgccgacaagaccatcctctccatggccaggaagcactccttcgacgacgcgccagaccacctcaagaacacctccttccactaattagacacttgattagccagtgcccaataaactgtgtacgcaggcccgtggcaacgtgtcggctgaaacatagtagtataatgttcagcgacagggccagcaggcgaggcgacgatggttgcagtgctgaaaggtggtgttcagcccttcaatttgtgcgagcaagcacttattatctgatgatgtatgtatgtaataatgtggccatgttctccatcttagtatcttcccggagatcttgaattaataacaactactagttcta

SEQ ID NO: 896 - DNA, 629 bp, Triticum aestivum
atccatctcatctcatccaactcacactactactgatctcagctaggtgtacttgagttcactagctagctctctcccacgaagatgtcgacggtgacccgtgcctacctcgaccagaggctcgccgccgccaagcgctgctccaaagaggctgccatggcgggagccaaggccgcggccgtcgccaccgtcgctgccgcagtccccaccctggcgagcgtgaggatgctgccgtgggcgaaggcgcacctcaaccccaccgggcaggcgctcatcatctccacggtcgccgggatggcctacttcatcgtcgccgacaagaccatcctctccatggccaggaagcactccttcgacgacgcgccggagcacctcaagaacacctccttccactaattagactatagtagatccattattagtatagtgtgtaataaaccgtgtctgctgaagcctgaaagatggtataatgttgagcgagaggggcgatcaggcgaggtgatggtataattaactgatgatgtatgtaataatgtggtcatgttctccatcttgtcatctttccagggatcgtgaattaataaccagctcttgtacaactttgcttcaagtacactcactcatgactc

SEQ ID NO: 897 - DNA, 586 bp, Secale cereale
actactaccgctgaaacttcactgctactaccacctcacttccttcggatctcttgccggcgaagatgtctacggtgacccgcgcctacctcgaccagaggctcgccgccgccaagcgctgctccagagaggctgccatggcgggagccaaggccgcggccgtcgccaccgtcgcagccgcagtccccaccctggcgagcgtgaggatgctgccgtgggccaaggcgcacctgaacccgaccgggcaggcgctcatcatctccaccgtcgccgggatggcctacttcatcgttgccgacaagaccatcctctccatggcaaggaagcactccttcgaggacgcgccggaccacctcaaggacacctccttccactaattaggctttaattgatccatcagtagtgggcaataatctgtgtgcgccagcccgtacgtgtctgctgaaagatagtataaatgttcagcacctatccgagatcagtgcagacagtgagtggtgtggtgtactgctcttctctgcgtgcaagcacttatctgatcaagtaatcatcatgtatcaagccaataatcttgaattaataataa

SEQ ID NO: 898 - DNA, 529 bp, Secale cereale
atgggacacaccgctactcatctcgcctcacacacttcactgctagcaagttcacttctcctaccaccaacctccctcaccaacatgtctacggtcacccttgcctacctcgaccagaggctcgccgccgccaaacgctgctccagagaggctgccatggcgggagccaaggccgcggccgtcgccaccgtcgcagccgcagtccccaccctggcaagcgtgaggatgcttccatgggcgagagcgcacctgaacccaaccgggcaggcgctcatcatttccaccgtcgccgggatggcctacttcatcgtcgccgacaagaccatcctctccatggccagaaagcactcattcgacgacgcgccggaccaccttaagaacacctccttccactaattggacacttgattagccagtgcctaataaactgtgtactcaggcccttacgtgtcttctggaacatagtagtataatgttcagcaacacaggtcagcaggcaaggcgaggttcacagtccggaaaggtggta

SEQ ID NO: 899 - DNA, 629 bp, Hordeum vulgare
catctttttagctactgcacttggctttgctgctactgctcgttcacttccttccgatctcgtacaaccaagctctgctcccggcgaaggaagatgtcgacggtcacccgcgcctacctcgaccagaggctcgccgcagctaagcgctgctccagagaggctgccatggccggagccaaggccgcggccgtcgccaccgtcgcagccgcagtccccaccctggcgagcgtgaggatgctgccgtgggccaaggcgcacctgaaccctaccggccaggcgctcatcatctccaccgtcgccgggatggcctacttcatcgtcgccgacaagaccatcctctccctggccaggaagcactcctttcaggacgcgccggagcacctcaagaacacctccttccactaattagacgccgtgattagctagggcgggcgcaataaactgatcgacggccgtacgtgtctgatgaatgtgtgaatgaatgatgatagactgtatagtgttcagtgacactgtgacaggggcagtgccgaatgatgtagtgcgcttctcctccttcatgtactttttcttttgttttcttcttcttcatgcacttatctgatgatgatgtgcagtaataatttatg

SEQ ID NO: 900 - DNA, 547 bp, Triticum aestivum
ttctcgtaccaccaacctccctcgccaagatgtggacggtgacccgcgcctacctcgaccagaggctcgccgccgccaagcgctgctccagagaggccgccatggccggagccaaggccgcggccgtcgccaccgtcgctgccgcagtccccacactggcgagcgtgaggatgctgccgtgggcgagggcgcacctgaacccgaccgggcaggccctcatcatctccaccgtcgccgggatggcctacttcatcgtcgccgacaagaccatcctctccatggccaggaagcactccttcgacgacgcgccggaccacctcaagaacacctccttccactaataattcgactataatagatccattagtagtgggtaataatctgcacgccggcctggaagtgtctgctgaaagatagtactgtaatgttcaggcagcacttatctgagatcaggcgaggcttgcagacagccagtggcgtagtactgcgcttctctgcgcgcaagaacttatctgatgaagtgatcatgtatccacccattaatctt

SEQ ID NO: 901 - DNA, 950 bp, Triticum aestivum
gatcagacatccgcttttccttgccctgtataaaaactacagaatacagaatggtggacgaactgcacactgattgcaagcacagatgatcggtgatcacaaccaaggaagggaacacatctttcagaacagtcacacatcacctcacatgagctcctcctccttgcggaggtactcgccggcgtcggactggtggagcaccaccacggcgttggtgtcggccttcctgcagtcctgcgcgcccctggcggcgaccccgaacccgagcggcacgtcggccatggacatgacgacgacgccatcgccggacttggtgttctccgtgatgcgcgcgagcgcggacttggcctcgtgccgaattcggcacgagggctactcatcttacctgacacacttcacttccttcggatctcgtgccaccaagctctgctcccgccaagatgtcgacggtgacccgcgcctacctcgaccagaggctcgccgctgccaagcgctgctccagagaggctgccatggccggagccaaggccgcggccgtcgccaccgtcgccgccgcagtccccaccctggcgagcgtgaggatgctgccgtgggccaaggcgaacctcaacccgaccgggcaggcgctcatcatctccacggtcgccgggatggcctacttcatcgtcgccgacaagaccatcctgtccatggccaggaagcactccttcgacgacgcgccagaccacctcaagaacacctccttccagtaattacgctataatagctccattaatagtgcgtaataaaccgtgtacgccggtcggcctgtacatgtctgctgattcagctagggaggcgatcaggcgaggcttgcagacagtgagtggtctactgcgcttctctccgagcaagcacttatctgatcaagtaatcatcatgtatccaaccagtaattttgaattcataat

SEQ ID NO: 902 - DNA, 620 bp, Triticum aestivum
ccacgcgtccgctcgtatcatttcactgctaatactagctcacttccttcggatctcgctcgttccaccaagctactagtccctcgaagatgtcgacggtgacccgtgcctacctcgaccagaggcttgccgccgccaagcgctgctccagagaggctgccgtggcgggagccaaggccgcggccgtcgccaccgtcgctgccgcagtccccaccctggcgagcgtgaggatgctgccgtgggcgaaggcacacatcaacccaactggccaggccctcatcatctccactgtcgccgggatggcctacttcatcgtcgccgacaagaccatcctctccatggcaaggaagcactccttcgatgaggcgccggaccacctcaagaacacctccttccactgattttagactataatagacccattagtagtgcgcaataagctgtgtgcgctagcccgtacgtgtctgcagaaagatagtgtataacgttcagcacttacccgagatcaggcgaggcttgcagacagttagtggtgtgggtgcaattagcacttatctgatcaagtaatcatcatgtatccagccagtaatcttgaattagtaataacttgcatttgtaca

SEQ ID NO: 903 - DNA, 548 bp, Triticum aestivum
ctactcatcttacctgacacacttcacttccttcggatctcgtgccaccaagctctgctcccgccaagatgtcgacggtgacccgcgcctacctcgaccagaggctcgccgccgccaagcgctgctccaaagaggctgccatggcaggagccaaggcggcggccgtcgccaccgtcgctgccgcagtgcccacactggcgagcgtgaggatgctgccgtgggcgaaggcacacctgaacccgaccgggcaggccctcatcatctccaccgtcgccgggatggcctacttcatcgtggccgacaagaccatcctctccatggccaggaagcactcctttgaggacgcgccggagcacctcaagaacacctccttccactaattagactataaaatagatccattagtagtccgtaatagtctgcacgccggactggaagtgtctgctgaaagatggtattgtaatgttcaggcagcacttctatgaaatcaggcgagtggtgtagtactgcgcttctttgcccgcaagaacttatctgatgaagtgatc

SEQ ID NO: 904 - DNA, 736 bp, Secale cereale
tcactactactgctgatacttcactgctactaccagctcacttccttcggatctcttgccggccaagatgtcgacggtgaccggtgcttatcttgaccagaggctcgccgccgccaaacgctgctccagagaggctgccatggccggagccaaggccgccgccgtcgccaccgtcgcagccgcagtgcccaccctggcgagcgtgaggatgctgccgtgggccaaggcgcacctggaacccaaccgggcaggccctcatcatctccaccgtcgccgggatggcctacttcatcgtcgccgacaagaccatcctttccatggccagaaagcactcattcgatgatgcgccagaccaccttaaggacacctccttccactaattggacacttgattagccagttcctaataaactgtgtactcaggcccgtacgtgtcttctgaaacatagtagtataatgttcagcgacacagggccagcaggcaaggcgaggttgcagtgcggaaaggtggtatgcatcccaagaacacctccttccagtagtcagactataatagatccgttagcagggtgcaataagctgtgtgcgcgagcccgtacgtgtccgctgaaagatagtataacgttcagcacttatccgagatcaggcgaggcttgcacacagtcagtgttgtcgtgtactgctcttctctgcgtgcaagcacttatctgatcaagtaatcatcatgtatcctgcc

SEQ ID NO: 905 - DNA, 531 bp, Secale cereale
ctcacagtcacactactaccgctgaaacttcactgctactaccacctcacttccttcggatctcttgccggcgaagatgtctacggtgacccgcgcatacctcgaccagaggctcgccgccgccaaacgctgctccagagaggctgccatggcgggagcgaaggccgcggccgtcgccaccatcgcagccgcagtccccaccctggcgagcgtgaggatgctgccgtgggccaaggcgcacctgaacccgaccgggcaggcgctcatcatctccaccgtcgccgggatggcctacttcatcgtcgccgataagacaatcctctccatggcaaggaagcactccttcgaggacgcgccggaccacctcaaggacacctccttccactaattaggctataattgatccatccgagatcagtgcagacagtgagtggtgtggtgtactgctcttctctgcgtgcaagcacttatctgatcaagtaatcatcatgtatccagccaataatcttgaattaataataaacttgcatt

SEQ ID NO: 906 - DNA, 427 bp, Secale cereale
ttctcgtaccaccaacctcccacgccaagatgtcgacggtgacccgcgcctacctcgaccagaggctcgccgccgccaaacgctgctccagagaggctgccatggcgggagccaaggccgcggctgtcgccaccgtcgcagccgcagtccccaccctggcaagcgtgaggatgcttccatgggcgagggcgcacctgaacccaaccggccaggctctcatcatctccaccgtcgccgggatggcctacttcatcgtcgccgacaagaccatcctcgccatggcaaggaagcactccttcgaggacgcgccggaccacctcaagaacacctccttccactaataattggactaaaatagatccattagtagtgcgtaagtaataatctgcggaagtgtctgctgaaagatggtactataatgttcagg

SEQ ID NO: 907 - DNA, 455 bp, Secale cereale
gccaagatgtcgacggtgacccgcgcctagctcgaccagaggctcgccgccgccaagcgctgctccagagaggctgccatggccggagccaaggccgcggccgtcgccaccgtcgcagccgcagtccccaccctggcgagcgtgaggatgctgccgtgggccaaggcacacctgaacccgaccgggcaggcgctcatcatctccaccgtcgccgggatggcctacttcatcgtcgccgacaagaccatcctctccatggcaaggaagcactccttcgaggacgcgccggaccacctcaaggacacctccttccactaattaggctataattgatccatcagtagtgcgtaataatctgtgtgcgccagcccgtacgtgtctgctgaaagatagtataaatgttcagcttcagcacctataggagatcagtgcagacagtgagtggtgtggtgtac

SEQ ID NO: 908 - DNA, 567 bp, Hordeum vulgare
acacacttcactgttactaaggagtcaggagtagttcacttccttccggtctcctgccaccaagctttgctccggcgaagatgctacggtgaccggcgcctacctcgaccagaggctcgccgcagcaaagcgctgctccagagaggctgccatggccggagccaaggccgcggccgtcgccaccgtcgccgccgcagtgcccaccctggcgagtgtgaggatgcttccgtgggccaaggcgcacctgaaccccgccggtcaggcgctcatcatctccaccgtcgccgggatggcctacttcatcgtcgccgacaagaccatcctctccatggccaggaagcattccttccaggacgcgccggagcacctcaagaacacctcattccactaattattgggctgtatgtacgtttttgctgaaagatactcacgtagtacgagtataatgttcagcgaggcgatgcagatcaggccttgcgcctctatccgtgcaggcacttgtctgatgaagtaatcataatgtattcagccagtaatcttgaattaataatgacttgcatctgttca

SEQ ID NO: 909 - DNA, 591 bp, Hordeum vulgare
gctgatacttcactgctactaccacttcacttcacttccttgggatctcgtgccaagatgtctacggtgacccgtgcctacctcgaccagaggctcgccgccgccaaccgctgctccagagaggcagccatggcgggagccaaggccgcggccgtcgccaccgtcgcagccgcagtccccacgctggcgagcgtgaggatgctgccgtgggcgagggcgcacctgaacccgactggccaggcactcatcatctccaccgtcgccgggatggcctacttcatcgtcgccgacaagaccatcctctccatggccaggaagcattccttccaggacgcgccggaccacctcaagaacacctcattccactagttagacctgcaataaactgcgcttctctgccaataaactgtacgcctctgccgaaagaaagcgtaaagttcagtgaaggaggcggtcaccatgcgaggcctgcagacagtgagtggtgtagtgcgcttctcttctctgtgtgcaaaacactttctatctgatgaagcaatcatcatgtatccacccagtaatcttgaattaataataacttgcatttgtaca

SEQ ID NO: 910 - DNA, 509 bp, Triticum aestivum
atgtcgaccgtgacccgtgcctacctcgaccagaggctcgcagccgccaagcgctgctcgaaagaggctgccatggcgggagctaaggccgcggccgtcgccaccgtcgctgccgcagtccccaccctcgcgagcgtgaggatgctgccgtgggcgaaggcgcacctcaacccaaccgggcaggcgctcatcatctccaccgtcgccgggatggcctacttcatcgtcgcagacaagaccatcctctccatggcaaggaagcactccttcgaggacgcgccggagcacctcaggaacacctccttccactaattagcctattgtagatccattagtatagtgcgtaataaaccgtgttctgctgaagcctgaaagatggtataatgttcagcgagagggtataattatctgatgatgtatgtaataatgtggccatgttctccatcttgtcatctttccagggatcgtgaaataataaccagctcttgtacaactttgcttcaagtcca

SEQ ID NO: 911 - DNA, 685 bp, Triticum aestivum
ctcacactgcttacttgacttcactacctagctcacttccttcggatctcgtgccaccaagctctcttccacggccacgaagatgtctacggtgaccggtgcccacctagaccagaggctcgccgccgccaagcgctgctccagagaggctgccatggcgggagccaaggccgcagccgtcgccaccgtcgctgccgcagtccccacactggcgagcgtgaggatgctgccgtgggccaagacgcacctgaaccccgccgggcaggcgctcatcatctccaccgtcgccgggatggcctacttcatcgtcgccgacaagaccatcctctccatggccaggaagcattccttcgaggacgcgccggaccacctcaagaacacctccttccactaattaggctatactttcaataattagtagtagtgcgcaataaactacacgccggcccgtacggccgtacgtgtctgctgaatgatactagtatgatgttcagcgagagaggcgaggcgatgcagatcaggcctcgcgcttctatccgtgcaagcacttatctcatgaagttaccatgtaatccagctagtattcttggataaatgaatactagtatttgtacaactctagttcatctgccatcactcatcttacatgtggcagagcataaaaaagaatctccgacgccgaccc

SEQ ID NO: 912 - DNA, 671 bp, Triticum aestivum
ttgacttcactacctagctcacttccttcggatctcgtgccaccaagctctcttccacggccacgaagatgtctacggtgaccggtgcccacctagaccagaggctcgccgccgccaagcgctgctccagagaggctgccatggcgggagccaaggccgcagccgtcgccaccgtcgctgccgcagtccccacactggcgagcgtgaggatgctgccgtgggccaagacgcacctgaaccccgccgggcaggcgctcatcatctccaccgtcgccgggatggcctacttcatcgtcgccgacaagaccatcctctccatggccaggaagcattccttcgaggacgcgccggaccacctcaagaacacctccttccactaattaggctatactttcaataattagtagtagtgcgcaataaactacacgccggcccgtacggccgtacgtgtctgctgaatgatactagtatgatgttcagcgagagaggcgaggcgatgcagatcaggcctcgcgcttctatccgtgcaagcacttatctcatgaagttaccatgtaatccagctagtattcttggataaatgaatactagtatttgtacaactctagttcatctgccatcactcatcttacatgtggcagagcataaaaaagaatctccgacgccgaccc

SEQ ID NO: 913 - DNA, 663 bp, Triticum aestivum
ctcacctcactcacactactactgatatcagctaggagtactcgagttcactagctaccagttcgcttccttccttcggcaccagactctctcccacgaagatgcctacggtgacccgtgcctacctcgaccagaggctcgccgccgccaaccgctgctccaaagaggctgccatggcgggagccaaggccgcggccgtcgccaccgtcgctgccgcagtccccactctggcgagcgtgaggatgctgccgtgggccaaggcgcacctgaaccccaccgggcaggcgctcatcatctccaccgtcgccgggatggcctacttcatcgtcgccgacaagaccatcctctccatggccaggaagcactccttcgacgacgcgccggaccacctcaagaacacctccttccactaattagagcagtagatcctgtagtataatgtctgctgaatccaccatgggtagtgcgcaataaacttcacgccgacccgtacggccgtacgtgtctgctgaatgatacagtagtataatgttcagcgagagaggcgaggcgatgcagatcaggccttgcgcttctatccgtgcaagcacttatcggatgatgaagttaccatgtaacccagccagtattttcttgaattaatgaataccagtatttgtacaa

SEQ ID NO: 914 - DNA, 609 bp, Secale cereale
tctcactcacagtcacactacaaccgctgatacttcattgctactagtaccatcggttcacttccttcggatctcttgccggccaagatgtctacggtgaccggcgcctacctcgaccagaggctcgctgccgccaaacgctgctccagagaagccgccatggccggagccaaggccgcggccgtcgccaccgtcgctgctgcagtacccacccttgcgagcgtgaggatgctgccgtgggccaaggctcacagtcaaccccaccgggcaggcgctcatcatctccaccgtcgccgggatggcctacttcatcgttgccgacaagaccatcctctccatggcaaggaagcactccttcgaggacgcgccggaccacctcaaggacacctccttccactaattaggctttaattgatccatcagtagtgggcaataatctgtgtgcgccagcccgtacgtgtctgctgaaagatagtataaatgttcagcacctatccgagatcagtgcagacagtgagtggtgtggtgtactgctcttctctgcgtgcaagcacttatctgatcaagtaatcatcatgtatcaagccaataatcttgaattaataataa

SEQ ID NO: 915 - DNA, 602 bp, Secale cereale
ctcacacagtcatcatactactactgctgaaagcctgaaacttcactgttactaccagctcactttcttcggatctcggccaagatgtcgacggtgacccgtgcctacctcgaccagaggctcgccgccgccaagcgctgctccaaagaggctgccatggccggagccaaggccgcggccgtcgccaccgtcgctgccgcagtacccaccctggcgagcgtgaggatgctgccgtgggccaaggcacacatcaacccaactggccaagcgctcatcatctccaccgtcgccggcatggcctacttcatcgtcgccgacaagacaatcctctccatggcaaggaagcactccttcgaggacgcgccggaccacctcaaggacacctccttccactaattaggctataattgatccatcagtatgggtaataatctgtgtgcaccagcccgtactgctgaaagatactagtataaatgttcagcacctatccgagatcagtgcagacagtgagtggtgtggtggactgcccttctctgcgtgcaagcacttatctgatcaagtaatcgtcatgtatccagccagtaatcttgaattaataataa

SEQ ID NO: 916 - DNA, 639 bp, Triticum aestivum
ctcatcttgcctcacacacttcactgctagctactagtaattcacttccttgggttctcgtgccaccgagctctctcccgccaagatgtcgacggtgacccctgcctacctcgaccagaggctcgccgccgccaagcgctcctccagagaggccgccatggcgggagccaaggccgcggccgtcgccaccgtcgccgccgcaatccccaccctggcgagcgtgaggatgctgccgtgggcgagggcgcacctcaacccaaccgggcaggcgctcatcatctccaccgtcgccgggatggcctacttcatcgtcgccgacaagaccatcctctccatggccaggaagcactccttcgacgacgcgccagagcacctcaagaacacctccttccactaattagactgtaataacagatccattagcagtgcgcgataagctgtgtgcgccagcccgtacgtgtctgctgaaagatggtgtgtaacgttcagcacttacccgaggcttgcagacagtcagtggtgtggtgtactgctcttctctgcgtgcaaggacttgtctgatcaagtaatcatcatgtatccagccagtaatcttgaactaataataacttgcatttgtacaactcagattcacctgcc

SEQ ID NO: 917 - DNA, 771 bp, Triticum aestivum
aaaccacggtcttgctggcttcccaccgtatcaggtcgtcttcctgcccggccgcacgctggttgagcggtttcctgcaacctataaatcccgccggatcacctcgctctgcccatctcatctcactcgcattcactcaactgatactactagctagtccacttccttcggatctcttgccaccaagctctgctcccgccaagatgtcgacggtgacccgcgcctacctcgaccagaggctcgccgccgccaagcgctgctccaaagaggctgccatggcgggagccaaggcggcggccgtcgccaccgtcgctgccgcagtgcccacactggcgagcgtgaggatgctgccgtgggcgaaggcgcacctgaacccgaccgggcaggccctcatcatctccaccgtcgccgggatggcctacttcatcgtcgccgacaagaccatcctctccatggccaggaagcactcgtacgagacggcgccagagcacctcaagaacacctccttcaactaaattagacagtagatccattagtagtgcgcaataaaccatgtacgcccgtcgccagtcggcctttagccctgtataatgttcaattgttcagtgaggtgcgatcaggcgaggcgatacctgcagcgcgaatggtggtgtactgctgttctctgcgagcaataactaattatgtgacagtgatgtatggaataatgtggccatgttctccatcttgtcatctttccagggatcgtgaattaataacaaccagtttttg

SEQ ID NO: 918 - DNA, 380 bp, Triticum aestivum
ctactagttcacttccttcggatctcgctcgtgcctccaagctctcttccacggcctagaagatgtcgacggtgacccctgcctacctcgaccagaggctcaccgccgccaagcgctgctccagagaggctgccatagcgggagccaaggccgcggccgtcgccaccgtcgctgccgcagtccccaccctggcgagcgttaggatgctgccgtgggcgaaggcgcacctgaaccccaccggacaggccctcatcatctccaccgtcgccgggatggcctacttcatcgtggccgacaagaccatcctctccatggccaggaagcactccttcctggacgcgccggaccacctcaagaacacctccttccactgattagac

SEQ ID NO: 919 - DNA, 611 bp, Triticum aestivum
gctactactaattcacttccttcggatcccgctcgtgccaccaagctctgctcccgctaagatgtcgacggtgacccgtgccaacctcgaccagaggctcgccgccgccaaccgctgctccagagaggctgccatggcgggagccaaggccgcggccgtcgccaccgtcgctgccgcagtacccacactggcgagcgtgaggatgctgccgtgggcgagggcgcacctcaaccccaccgggcaggcgctcatcatctccacggtcgccgggatggcctacttcatcgtcgccgacaagaccatcctctccatggccaggaggcactccttcgacgacgcgccagagcacctcaagaacacctccttccactaattagactataatagtagacacatataatgttctataatggtactataatgttcagcgagaggggcggtcaggcgaggtgatggtataattatctgatgatgtatgtatgtaataatgtggccatgttctttccagggatcttgtcatctttccagggatcgtgaattaataaccaccagtttttgtacaactttagttcaagtgcactcactcatctcacttatttctaaaaaaaaaa

SEQ ID NO: 920 - DNA, 853 bp, Triticum aestivum
gtgttctgccgcaccaaaaaaaccacggtcttgctggcttcccaccgtatcaggtcgtcttcctgcccggccgcacgctggttgagcggtttcctgcaacctataaatcccgccggatcacctcgctctgcccatctcatctcactcgcattcactcaactgatactactagctagtccacttccttcggatctcttgccaccaagctctgctcccgccaagatgtcgacggtgacccgcgcctacctcgaccagaggctcgccgccgccaagcgctgctccagagaggctgccatggcgggagccaaggcggcggccgtcgccaccgtcgctgccgcagtccccacactggcgagcgtgaggatgctgccgtgggcgagggcgcacctgaacccgaccgggcaggccctcatcatctccaccgtcgccgggatggcctacttcatcgtcgccgacaagaccatcctctccatggccaggaagcactcctacgaggacgcgccggagcacctcaagaacacctccttcaactaattagacagtagatccattagtagtgcgcaataaaccatgtacgcccgtcgccagtcggcctttagccctgtataatgttcaattgttcagtgaggtgcgatcaggcgaggcgatacctgcagcgcgaatggtggtgtactgctgttctctgcgagcaataactaattatgtgacagtgatgtatggaataatgtggccatgttctccatcttgtcatctttccagggatcgtgaattaataacaaccagtttttgtactacaactttggttcaagtgcactcactcatcgcacttatttattgtttgtgattaccaaag

SEQ ID NO: 921 - DNA, 581 bp, Triticum aestivum
ctactagttcacttccttcggatctcgctcgtgcctccaagctctcttccacggcctagaagatgtcgacggtgacccctgcctacctcgaccagaggctcaccgccgccaagcgctgctccagagaggctgccatagcgggagccaaggccgcggccgtcgccaccgtcgctgccgcagtccccaccataagtacccaggaagccattcagttccagagttcaaagcacgtctcatgaatgcgttacctgtaatttcagctggcgaggagaggcatttgggtgctctagctcatctcctatgcacacgaggtgttcgatgaaatgcccaagccacgctagttaagttttctcctttcgaagctcgacctccaaactccattttccctgagatttgtctaggtttagcagtccgtcacgttccgtccccgtctttaccgccatcgatcgcccgcgccgatctcgtcacctgcaccactttgtgagcctcttatcttcttctgaaagaaaacaattcttactttagatagacacttgtctaattttcttacttttattattgcttgcacttatataatgcga

SEQ ID NO: 922 - DNA, 589 bp, Festuca arundinacea
  misc_feature (398)..(398): n is a, c, g, or t
  misc_feature (402)..(403): n is a, c, g, or t
  misc_feature (406)..(407): n is a, c, g, or t
  misc_feature (418)..(418): n is a, c, g, or t
  misc_feature (436)..(436): n is a, c, g, or t
  misc_feature (453)..(453): n is a, c, g, or t
  misc_feature (466)..(466): n is a, c, g, or t
  misc_feature (470)..(470): n is a, c, g, or t
  misc_feature (479)..(479): n is a, c, g, or t
  misc_feature (489)..(490): n is a, c, g, or t
  misc_feature (494)..(494): n is a, c, g, or t
  misc_feature (504)..(505): n is a, c, g, or t
ggcacgaggacttagccagctttgtactcttcagcgacttcactgcagctacctcgcggccatgtctacggtgacccgcgcctacctcgaccagaggctcgccatggcaaagcgctgctccagagaggccgccatggcaggagccaaggccgcggccgtcgccaccgtcgcagccgcagtccccaccctggcgagcgtgaggatgctgccgtgggcgaaggcgcacctgaacccagccggccaggcgctcatcatctccaccgtcgccgggatggcatacttcatcgtcgccgacaagaccatcctgtccatggccaggaagcactcgtttgagggcgcgccggagcatctgaagaacacatccttccagtataggctctagatcaatatgaataagntgcnntannctgtgtgtacncacgtgtctgctgaaagntactataatgttcagcnacagaggcgaggngatncagtgcagntagtagtgtnntgtncttctcttcnngaggaaagcacttatctgatgatttaatcatgtatcttctgagccagaaatcttgaatcggtaactaggtactcctttttgtac

SEQ ID NO: 923 - DNA, 460 bp, Secale cereale
tcattgctactagtaccatcggttcacttccttcggatctcttgccggccaagatgtctacggtgaccggcgcctacctcgaccagaggctcgctgccgccaaacgctgctccagagaagccgccatggccggagccaaggccgcggccgtcgccaccgtcgctgccgcagtacccaccctggctagcgtgaggatgctgccgtgggcgagggcgcacctgaacccaactgggcaggcgctcatcatctcgaccgtcgccgggatggcctacttcatcgtcgccgacaagaccatcctctccatggccagaaagcactccttcgaggatgcgccggaccacctcaaggacacctccttgcactaattaggctttaattgatccatcagtagtgcgcaataatctgtgtgcaccagcccgtagtcgtctgctagaaagatagtataaatgttcagcactac

SEQ ID NO: 924 - DNA, 578 bp, Secale cereale
acagtcatactactactgctgaaacttaactgttactaccagctcacttccttcggatctcttgccggcgaagatgtctacggtgacccgcgcctacctcgaccagaggctcgccgccgccaagcgctgctccaaagaggccgccatggccggagccaaggccgcggccgtcgccaccgtcgcagctgcagtacccaccctggcgagcgtgaggatgctgccgtgggccaaggcacacatcaacccaactggccaagcgctcatcatctccaccgtcgccgggatggcctacttcatcgttgccgacaagaccatcctctccatggcaaggaagaactccttcgaggacgcgccggaccatctcaaggacacctccttccactaattaggctttaattgttccatcagtagtgcgcaataatctgtgtgcgccagcccgtactgctgaaagatatagtataaatgttcagcacctatccgagatcagtgcagacagtgagtggtgtggtgtactgctcttctctgcgtgcaagcacttatctgatcaagtaatcatcatgtatccaaccaataatctt

SEQ ID NO: 925 - DNA, 721 bp, Triticum aestivum
cactgctgctcatacttcactgctagtactaccgtggcaccaagctctctcccgccaagatgtcgacggtcacccgcgcctacctcgaccagaggctcgccctcgccaaccgctgctccagagaggctgccatggccggagccaaggccgctgccgtcgccaccgtcgctgccgcagtccccaccctggcaagcgtgaggatgctgccgtgggcgagggcgcacctcaacccgaccgggcaggcgctcatcatctccaccatcgccgggatggcctacttcatcgtcgccgacaagaccatcctatccatggccaggaagcactccttcgacgacgcgccggaccacctcaagaacacctccttcaactaattagactacaatagtagatccattagtagtgcgcagcgacggcctgaaagatagtataatgttcagcacctatctgatatcaggccaagttcgcagacagtgagtggtgtagtactgcgcttctctgccgctctgcgtgcaagcacttgtctgatgatgtatccagccagtaatcttgaattaataataacctgcatctgtacaaaaaaaaaaggggggccggtaccaactcgcctatatgagtctattcgcggccactggcgtcgtttaaacgtctcgccggaaacctgcgtaccaattaacccttgagcaatccccttccaaccggggcatacgaaaggcccacgttg

SEQ ID NO: 926 - DNA, 578 bp, Triticum aestivum
cactgtcacactgtctcactactactgctgatacttcactgctactaccagttcacttccttgggatctcggccaacatgtcgacggtgacccgcgcctacctcgaccagaggctcgccgccgccaaccgctgctccagagaggctgccatggccggagccaaggccgcggcagtcgccgccgtcgctgccgcagtccccaccctagcgagcgtgaggatgctgccgtgggcgagggcgcacctcaacccgaccgggcaggcgctcatcatctccaccgtcgccgggatggcctacttcatcgtcgccgacaagaccatcctctccatggccagaaagcactccttcgaggacgcgccggaccacctcaagaacacctccttcaactaattaggctataatctgcacgccggcctggaagtattataatgttcagcacttattcgagatcaggcgagccttgcagacagtcagtggtgtagtattgcgcttcgctgcgtgcaacttatctgatgaagtaatcatcatgtatccagccagtaatcttgaattaataatgacttgtatttgtacaactca

SEQ ID NO: 927 - DNA, 568 bp, Triticum aestivum
cactgtcacactgtctcactactactgctgatacttcactgctactaccagttcacttccttgggatctcggccaacatgtcgacggtgacccgcgcctacctcgaccagaggctcgccgccgccaaccgctgctccagagaggctgccatggccggagccaaggccgcggcagtcgccgccgtcgctgccgcagtccccaccctagcgagcgtgaggatgctgccgtgggcgagggcgcacctcaacccgaccgggcaggcgctcatcatctccaccgtcgccgggatggcctacttcatcgtcgccgacaagaccatcctctccatggccagaaagcactccttcgaggacgcgccggaccacctcaagaacacctccttcaactaattaggctataatctgcacgccggcctggaagtattataatgttcagcacttattcgagatcaggcgagccttgcagacagtcagtggtgtagtattgcgcttcgctgcgtgcaacttatctgatgaagtaatcatcatgtatccagccagtaatcttgaattaataatgacttgtattt

SEQ ID NO: 928 - DNA, 515 bp, Lolium multiflorum
cttagcgacttagccagctttgtactcttcagcgacttcactgcagctacctcgcggccatgtctacggtgacccgcgcctacctcgaccagaggctcgccatggcaaagcgctgctccagagaggccgccatggcaggagccaaggccgcggccgtcgccaccgtcgcagccgcagtccccaccctggcgagcgtgaggatgctgccgtgggcgaaggcgcacctgaacccagccggccaggcgctcatcatctccaccgtcgccgggatggcatacttcatcgtcgccgacaaggccatcctgtccatggccaggaagcactcgtttgagggcgcgccggagcatctgaagaacacatccttccagtataggctctagatcaataagtttgcaataagctgcgtgtacgccgtccgcctgtacgcacgtgtctgatgaaagatggtactataatgttcagcgacagaggcgaggtgatacagtgcagatagtagtgttttgtccttctcttcc

SEQ ID NO: 929 - DNA, 575 bp, Triticum aestivum
cacacaccactactcatcttacctgacgcagttcactgctagccaattcacttctcgtaccaccaacctccctcgccaagatgtcgacggtgacccgcgcctacctcgaccagaggctcgccgccgccaagcgctgctccaaagaagctaccatggcgggagccaaggccgcggccgtcgccaccgtcgctgccgcagtccccacactggcgagcgtgaggatgctgccgtgggccaaggcgcacctgaaccccaccgggcaggccctcatcatctccactgtcgctgggatggcctacttcatcgtcgccgacaagaccatcctctccatggccatggccaggaggcactccttcgaggacgcgccggagcacctcaagaacacctccttccactagttagatccattattagtaatgcccaatgaaccgtgtatgccaaagtgcatagcgtacagtgatcagcaaagggaggtcataatataattttcatcatgcaagtagccatgtacagcatcttttgagctagcaatactgaaagatgtaccagcatttgttaaccaatattttccagct

SEQ ID NO: 930 - DNA, 416 bp, Hordeum vulgare
tcactcacacagtccactgctgctgatacttcactgctactaccactaccagttcacttcacttccttgggatctcgtgccaagatgtctacggtgacccgcgcctacctcgaccagaggctcgccgccgccgaccgctgctccagagaggcagccatggcgggagccaaggccgcggccgtcgccaccgtcgcagccgcagtccccacgctggcgagcgtgaggatgctgccgtgggcgagggcgcacctgaacccgactggccaggcactcatcatttccaccgtcgccgggatggcctacttcatcgtcgccgataaggccatcctctccatggccaggaagcattccttcgaggacgcgccggaccacctcaagaacacctccttgtagatgttaatcatgttgctcatgta

SEQ ID NO: 931 - DNA, 584 bp, Secale cereale
actactactgctgaaacttcactgctactaccagctcacttccttcggatctcttgccggccaagatgtgtacggtgacccgcgcctacctcgaccagaggctcgccgccgccaagcgctgctccaaagaagccgccatggccggagccaaggccgcggccgtcgccaccgttgctaccgcagtacccaccctggcgagcgtgaggatgctgccgtgggccaaggcacacatcaacccaactggccaagcgctcatcatctccacggtcgccgggatggcttacttcatcgttgccgataagacaatcctctccatggcaaggaagcactccttcgaggacgcgccggaccacctcaaggacacctccttccactaattaggctataattgatccatcagtagtgggtaataatctgtgtgcaccagcccgtactgctgaaagatactagtataaatgttcagcacctatccgagatcagtgcagacagtgagtggtgtggtggactgcccttctctgcgtgcaagcacttatctgatcaagtaatcatcatgtatccagccagtaatcttgaattaataataa

SEQ ID NO: 932 - DNA, 597 bp, Secale cereale
gtcacactactacccctgatacttcattgctactagtaccaccggttcacttccttcggatctcttgccggcgaagatgtctaccgtgacccgcgcgtacctcgaccagaggctcgccgccgccaagcgctgctccaaagaggccgccatggccggagccaaggcagcggccgtcgccaccgtcacagccgcagtacccacccttgcgagcgtgaggatgctgccgtgggccaaggctcacagtcaacccaccgggcaggcgctcatcatctccaccgtcgccgggatggcctacttcatcgttgccgacaagaccatcctctccatggctagaaagcactccttcgaggatgcgccggaccacctcaaggacacctccttccactaattaggctttaattgttccatcagtagtgcgcaataatctgtgtgcgccagcccgtacgtgtctgctgaaagatagtataaatgttcagcacctatccgagatcagtgcagacagtgagtggtgtggtgtactgcccttctctgcgtgcaagcacttatctgatcaagtaatcatcatgtatccagccagtaatcttgaattaataataa

SEQ ID NO: 933 - DNA, 584 bp, Secale cereale
tcactactactgctgatacttcactgctactaccagctcacttccttcggatctcttgccggccaagatgtcgacggtgaccggtgcttatcttgaccagaggctcgccgccaccaaacgctgctccagagaggctgccatggcaggagccaaggccgcggccgtcgccaccgtcgcagccgcagtgcccaccctgacaagcgtgaggatgcttccatgggcgagggcgcacctgaacccaaccgggcaggcgctcatcatctccaccgtcgccgggatggcctacttcatcgtcgccgacaagacaatcctctccatggcaaggaagcactccttcgaggacgcgccggaccacctcaaggacacctccttccactaattaggctttaattgatccatcagtagtgcgcaataatctgtgtgcgccagcccgtccgtgtctgctgatagatagtatactgttcttctctgcgagatcagtgcagacagtgagtggtgtggtgtactgttcttctctgcgtgcaagcacttatctcatcaagtaatcatcatgtatccagccaataatcttaaattaataataa

SEQ ID NO: 934 - DNA, 716 bp, Triticum aestivum
ctcacctcactcacactactactgatatcagctaggagtactcgagttcactagctaccagttcgcttccttccttcggcaccagactctctcccacgaagatgcctacggtgacccgtgcctacctcgaccagaggctcgccgtcgccaaccgctgctccaaagaggctgccatggctggagccaaggccgcggccgtcgccaccgtcgctgccgcagtccccactctggcgagcgcgaggatgctgccgtgggcgagagcgcacctgaaccccaccgggcaggccctcatcatctccaccgtcgccgggatggcctacttcatcgtggccgacaagaccatcctctccatggccaggaagcactccttccagaacgcgccggaccacctcaagaacacctccttccactgattaggcagtagatcctgtagtataatgtctgctgaatccaccatgggtagtgcgcaataaacttcacgccgacccgtacggccgtacgtgtctgctgaatgatacagtagtataatgttcagcgagagaggcgaggcgatgcagatcaggccttgcgcttctatccgtgcaagcacttatcggatgatgaagttaccatgtaacccagccagtattttcttgaattaatgaataccagtatttgtacaattctggttcatctgccatcactactcatcttacatgtgccagagcatgcaaaaa

SEQ ID NO: 935 - DNA, 614 bp, Triticum aestivum
gctgacacttcactgtactaccggttcatttccttgcgatctcgcgccaccaagctctgctcctgcgaagatgtgtaccgtaacccgagcccacctcgaccaaaggctcgccgccgccaagcgctgctccagagaggcagccattgcgggagccaaggcggccgccgtcgccaccgttgcaaccgcagtccccaccctggcgagcgtgaggatgctgccgtgggcgagggcgcacctcaaccccaccgggcaggcgctcatcatctccaccgtcgccgggatggcctacttcatcgtcgccgacaagaccatcgtatcaatggccaggaagcactcctacgaggacgcgccggagcacctcaagaacacctccttccactaattagactgtaatagacccattagtagcagtgtgcaataaactgcatgccggcctgcacgtgtctgctgaaggatactagcactagtataatgttcagcaattatctgagatcaggctaggcttgcagacagtgagtggtgtagtgtactggtcttctctgcgtgcaattagcacttatctgatcaagtaatcatcatgtatccagccagtgatcttgaattaataataactt

SEQ ID NO: 936 - DNA, 879 bp, Triticum aestivum
ccacgcgtccgacatgctcctacgtctacgtgttatcctacgcaggaacacgctccccgccaaccccgatggatcgatgatccatgcctcctcttatccgctgcagggacctgtgctctgccgcacccgcaccgaccgccggtaccaaaaccaaaccacggtattgcttgcttcccaccgtatcaggtcgtcttcctgcccggccgcacgctggttgcgcggtttcctgcaacctataaatccggccggatcaccttgctctgcccatctcatctcactcacatccacgctccacttatacactagctacttcgcttccttcggatctcgtgtcaccaatatctccggcgaagatgtcgacggtgacccgtgcctacctcgaccagaggctcgccgccgccaagcgctgctccaaagaggctgctatggcgggagtcaaggccgcggcggtcgccaccgtcgctgccgcagtgcccaccctggcgagcgtgaggatgctgccgtgggtgagggcgcacctgaaccccacaggacaggcgctcatcatctccacggtcgccgggatggcctacttcatcgtcgccgacaagaccatcctctccatggccaggaagcactcgcacgagatggcgccagagcacctgaagaacacctccttccactaattagcctatagtagatccattattagtatagtgtgtaataaaccgtgtctgctgaagcctgaaagatggtataatgttgagcgagaggggcgatcaggcgaggtgatggtataattaactgatgatgtatgtaataatgtggtcatgttctccatcttgtcatctttccagggatcgtgaattaataaccagctcttgtacaactttgcttcaa

SEQ ID NO: 937 - DNA, 450 bp, Triticum aestivum
aagatgtcgacggtgacccgcgcctacctcgaccagaggctcgctgccgccaaccgctgctccagagaggctgccatggccggagccaaggccgcggccgtcgcctccgtcgcggccgcagtacccaccctggcaagcgtgaggatgctgccgtgggcgagggcgcacctcaacccgactgggcaggcgctcatcatctccaccgtcgccgggatggcctacttcatcgtcgcggacaagaccatcctgtccatggccaggaagcactccttcgaggacgcgctggaccacctcaagaacacctccttcaactaattagcctataatagatccattagtagtactgtaatgttcaggcagcacttatgtggtatcaggggaggcttgcagacagccagtggtgtagtagtgcgcttctctgcgcgcaagaacttatctgatgaagtgatc

SEQ ID NO: 938 - DNA, 654 bp, Triticum aestivum
ctcacacactactactacggatctcagccaggagtactcgagttcactagctagctactagttcacttccttcggcaccaagctctctccggcgaagatgtccacggtgacccgctcctacctcgaccagaggctcgccgccgcccagcgctgctccaaagaggctgccatggcgggagccaaggccgcggccgtcgccaccgtcgctgccgcagtccccaccctggcgagcgtgaggatgctgccgtgggcgagggcgcacctcaaccccaccgggcaggcgctcatcatctccaccgtcgccgggatggcctacttcatcgtcgccgacaagaccatcctctccatggccaggaagcactcgtacgagacggcgccagagcacctcaagaacacatccttccactaattagacacttgattagccagtgccaataaagtgtgtacgcaggcccgtacgtgtcttctgaaacatatagtagtataatgttgagcgaggcgatggttgctgtgcggaaaggtggtgtataacccttttctgcgagcaagcactaattatctgatgatttatgatgtagtactccataataatgtggccatgttccccatcgtactagtatctttccaaaggtcatgaatcaataacaaccatag

SEQ ID NO: 939 - DNA, 502 bp, Triticum aestivum
ttcactagctagctacaagttcacttccttcgtcaccaagctctctccggcgaagatgtcgacggtgacccgcgcctacctcgatcagaggctcgccgccgccaaccgctgctccaaagaggctgccatggccggagccaaggccgcggccgtcgcctccgtcgcggccgcagtgcccaccctggcgagcgtgaggatgcttccgtgggcgagggcgcacctgaacccaaccgggcaggccctcatcatctccaccgtcgccgggatggcctacttcatcgtggccgataagaccatcctctccatggcaaggaagcactccttcgaggacgcgccggaccacctcaagaacacctccttcaactaatcagcctataatagatctattagtagtactgtaatgttcaggcagcacttatgtgatatcaggcgaggcttgcagacaggcagtggtgtagtaccgcgcttctctgcgcgcaagaacttatctgatgaagtgatc

SEQ ID NO: 940 - DNA, 387 bp, Secale cereale
acaccgctactcatctcgcctcacacacttcactgttagcaagttcacttctcctaccaccaacctccctcaccaacatgtctacggtcacccttgcctacctcgaccagaggctcgccgtggccaagcgatgctccagagaggctgccatggcgggagccaaggccgcagccgtcgccaccgtcgctgccgtagtccccaccctggcaagcgtgaggatgcttccatgggcgagggcgcacctgaacccaactgggcaggcgctcatcatctccaccgtcgccgggatggcctacttcatcgtggccgacaagaccatcgtctccatgaccagaagcacgcctttgaggacgcgccggaccacctcaagaacacctccttccacta

SEQ ID NO: 941 - DNA, 520 bp, Secale cereale
acttcactgctagcaagttcacttgtcgtaccaccaacctccctcaccaacatgtctacggtgacccgtgcctacctcgaccagaggctcgccgtcgccaagcgctgctccagagaggcagccatggcgggagccaaggccgcggccgtcgccaccgtcgcagccgcagtccccaccctggcaatcgtgaggatgcttccatgggcgagggcgcacctgaacccaaccgggcaggcgctcatcatttccaccgtcgccgggatggcctacttcatcgtcgccgacaagaccatcctctccatggccagaaagcactcattcgacgacgcgccggaccaccttaagaacacctccttccactattggacacttgattagccagtgcctaataaactgtgtactcaggcccttacgtgtcttctgaaacatagtagtataatgttcagcaacacagggtcagcaggcaaggcgaggttgcagtgcggaaaggtggtatgcatcccaagaacacctccttcca

SEQ ID NO: 942 - DNA, 543 bp, Triticum aestivum
ctcatcttgcctcacacacttcactgctagctactagttcatttgcttgcgttctcgtgccaccaacctcgatcgccaagatgtctacggtgagctgcgcctacctcgaccagaggctcgctgccgccaaccgctgctccgaagaggctgccatggccggagccaaggccgcggctgtcgccaccatcgccgccgcagtccccaccgcaactggcgagcgtgaggatgctgccgtgggcgagggcgcacctgaacccgaccgggcaggccctgatcatctccaccgtcgccgggatggcctacttcatcgtcgctgacaagaccatcctctccatggccaggaagcactccttccaggatgcgccggagcacctcaagaacacctccttccactagttagatccattattagtaatcccagtaaaccttgtgcgccaaagtgcatagcgtacagtgatcagcaagggaggtcagggatgctcctggatagtcttgtactgcgagtgcaatttctcatttcataatataattttcatcatgcaa

SEQ ID NO: 943 - DNA, 653 bp, Brachypodium distachyon
ccaactcatctcatctcactctcactctcactgctcatctcacttactagcttgccacacttcactacaagcgacacacacctcatcgatcacatctcgacatgtctaccaccgtgagccgcgcctacctcgaccagaggctcgccgccgcaaagcgctgctccaaagaggctgcaatggcgggcgccaaggccgctgccgtcgccaccgtcgccgccgctgtccccaccctggcgagcgtgaggatgctgccgtgggcgagggcgcacctgaacccgacggggcaggcgctcatcatctccaccgttgccgggatggcatacttcatcgtcgccgataagaccatcctctccatggccaggaagcactccttcgaggaagctcccgagcacctcaaggacacctccttcaagagcgccggcgcgccgcccgccagcacccgcccttgggccttcttcaggcactgatcaattcaccggtctatccaactctctagatctcatcaacccggcgtgcgattccatcagatgtatggcttcagaaagcgatgtgagctagtatcatcatcaattcgtgcgtatgtataatgtgtgccatgccatgcatttcctcgagctgaaataaagaccaataaagtgtgggtgtgacatttg

SEQ ID NO: 944 - DNA, 774 bp, Brachypodium distachyon
ctgccccaactcatctcatctcactctcactctcactgctcatctcacttactagcttgccacacttcactacaagcgacacacacctcatcgatcacatctcgacatgtctaccaccgtgagccgcgcctacctcgaccagaggctcgccgccgcaaagcgctgctccaaagaggctgcaatggcgggcgccaaggccgctgccgtcgccaccgtcgccgccgctgtccccaccctggcgagcgtgaggatgctgccgtgggcgagggcgcacctgaacccgacggggcaggcgctcatcatctccaccgttgccgggatggcatacttcatcgtcgccgataagaccatcctctccatggccaggaagcactccttcgaggaagctcccgagcacctcaaggacacctccttcaagagcgccggcgcgccgcccgccagcacccgcccttgggccttcttcaggcactgatcaattcaccggtctatccaactctctagatctcatcaacccggcgtgcgattccatcagatgtatggcttcagaaagcgatgtgagctagtatcatcatcaattcgtgcgtatgtataatgtgtgccatgccatgcatttcctcgagctgaaataaagaccaataaagtgtgggtgtgacatttgcgaagttgcaaacacttcttcgtctatagcacatgttcaggagcagtttatttccgatagaatggcaaacttgtttcccaaaatgaaaaccaaaccaacagccgttcatagaagca

SEQ ID NO: 945 - DNA, 509 bp, Leymus cinereus x Leymus triticoides
gcacgaggcacactactaactgatctcagctacttgacttccctaagctactactcccacgaaaatgtctacggtgacccgcgcctacctcgaccagaggctcgccgccgccaagcgctgctctagagaaatgcagaggctgccatggcaggagccaaggccgcggtcgtcgccaccgtcgcagccgcagtccccaccctggcgagcgtgaggatgctgccgtgggcaaaggcgcacctgaacccgactggccaggcgctcatcatctccaccgtcgccgggatggcctacttcatcgtcgccgacaagaccatcctctccatggccaggaagcactccttccaggacgcgccagagcacctcaagaataccgtcgccgacaagacggtatgagaagcgagtcgatgcttatgcacttctctgcgcgcaagcaaatatctgattatgtaatgatgttgccgtgtatgttactatctttccggggatcctgaattaacaacaactagttt

SEQ ID NO: 946 - DNA, 513 bp, Triticum aestivum
caccactactcatcttgcctcacacacttcactgctagctactagttcatttgcttgcgttctcgtgccaccaacctcgatcgccaagatgtctacggtgagctgcgcctacctcgaccagaggctcgctgccgccaaccgctgctccgaagaggctgccatggccggagccaaggccgcggctgtcgccaccatcgccgccgcagtccccaccgcaactggcgagcgtgaggatgctgccatgggagagggcgcacctgaacccgaccgggcaggcgctcatcatctccaccgtcgccgggatggcctacttcatcatcgccgacaagaccatcctcttaatggccaggaagcactccttcgaggacgcgccagaccacctcaagaacacctccttccactagttagatccattattagtaatcccagtaaaccttgtgcgccaaagtgcatagcgtacagtgatcagcaagggaggtcagggatgctcctggatagtcttgtactgcgagt

SEQ ID NO: 947 - DNA, 487 bp, Secale cereale
ctcgctcgcgccaccaagctctactcccgccaagatgtcgacggtgccccctgcctaccacgaccagaagctcgccgcggccaagcgctgcgccagagaggctgccctggcgggagccaaggccgcggccatcgccgccgtcgctgccgcagtacccaccctgctgagcgtgaggatgctgccgtgggcaaaggcacacatcaaccaactggccaggcgctcatcatctcgaccgtcgccgggatggcctacttcatcgtagctgacaagaccatcgtctccatggccaggaagcactccttcgagaacgcgccggagcacctcaaggacacctccttcaaataagtagcctatactactagatccattagtagtgcgtaataaaccatgtacgccggccgtcggcccgggccgtcttgtaccgtgtctgctgaagcctgaaagacggtacaatgcttgcagtgcgcttctctgcaagcaagcacta

SEQ ID NO: 948 - DNA, 785 bp, Pennisetum glaucum
ctctggtcgaggtaggcacgggtcaccgtcgacatgacgatcgagtctgggcctctgggggatcgatctaactctcacttccactagtacaacccgagtggtagccgacaaatccttctccaaacaccagcgatctgcatgcgcgtctgatcgaacccccagaggcccagactcgatcgtcatgtcgacggtgacccgtgcctacctcgaccagaggctcgccgtggccaagcgctgctccagagaggccacgctcgccggagccaaggcggccgccgtcgccacagtcgcatctgcagtcccgacgctggcgagcgtgcggatgctgccgtgggcgaaggccaacctgaacccgaccggccaggcgctcatcatctgcacggtggccgggatggcctacttcgtcgccgccgacaagaagatcctctcgctggcgaggcgccactccttcgaggaggcgccggagcacctcaagaacacgtcctaccagggggccgcccgcccgcacccggcattcttcagcccttgatcgtcgttgaacaacatcttggtcgctagttcgctactgatgtatgtggcatcgatgcccggctcgatcttctcgatcagacaaaaaacgtgtaacagtacttgggccattgtaatgtaaaactaccttccaaacaataagcatagtcaagtatttgtgtttcactgtttctgaaccctgaactctcttggcgatgaactgaaaagccaacatcctggcatctcatcccagcagcataaacatttttcaaagttag

SEQ ID NO: 949 - DNA, 941 bp, Oryza sativa
gcactatgcagtgtgcaggttggccaccaacttccaaacgagtaaaactccggaagcagaggtccattgaacctacccggctcgtgggtttctgcacaaaaccgtggccgcgcgccaccaagttcatcccatccactcctcgatctcctcgtacgcctataaaatcatacggcttcttgctctcttggcaatgcaagccaactgaacgaactcaagaacagattcaaacaattgtagctgattcctctctgcttctcgttgttcttggttggttgttgttgtagaagaagaagaagaagaagatgtcgacggtgactcgtgcctacttggatcagaagctcgcactcgccaagcgctgctccagagaggcgacgctcgccggagccaaggctgcggcggtggcgacggtggcatccgccgtcccaacgttggcgagcgtgaggatgctgccatgggcgaaggccaacatcaacccgacgggtcaggcgctgatcatctgcacggcggctgggatggcatacttcgtcgccgccgacaagaagatcctctcgctggcgaggaagcactcgttcgagggcgcaccggagcacctcaagaacacctccttccagggcaccggccgccctcacccagccttcttcaggccatgaggaacactgaactttcacagtgactgatggaagcctggataaactgctactgctgctgagttcatgcgtaatggttctataagttgtgatgtaattagttttgttgttgttgatgatgaaaatgaaatcaatgagaactagtactttgtttttttaccctgttctgaacttcatctgaaaactcgttgatgtcttcaccttcttcaaaacagttgatgaacacttatcccctagctagttagttggtgtgaaatttgaagccaaagctataattaaaaagattttcagata

SEQ ID NO: 950 - DNA, 301 bp, Secale cereale
gaccagaggctcgccgccgccgaacgctgctccagagaggctgccatggcgggagccaaggccgcagccgtcgccaccgtcgcagccgcagtgcccaccctggcaagcgtgaggatgcttccatgggcgagggcgcacctgaacccagccgggcaggcactcatcatctccaccgtcgccgggatggcctacttcatcgtcgccgacaagaccatactcgccatggccaggagcattcgtcgacgacgcgccggaccacctcaagaacacctcctcactaattaggctataattgatccat

SEQ ID NO: 951 - DNA, 709 bp, Oryza sativa
tcggcgatgcaagccaactgaacccactctcaagaacagatacagattcagactggtgtttctgctagactgctactgcaagtgttggtagctagatcctctctctgcttgtcgttgttgttgtagaagaagaagctgatgtcgacggtgactcgtgcctacctcgaccagaagctcgccctcgcaaaacgctgctccagagaggcgacgctcgccggagccaaggcggcggcggtggcgacggtggcatccgccgtcccgacgctggcgagcgtgaggatgctgccgtgggcgaaggccaacatcaacccgacgggacaggcgctgatcatctgcacggcggccgggatggcatacttcgtcgccgccgacaagaagatcctctcgctggcgaggaggcactccttcgagaacgcacctgaacacctcaagaacacctccttccagggcaccggccaccctcaccctgccttcttcaggccatgaggaacactgaacttcacagtgactgatggaagcctggataaaccgctactactacaatatggctgtgcttgctgtgtaatggttctataagttgtaatgtaattaattagttttgatgatgaagatgatgatgatgaaatcagtgagaactagtaccttgttttttttttcactccgttctgaacttcctctgaaatttccttgctgtcttgtctgcccttta

SEQ ID NO: 952 - DNA, 644 bp, Oryza sativa
atggcgacgcccacaaaacaggagcggccatcgatgacgttcagccgaccggcggcctacggtttttcagaccggccggcgatcgatcttgctctttcagaaaatgcagaggccaaatctcataagaagaagaagaagaagatgtcgacggtgactcgtgcctacttggatcagaagctcgcactcgccaagcgctgctccagagaggcgacgctcgccggagccaaggctgcggcggtggcgacggtggcatccgccgtcccaacgttggcgagcgtgaggatgctgccatgggcgaaggccaacatcaacccgacgggtcaggcgctgatcatctgcacggcggctgggatggcatacttcgtcgccgccgacaagaagatcctctcgctggcgaggaagcactcgttcgagggcgcaccggagcacctcaagaacacctccttccagggcaccggccgccctcacccagccttcttcaggccatgaggaacactgaactttcacagtgactgatggaagcctggataaactgctactgctgctgagttcatgcgtaatggttctataagttgtgatgtaattagttttgttgttgttgatgatgaaaatgaaatcaatgagaactagtactttgttttttt

SEQ ID NO: 953 - DNA, 830 bp, Sorghum bicolor
gaaaccagccgtgctctgctcacttctctgtagtctctctctctctctctctctctctgagcccagtgctgcgcatcagactctcacgagcctcacgaacaggatcaagaaaccaccaccatgtcgacggtgagccgtgcgtccctcgaccagaagcttgccctcgccaaacgctgctcccgagaggcgaccatggcagggtttaaggcagcagctgtagcaaccgtcgcctctgcagttcccaccctggcgagcgtgaggatgctgccatgggcgaaggccaacatcaaccccaccggacaggcactcatcatctccacggttgccgggatggcctacttcatcgccgccgacaagaagatcctgtcgctggcgagacggcactcgttcgagaacgcaccggagcacctcaagaacacctcttaccagggcaccggcaggccacacccggccttcttcaggccttgattgaggataaacaaagcaaaccatgcaagattatttgttctactgttgtatgtgtagtaatccagctatttcatgcaataatcaggcccctgcaatgcagaccagcaggtaggtagcttgctctgcgagctaattagcatagcttagcttctgtattatctgccgtagggtggttgcagtctgcggtgaacatgcatggattatatccatgctgtgtagtgtgtactagctatagctacatactattgtctgtaacatcttttatcgccatcaaggaaaatatgaaatactagcccttattggcatggtgtactttgtgcatatgcttcataaaactcaatcgaataaaatgaaatcagttg

SEQ ID NO: 954 - DNA, 963 bp, Sorghum bicolor
gttccatctccctcctcgcccaccggccaccgccgatcgtttgccatccgcgccccctgctgccgatgcggcgaatcagctgcggccggcctactataaatccatggcctcccctgccctcttccagaaaccagccgtgctctgctcacttctctgtagtctctctctctctctctctctctctgagcccagtgctgcgcatcagactctcacgagcctcacgaacaggatcaagaaaccaccaccatgtcgacggtgagccgtgcgtccctcgaccagaagcttgccctcgccaaacgctgctcccgagaggcgaccatggcagggtttaaggcagcagctgtagcaaccgtcgcctctgcagttcccaccctggcgagcgtgaggatgctgccatgggcgaaggccaacatcaaccccaccggacaggcactcatcatctccacggttgccgggatggcctacttcatcgccgccgacaagaagatcctgtcgctggcgagacggcactcgttcgagaacgcaccggagcacctcaagaacacctcttaccagggcaccggcaggccacacccggccttcttcaggccttgattgaggataaacaaagcaaaccatgcaagattatttgttctactgttgtatgtgtagtaatccagctatttcatgcaataatcaggcccctgcaatgcagaccagcaggtaggtagcttgctctgcgagctaattagcatagcttagcttctgtattatctgccgtagggtggttgcagtctgcggtgaacatgcatggattatatccatgctgtgtagtgtgtactagctatagctacatactattgtctgtaacatcttttatcgccatcaaggaaaatatgaaatactagcccttattggcatggtgtactttgtgcatatgcttcataaaactcaatcgaataaaatgaaatcagttgaaaaaaa

SEQ ID NO: 955 - DNA, 866 bp, Saccharum officinarum
gtcgacccacgcgtccgcgctttcgcccaaaaccaaaaccaggttcttggccgccgcttctccccggccggcgcccgcagtccgctgatccttccaggctactagctcctataaattctcagtctcccctccagagccctgcaagtcgcaacccactgccgcttcgttcaatcgtacgttcttctgtagccctttagccaacttctcctagcagcgcagtctgtaactgcaatcgcatagcatagtcgcgactcggaagaagacgaccatgtcgacggtgagccgtgcatcactcgaccagaagctcgccctcgccaagcgatgctcgcgagaggcgaccctcgcagggtttaaggcagcagctgtggcgaccgtcgcctctgcagttcccaccctggcgagcgtgaggatgctgccatgggcgaaggccaacatcaaccccaccggacaggctctcatcatctccacagttgctgggatggcctacttcatcgccgctgacaagaagatcctctcgatggcgaggaagcactcgtttgagggcgcaccagagcacctcaagaacacctcctaccagggcaccggcaggccgcacccggctttcttcaggccttgatccacctcagcatcttgatcgtcgatcgataaaactgtggagaggagtgaagttgatgtctcgtcgaataaactactgctacaagtagtcaacagcaactagaaaaacaatgcgttcacagcctcaaaaaaactgtaactagcttgtactccgatccattatataagcagagtaaagcgctgttttttgtgttcctcaaacaatgaacttgtttgattgtgggaaggggcccaccacacccatatatctg

SEQ ID NO: 956 - DNA, 599 bp, Setaria italica
atctcatctcactctcacttccaccagtacaacccgagtagccgacagatccttcaccaatcaccagcgatctgcctgcacgtctgaatccccagactcgccatgtcgacggtgacccgtgcctacctcgaccagaggctcgccatggccaagcgctgctccagagaggcgacgctcgccggagccaaggcggcggccgtcgccaccgtcgcatctgcagtcccaacgctggcgagcgtgcggatgctgccgtgggcgaaggcaaacctgaacccgaccggccaggctctcatcatctgcacggtggccgggatggcctacttcgtcgccaccgacaagaagatcctctcgctggcgaggcgccactccttcgaggaagcgcccgagcacctcaggaacacgtcctaccagggggccgcccgcccgcacccggcattctttaggccttgatcgttgagcaacatcttgatcgctagtgatgtggccccggctcaaatcttctcagacaaagtgtgtaacagtacttgggccattgtaatgtaactacctccaaataataagcatagtgaaatattttgtgtttctgaaccctgaacttg

SEQ ID NO: 957 - DNA, 752 bp, Sorghum bicolor
tgcattgcaacccatccggccatctctgaacacgtactccagtctgctttctgttcctaacgagtagtatcttgttcttcaattcacgaacaaaagtgatcagcatgtcgacggtgagccgcgcgtccctggaccagaagcttgccctcgccaagcgctgctcccgagaggcgaccctcgcaggagccaaggcagcagctgtagcaaccgtcgcctccgcgattcccactctggcgagcgtgaggatgctgccatgggcgaaggccaacatcaaccccaccggccaggcactcatcatctccacagttgccgggatggcctacttcatcgcggcggacaagaagatcctttcgctggcgaggcagcactcgttcgagaacgcaccagagcgcctcaagaacacctccttccaggccaccggccgtccccacccggccttcttcaggccttaaacctccaaattatgcaaattaatactctgttatgatgtgcgctgctacatctgtacttccatctatatatatatatagtagcgtactagagtctacgtatatgttagtcgtcgcaatataagcaggcccctgactgcattgcagaccagcaagtagtagctgcgagcttattagcgtagcttatgcacagtgccgtaatctctgctgctttgaacatgcgttcatgctgtgtacgactatatatatcgtcagtgacatgtatcacagtaatgaaacacttctacaccccttctttccatc

SEQ ID NO: 958 - DNA, 1456 bp, Sorghum bicolor
acgagacaaatcttttaagcctagttagtttatgattggacaatatttagcacaaacaaacgaaaatgctacggtactaaaatccaaaaaattttcggaactaaacaaggcctaagtgggtgttgctacacatatctgcagataactgatcgcccatctctggagcctgcaggagacaagcggggtccatgaaaggtgcgcacagagacacaccgtgacgtacatgggaatgggagtgttgtgttggtgcctgctgccctgcactgcactactactactactgcagtgagaaaacaggggcgcccccaaaaactgagggccctgaaaccatgatcgctctgctttcatcatcagatagagaaaagcatctcccttttatctactacagtagtatatactagtatatctttcctgctttccatgaacgctcgatccctcagcttgtcacgtttattcactttgttggctacgtggaatcacacgaggtgatctggtgatcaggtgaggcagggaagagatggagccctcgtcactcacatgatcgcgcccaacgccacacatgggtttcgtttcatttcgccccgaaaccacgtccggcccccgttgccgcccgccgattccatcccctccttctccggcgccggtcccgcctgctgccgcgccgtgcatataaattcacggcctccgccttcctcttcttgcattgcaacccatccggccatctctgaacacgtactccagtctgctttctgttcctaacgagtagtatcttgttcttcaattcacgaacaaaagtgatcagcatgtcgacggtgagccgcgcgtccctggaccagaagcttgccctcgccaagcgctgctcccgagaggcgaccctcgcaggagccaaggcagcagctgtagcaaccgtcgcctccgcgattcccactctggcgagcgtgaggatgctgccatgggcgaaggccaacatcaaccccaccggccaggcactcatcatctccacagttgccgggatggcctacttcatcgcggcggacaagaagatcctttcgctggcgaggcagcactcgttcgagaacgcaccagagcgcctcaagaacacctccttccaggccaccggccgtccccacccggccttcttcaggccttaaacctccaaattatgcaaattaatactctgttatgatgtgcgctgctacatctgtacttccatctatatatatatatagtagcgtactagagtctacgtatatgttagtcgtcgcaatataagcaggcccctgactgcattgcagaccagcaagtagtagctgcgagcttattagcgtagcttatgcacagtgccgtaatctctgctgctttgaacatgcgttcatgctgtgtacgactatatatatcgtcagtgacatgtatcacagtaatgaaacacttctacaccccttctttccatcgcctc

SEQ ID NO: 959 - DNA, 1654 bp, Triticum aestivum
tcatcgctgtctggaacagcgataactcgagaacgaggtccctctctttccgcctccacttcctcgcgagcctctctcttctcctgctcctcacagcggtggcggcggcgatgcagatggcggccgcgacaaccgatgctccggtggcagctgcgccgcacccacatccccatgcccatggcccacaagtaccgcacggtcacgggcacccgcaccctcaccaccacatgccgcagccgcggtgggtggtacttccttacccgccgccgccgcctatggtggccgcgccgccccctcctacaccgcagtatgtgaagcatttcgcgccgcaggcatcggtgacgccgcctccgccatcggctggatccggcgggaacggaggtgacgagaaccggacgatctgggtcggcgacctccagtactggatggacgagaactatctccacagctgcttcggccccagcggcgaggtggtgacgattaaagttatccgcaatagacattccggagtttctgagggttatggttttgtagagttctgttcccatgcatcagcagagaaagcacttcagaattttgctggtcatgtaatgcctaatactgaccgagcttttaagttaaattgggcatcatatagtgttggagaaaaacgctctgaacttgcttctgatcactcaatttttgttggtgatctagctgttgatgttactgatgacatgttgatggaactttttgctaacaaatatcgttctgtgaaaggagctaaagttattattgatgcaaacacgggccgttctaggggctatggatttgttaggtttggagatgatattgatagaactcatgctatgactgaaatgaatggtgtgtattgctccactcggccaattcgcattggacctgcaactcctagaagaacttcaggtgattctggcacctctccaccaacacaatcagatggtgactcgactaacaggacagtatatgttggcgggcttgaccccaacgttagtgaagatgaactaaggaaagcatttgcgaaatatggtgatgttgcttctgtcaaaattcctgttgggaaacaatgcggttttgttcaatttgtcaacagagctgatgcggaagaagcattacaagggttgagtggatcaacaatcgggaagcaggcagttcgtctttcttggggccgcagtccagcaagcaaacagtctaggggtgattctgggcatcggcggaatggcatgtactacggcacgcctttctacggtggatatggctacgggtcgccagttcctcacccaaacgtgtatgctgcggcttatggagcctaccctttctacggtaaccagcaactagtgagctgatgatagaggtcgtctctgtttcctcccaactccagtagaaaacaaggttttggtccagtaagcacagtatcgtacgatgacatattatagatggccataaaagcgggcgagagagacaggtatatgaatgtgatgtctgcagattcgtgttgctagtagaacctaaagcaaggcttgtagacaataaagagttgagttattcgtattgttgtaagaaattttgacttgctaataaaaccattggctggaattaatttttctcaagttcaggttatgattgctaggttaat

SEQ ID NO: 960 - DNA, 1602 bp, Triticum aestivum
tcatcgctgtctggaacagcgataactcgagaacgaggtccctctctttccgcctccacttcctcgcgagcctctctcttctcctgctcctcacagcggcggcggcggcgatgcagatggcggccgcgacaatcgatgctccggtggcagctgcgccgcacccacatccccatgcccatggcccacaagtaccgcacggtcacgggcacccgcaccctcaccaccacatgccgcagccgcggtgggtggtacttccttacccgccgccgccgcctatggtggccgcgccgccccctcctacaccgcagtatgtgaagcatttcgcgccgcaggcatcggtgacgccgcctccgccatcggctggatccggcgggaacggaggtgacgagaaccggacgatctgggtcggcgacctccagtactggatggacgagaactatctccacagctgcttcggccccagcggcgaggtggtgacgattaaagttatccgcaatagacattccggagtttctgagggttatggttttgtagagttctgttcccatgcatcagcagagaaagcacttcagaattttgctggtcatgtaatgcctaatactgaccgagcttttaagttaaattgggcatcatatagtgttggagaaaaacgctctgaacttgcttctgatcactcaatttttgttggtgatctagctgttgatgttactgatgacatgttgatggaactttttgctaacaaatatcgttctgtgaaaggagctaaagttattattgatgcaaacacgggccgttctaggggctatggatttgttaggtttggagatgatattgatagaactcatgctatgactgaaatgaatggtgtgtattgctccactcggccaattcgcattggacctgcaactcctagaagaacttcaggtgattctggcacctctccaccaacacaatcagatggtgactcgactaacaggacagtatatgttggcgggcttgaccccaacgttagtgaagatgaactaaggaaagcatttgcgaaatatggtgatgttgcttctgtcaaaattcctgttgggaaacaatgcggttttgttcaatttgtcaacagagctgatgcggaagaagcattacaagggttgagtggattaacaatcgggaagcaggcagttcgtctttcttggggccgcagtccagcaagcaaacagtctaggggtgattctgggcatcggcggaatggcatgtactacggcacgcctttctacggtggatatggctacgggtcgccagttcctcacccaaacgtgtatgctgcggcttatggagcctaccctttctacggtaaccagcaactagtgagctgatgatagaggtcgtctctgtttcctcccaactccagtagaaaacaaggttttggtccagtaagcacagtatcgtacgatgacatattatagatggccataaaagcgggcgagagagacaggtatatgaatgtgatgtctgcagattcgtgttgctagtagaacctaaagcaaggcttgtagacaataaagagttgagttattcgtattgttgtaagaaattttgacttgctaataaaac

SEQ ID NO: 961 - DNA, 1633 bp, Triticum aestivum
tccacttcctcgcgagcctctctcttctcctgctcctcacagcggcggcggcggcgatgcagatggcggccgcgacaatcgatgctccggtggcagctgcgccgcacccacatccccatgcccatggcccacaagtaccgcacggtcacgggcacccgcaccctcaccaccacatgccgcagccgcggtgggtggtacttccttacccgccgccgccgcctatggtggccgcgccgccccctcctacaccgcagtatgtgaagcatttcgcgccgcaggcatcggtgacgccgcctccgccatcgactggatccggcgggaacggaggtgacgagaaccggacgatctgggtcggcgacctccagtactggatggacgagaactatctccacagctgcttcggccccagcggcgaggtggtgacgattaaagttatccgcaatagacattccggagtttctgagggttatggttttgtagagttctgttcccatgcatcagcagagaaagcacttcagaattttgctggtcatgtaatgcctaatactgaccgagcttttaagttaaattgggcatcgtatagtgttggagaaaaacgctctgaacttgcttctgatcactcaatttttgttggtgatctagctgttgatgttactgatgacatgttgatggaactttttgctaacaaatatcgttctgtgaaaggagctaaagttattattgatgcaaacacgggccgttctaggggctatggatttgttaggtttggagatgatattgatagaactcatgctatgactgaaatgaatggtgtgtattgctccactcggccaattcgcattggacctgcaactcctagaagaacttcagtttcaggtgattttggcacctctccaccaacacaatcagatggtgactcgactaacaggacagtatatgttggcgggcttgaccccaacgttagtgaagatgaactaaggaaagcatttgcgaaatatggtgatgttgcttctgtcaaaattcctgttgggaaacaatgcggttttgttcaatttgtcaacagagctgatgcggaagaagcattacaagggttgagtggattaacaatcgggaagcaggcagttcgtctttcttggggccgcagtccagcaagcaaacagtctaggggtgattctgggcatcggcggaatggcatgtactacggcacgcctttctacggtggatatggctacacgtcgccagttcctcacccaaacgtgtatgctgcggcttatggagcctaccctttctacggtaaccagcaactagtgagctgatgatagaggttgtctctttcctcccaacttcagtagaaaacaaggttttggtccagtaagcacagtatcgtaagatgacatattatagatggccataaaagcgggcgagagagacaggtatatgaatgtgatgtatgcagatttgtgttgcttgtagaacctaaagcaaggcttgtagacaataaagagttgagttatttgtattgttgtaagaaattttgacttgctaatgaaactacgggaaacgattggggccggcgcaccggccgaaccactcggccggtcgcgcgcgacctgtgcgatccccttctcatcgg

SEQ ID NO: 962 - DNA, 1549 bp, Secale cereale
atctctttcggcctccacttcctcgcaagcctctctcttctcctgctcctcgcagcggtggcggcggcgatgcagatggcggccgcgacaaccgatgctccgcacgcacatccccatgcccatggcccacaagtaccgcacggtcatgagcacccgcaccctcaccaccacatgccgcagccgcggtgggtggtacttccctacccgccgccgccgcctatggtggtcgcgccgccccctcctacaccgcaatatgtgaaacatttcgcgccgcaggcatcggtgactccgcccccgccatcgtctggatccggcgggaacggaggtgacgggaaccggacgatctgggtcggagacctccagtactggatggacgagaattacctccacagctgtttcggacccagcggcgaggtggtgacgattaaagttatccgcaatagacattccggagtttctgagggttatggttttgtagagttctgctcccatgcatcagcagagaaagcacttcagaattttgctggtcatgtaatgcctaatactgagcgagcttttaagttgaattgggcatcatatagtgtcggagaaaaacgctctgaacttgcttctgatcactcaatttttgttggtgatctagctgttgatgttactgatgacatgttgatggaactttttgctaacaaatatcgttctgtgaaaggagctaaagttattattgatgcaaacacaggccgttctaggggctatggatttgttaggtttggagatgatattgatagaactcatgctatgactgaaatgaatggtgtgtattgctccactcggccaattcgcattggacctgcaactcctagaagaacttcaggtgattctggcacctctccaccaacacaatcagatggtgactcaactaacaggacagtatatgttggcgggcttgatcccaacgtcagtgaagatgaactaaggaaagcatttgcaaaatatggcgatgttgcttctgtcaaaattcctgttgggaaacaatgcggttttgttcaatttgtcaacagagctgatgcggaagaagcattacaagggttgagtggatcaacaatcgggaagcaggcagttcgtctttcttggggccgcagtccagcaagcaaacagtttaggggtgattctgggcatcgacggaatggcatgtactacggcacacctttctacggtggatatggctacgcgtcgccagttcctcacccaaacgtctatgctgcggcttatggagcctaccctttctacggtaaccagcaactagtaagctgatgatagagcttgtctctgtttcctcccaactccagtagaaaacaaggttttggtcaagtaagcacagtatcgtacgatgacatattatagatgccataaaagcgggcgagagagacaggtacatgaatgtgatgtctgcagatttgtgttgctagtagaacctaaagcaaggtgtgtagacaataaatagttgagttgttcgtaatgttgtaagaaattttaactttgctaataaaactgt

SEQ ID NO: 963 - DNA, 1626 bp, Brachypodium distachyon
ccctctctttccgcctccactcctcgcgagcctccacacaaaagcaaagcctcctctctcctccttctccttgctcctcacagcggcggcggcggcggaggtgatgcagatggcggcggcaacccccgacgcaccggcggcagctgctgcgccgcacccgcatccccatgtgcacgggccaccacagccgcacgggcacggccacgcccacccgcacccgcaccaccacatgccgcagccgcggtgggtggtcatcccgtaccccccgccgccgcccatggtggccgcgcctccccctcctccgccgcagtacgtgaagcatttcgccccgccggcctcggtcactccgccaccgccatcgggcggtggatccggcgggaacgggggtgacgacaaccggacgatttgggtcggtgacctccagtactggatggacgagaactacctccacagctgcttcggccccagcggcgaggtggtcacaattaaagttattcgcaatagacattcaggagtttctgagggttatggttttgtagagttctattctcacgcatcagcagagaaagcacttcagaattttgctggtcatgtaatgcctaatactgaccgagcttttaagttaaattgggcatcatatagtgttggagaaaaacgctctgaacttgcttctgatcactcaatttttgttggtgatctagctgttgatgttactgatgacatgttgatggaactttttgctaacaaatatcgatctgtgaaaggagctaaagttattattgatgcaaacacgggccgttctagaggctatggatttgttaggtttggagatgataatgacagaacacatgccatgactgaaatgaatggtgtatattgctccactcggccaattcgcataggacctgcaactcctagaagaacttcaggtgattctggctcctctccaccaaggcaatcagatggtgacttgactaacaggacagtatatgttggtgggcttgaccctaatgtcagtgaagatgaactaaggaaaacatttgcaaagtatggtgatgttgcctctgtcaaaattcctgttgggaaacaatgtggctttgttcagtttgtcaacagagctgatgcggaagaagcactacaagcgttgagtggatcaacaattgggaagcaggcagttcgtctttcctggggccgcagtccagcaagcaaacagcctaggggtgattctggccaccgacggaacggcatgtactatggaacacctttctatggtggatatggttacgcatcgccggttcctcacccaaacatgtatgccgcagcatatggagcctaccctttctacggtaaccagcagctagtgagctgatgagagagttggtctctgtttcctccaatggaaaacaaaggttttggtccagtaagcatagtagcgtacgatgacacattatagatggccataaaagtgggcgagagagacaggtatatgaaatgaaatgatgtctgcagatttgtgctgcgagtagaacctaaaagcttgtagacaataaagagttgtttttattctttcaaggaattttgacttgctaataaaactaagctattggctgaacatctgtttgcttc

SEQ ID NO: 964 - DNA, 1827 bp, Brachypodium distachyon
acgcgctccctctctttccgcctccactcctcgcgagcctccacacaaaagcaaagcctcctctctcctccttctccttgctcctcacagcggcggcggcggcggaggtgatgcagatggcggcggcaacccccgacgcaccggcggcagctgctgcgccgcacccgcatccccatgtgcacgggccaccacagccgcacgggcacggccacgcccacccgcacccgcaccaccacatgccgcagccgcggtgggtggtcatcccgtaccccccgccgccgcccatggtggccgcgcctccccctcctccgccgcagtacgtgaagcatttcgccccgccggcctcggtcactccgccaccgccatcgggcggtggatccggcgggaacgggggtgacgacaaccggacgatttgggtcggtgacctccagtactggatggacgagaactacctccacagctgcttcggccccagcggcgaggtggtcacaattaaagttattcgcaatagacattcaggagtttctgagggttatggttttgtagagttctattctcacgcatcagcagagaaagcacttcagaattttgctggtcatgtaatgcctaatactgaccgagcttttaagttaaattgggcatcatatagtgttggagaaaaacgctctgaacttgcttctgatcactcaatttttgttggtgatctagctgttgatgttactgatgacatgttgatggaactttttgctaacaaatatcgatctgtgaaaggagctaaagttattattgatgcaaacacgggccgttctagaggctatggatttgttaggtttggagatgataatgacagaacacatgccatgactgaaatgaatggtgtatattgctccactcggccaattcgcataggacctgcaactcctagaagaacttcaggtgattctggctcctctccaccaaggcaatcagatggtgacttgactaacaggacagtatatgttggtgggcttgaccctaatgtcagtgaagatgaactaaggaaaacatttgcaaagtatggtgatgttgcctctgtcaaaattcctgttgggaaacaatgtggctttgttcagtttgtcaacagagctgatgcggaagaagcactacaagcgttgagtggatcaacaattgggaagcaggcagttcgtctttcctggggccgcagtccagcaagcaaacagcctaggggtgattctggccaccgacggaacggcatgtactatggaacacctttctatggtggatatggttacgcatcgccggttcctcacccaaacatgtatgccgcagcatatggagcctaccctttctacggtaaccagcagctagtgagctgatgagagagttggtctctgtttcctccaatggaaaacaaaggttttggtccagtaagcatagtagcgtacgatgacacattatagatggccataaaagtgggcgagagagacaggtatatgaaatgaaatgatgtctgcagatttgtgctgcgagtagaacctaaaagcttgtagacaataaagagttgtttttattctttcaaggaattttgacttgctaataaaactaagctattggctgaacatctgtttgcttcctttttcttttgttcagattgtagttgctaggctgattcatttctatcttgtgatcgcctgattggctcgcgataaatttcctttgttattgttgtacaacctacttccatcctgatgctagtctagagtgctagttgctgggcatagcatccatgttttgtgatatcatgccattgtcctgttatgctcatag

SEQ ID NO: 965 - DNA, 1785 bp, Setaria italica
gagctcccccctctctttccgcctccacccctcgcgagctcgccacacgcggcggcttcctccctccttcctcctcatacccccggcggcggcggcggcgatgcagatggcagcggcagcggcccccaccgacgccccggccgcggccgcggctgctgcgccgcaccaccacccccacgcgcacgccgcggcggccccgccgcacccgcacgcgcacgcgccgcacccgcaccaccacatgccgcagccgcggtgggtggtcatcccgtacccaccgccgcaccaccctatggtggccgcgccgccgcccccgccgccgcagtttgtcaagcacttcgcgccgccggcctcggtcaccccgccaccgccgccgtcggctggatccggcgggaatggcggcgaggacaaccggacgatctgggtcggcgacctccagtactggatggacgagaactacctccacagctgcttcggccccagcggcgaggtggtgacaattaaagttattcgcaatagacactctggggtctctgagggttatggttttgtagagttctattctcacgcatcagcagagaaggccttacagaacttctctggtcatgtaatgcctaatactgatcgggcgtttaagttaaattgggcatcatatagtatgggagaaaaacgctctgaacttgcatctgatcactcgatatttgttggtgatttggctgttgatgttactgatgacatgttgctggacctattttctagcaaataccgatcagtgaaaggagctaaagttattattgatgcaaacacaggccgttctagaggctacggctttgttaggttcggagatgataatgacaaaactcatgcaatgactgaaatgaatggtgtatactgttccacaagaccaattcgagtaggaccagctactcctagaagatctcaaggtgattcaggctcttctccaccaaggcaatcagatgctgactcaactaacaggacggtatatgttggtgggcttgaccccaacgttagtgaagaggaactgaggaaagcatttgcaaaatatggtgatcttgcctctgtcaaaattcctgttgggaagcaatgtgggtttgttcagtttgtaaacagagctgatgctgaagaagcactacaaggactgaatggatcaaccattgggaagcaggcagttagactttcctggggccgcagcccagccagcaaacagtctaggggtgattctggccaccggcgcaacggcaacggcatgtactatgggacaccattctatggtggatatggctacgcctcaccggttcctcacccgaacatgtatgcggcggcctatggagcctacccatactacggcaaccagcagctagtgagctgatgtggagagcttctccgatccgctccgtttcctccatcagagggaacaaggttttggtccagtaagcatagtagcgtacgatgagagattattataggtggccataaaagtgggcgtgagagacaagacaggtatatgatgataatggtacctgcagatctgcgctgctagtagaacctaaagaagcttgtagacaataagacctattcttttcctgagaaattttgacttgctaataaaactaaagctatcagttgtcgtgactgtccgtttgtttgttgtgcgctttgtattgggcagtcagagtttttgctgtagttcactttgttgcatgctcggttcgttgattgctgtgattttgcatcagttgctagcttgggcgatatggtatctgtcag

SEQ ID NO: 966 - DNA, 1696 bp, Pennisetum glaucum
ctcgtccatccagtactggaggtcgcccaccctcctctctttccgcctccaccccctcgcgagctcgccacacgcggcggcttcctccctccttcctcatcaacccccccggcggcggccgcgatgcagatggcggctgcggcggcccccaccgacgccccggccgcggccgcggttgctgcgccgcaccaccacccccacgcgcacgctgccgcggcggcggcggccccgcctcacccgcacgcgcacgcgcacgcgccgcacccccaccaccacatgccgcagccgcggtgggtggtcatcccgtacccgccgccgcaccaccccatggtggccgcgccgccgcccccgccgccgcagttcgtcaagcacttcgcgccgccggcctcggtcaccccgccgccgccgccgtcggctggatccggcgggaatgggggcgaggacaaccggacgatctgggtgggcgacctccagtactggatggacgagaactacctccacagctgcttcggccccagcggcgaggtggtgacaattaaagtcattcgcaatagacactccggggtctctgagggttatggttttgtagagttctattctcacgcatcagcggagaaggccctacagaatttttctggtcatgtaatgcctaataccgatagggcatttaagttaaattgggcatcatatagtatgggagaaaaacgctctgaagttgcatctgattactcgatatttgttggtgatttggctgttgatgttactgatgatatgttgctggaactattttctagcaaataccgatcagtgaaaggagctaaagttattattgatgcaaacacaggccgttccagaggctacggctttgttaggttcggagatgataatgacaaaactcacgcaatgaatgaaatgaatggtgtatactgttccacaagaccaattcgagtaggaccagctactcctagaagatctcaaggtgattcaggctcttctccaccaaggcaatcagatgctgactcaactaacaggacggtgtatgttggtgggcttgaccccagcgttagtgaagaggaactgaggaaagcatttgcaaaatatggtgatctcgtctctgtcaaaattcctgttgggaagcaatgtgggtttgttcagtttgtaaatagagctgatgctgaagaagcactacaaggactgagtggatctgtcattgggaagcaggcagttagactttcctggggccgtagcccagccagcaaacagtctaggggtgattctggccaccggcgcaatggcaatggcaacggcatgtactacgggacaccattctatggtggatatggctacgcctcaccagttcctcacccgaatatgtatgccgcgccctatggagcctacccatactacggcaaccagcagctagtgagctgatgtggagagcttctccgatccgctccgtttcctccaccggagggaacaaggttttggtccagtaagcatagtagcgtacgatgagatattattataggtggccataaaagtgggcgtgagagcaacgagacaggtatatgatgataatggtacctgcagatctgtgctgctagtagaacctaaagaaagcttgtagacaataagacatattctttttcctgagaaattttgacttgctaataaaactaaagctgagttgttgtga

SEQ ID NO: 967 - DNA, 1825 bp, Sorghum bicolor
ctccttcctctctttccgcctccaccctccctctctcgcgagcttcgacacacgcggcggccccctccctcctccagccccaacccccggcggcggcggcggcgatgcagatggcagcggcagtggcccccaccgacgccccggcctcggcggctgcggcggcgccgcacccccacccccacccgcacgccgcggctgcggcggctgcggctgcggccgcctcgccgcacccgcacgcaccaccgcacccgcaccaccatatgccgcaaccgcggtgggtggtcatcccgtaccctccgccacaccaccccatggtggccgcgccgccgccacctcccccgcagttcgtcaagcatttcgcgccgccggcctcggtgacaccgccgccgccgcccgctggatccggcgggaacgggggcgaggacaaccggaccatctgggttggcgacctgcagtactggatggacgagaactacctccacagctgcttcggccccagcggcgaggtggtgaatattaaagtcattcgcaatagacactcgggagtttctgagggttatggttttgtagagttctattcgcacgtgtcagcagagaaggcactacagaatttttctggtcatgtaatgcctaatactgaccgggcttttaagttaaactgggcatcatatagcatgggagaaaaacgcacggaactttcatctgatcactcgatatttgttggcgatttggctgttgatgttactgatgagatgttgctggagcttttttctaacaaataccgatcagtgaaaggagctaaagttattattgatgcaaacacaggccgttctagaggctacggctttgttaggtttggagatgataatgacaaaactcatgcaatgaccgaaatgaatggtgtatactgttccacaagaccaattcgtgtaggaccagcgactcctagaagatctcaaggtgattctggctcttctccaccaaggcaatctgatgttgactctactaacaggacggtatatgttggtgggcttgatcccaatgttagcgaagatgaactgaggaaagcatttgcaaaatatggtgatcttgcctctgtcaaaattccttttgggaagcaatgtgggtttgttcaatttgtaaacagagctgatgctgaagaagcactgcaagggttgaatggagcaactattgggaagcaggcagttcgactttcctggggccgcagtcctgcaagtaaacagtctaggggtgattctggccaccgtcgcaatggcaatggcaatggcatgtactacgggacgccattctacagtggatatggctacgcgtcacctgttccccacccaaacatgtatgcggcggcctatggagcctacccatactatggcaaccagcagctagtgagctgatgcggcgatgctctctgctcagtttcctcccctgggaggaaacaaggttttggtccagtaagcaatagtagctatgatgagatattataggtggccataaaaatgggcgagagagacgagacaggtatatgatgataatgctacctgcagatctgtgctgctagtagaacctaaaagagcttgtagtagacaataaaacctatttttgccttagaaattttgacttgctaataaaactaaagctatcggttgttgtgactgcctgtttggttggtgtgctgtgttttactgtacgagtatgttgcattttgcggtggttattctagctgcatgctcggttcgtcagttgctgtcacttcacatcagttgctagcttggagttggatgatttttgcatgcatctgtaatctgtt

SEQ ID NO: 968 - DNA, 1882 bp, Sorghum bicolor
gagctccttcctctctttccgcctccaccctccctctctcgcgagcttcgacacacgcggcggccccctccctcctccagccccaacccccggcggcggcggcggcgatgcagatggcagcggcagtggcccccaccgacgccccggcctcggcggctgcggcggcgccgcacccccacccccacccgcacgccgcggctgcggcggctgcggctgcggccgcctcgccgcacccgcacgcaccaccgcacccgcaccaccatatgccgcaaccgcggtgggtggtcatcccgtaccctccgccacaccaccccatggtggccgcgccgccgccacctcccccgcagttcgtcaagcatttcgcgccgccggcctcggtgacaccgccgccgccgcccgctggatccggcgggaacgggggcgaggacaaccggaccatctgggttggcgacctgcagtactggatggacgagaactacctccacagctgcttcggccccagcggcgaggtggtgaatattaaagtcattcgcaatagacactcgggagtttctgagggttatggttttgtagagttctattcgcacgtgtcagcagagaaggcactacagaatttttctggtcatgtaatgcctaatactgaccgggcttttaagttaaactgggcatcatatagcatgggagaaaaacgcacggaactttcatctgatcactcgatatttgttggcgatttggctgttgatgttactgatgagatgttgctggagcttttttctaacaaataccgatcagtgaaaggagctaaagttattattgatgcaaacacaggccgttctagaggctacggctttgttaggtttggagatgataatgacaaaactcatgcaatgaccgaaatgaatggtgtatactgttccacaagaccaattcgtgtaggaccagcgactcctagaagatctcaaggtgattctggctcttctccaccaaggcaatctgatgttgactctactaacaggacggtatatgttggtgggcttgatcccaatgttagcgaagatgaactgaggaaagcatttgcaaaatatggtgatcttgcctctgtcaaaattccttttgggaagcaatgtgggtttgttcaatttgtaaacagagctgatgctgaagaagcactgcaagggttgaatggagcaactattgggaagcaggcagttcgactttcctggggccgcagtcctgcaagtaaacagtctaggggtgattctggccaccgtcgcaatggcaatggcaatggcatgtactacgggacgccattctacagtggatatggctacgcgtcacctgttccccacccaaacatgtatgcggcggcctatggagcctacccatactatggcaaccagcagctagtgagctgatgcggcgatgctctctgctcagtttcctcccctgggaggaaacaaggttttggtccagtaagcaatagtagctatgatgagatattataggtggccataaaaatgggcgagagagacgagacaggtatatgatgataatgctacctgcagatctgtgctgctagtagaacctaaaagagcttgtagtagacaataaaacctatttttgccttagaaattttgacttgctaataaaactaaagctatcggttgttgtgactgcctgtttggttggtgtgctgtgttttactgtacgagtatgttgcattttgcggtggttattctagctgcatgctcggttcgtcagttgctgtcacttcacatcagttgctagcttggagttggatgatttttgcatgcatctgtaatctgttggtaaggccttgtttacttttcaaaaagtttgcaattttttttaaagattttcc

SEQ ID NO: 969 - DNA, 1850 bp, Oryza sativa
cgcgctcccctcctccgcctccactcctctcgcgaccaccaaccagcggcttcccggcggcggcggcggcgcgcgcgggcgagggcgagggcgcggcgaggcgatgcagatggctgcggcggcggcggcggcgagcaccgaggccccggcggtcgcggcggccgcgcctcaccaccaccacccgcacccccacgcgcacgggatgcacccgcacgcgcaccaccacatccaggcgcagccgaggtgggtggtcatcccgtacccgccgccgcacggcatggtggccgccgcgccgccgcctcccccgccgcagttcgtcaagcacttcgcgccgccggcgtcggtcaccccgccgccgccgcagcaggcgcagcaggcgcaggcggcggcggcggcggccgggggtggatccggcggagggaacggggacgagaaccggacgatttgggtcggggatctccagtactggatggacgagggctacctgcacaactgctttggccccagcggcgaggtggtcacaattaaagttattcgtaatagacattctggagtttctgagggttatggttttgttgagttcttttctcatgcatcagcagagaaagcactccagaatttttctggtcatgtaatgcctaataccgaccgagcttttaagttaaactgggcatcatatagcatgggagaaaagcgcgccgaacttgcttctgatcactcaatatttgttggtgatctggctgttgatgttacggatgaaatgttgatggatctttttgccaaaaaataccgatctgtgaaaggagctaaagttattattgatgcaaacaccggacgttctaggggctacggctttgttaggtttggagatgataacgacaaaactcatgcgatgactgaaatgaatggtgcatattgctctacccggccaattcgtataggacctgcaacacctagaagatcttcaggtgattctggctcctcgccaccaaggcagtcagatagtgactcaactaacaggacgatatatgttggcgggcttgatcccaacgctactgaagatgaactaaggaaagcatttgctaagtatggtgatcttgcctctgttaaaattcctgttggcaaacagtgtggttttgttcaatttgtcaacagacctgatgcagaagaagcactgcaagggttgaatggatcaacaattggaaagcaggcagtgcgtctttcctggggccgcagtccagcaagcaaacagtctaggggtgattccggccaccggcgcaatggcatgtactacggtacacctttctacggtggatatggctatgcgtcgccacttccacacccaaacatgtatgcagcagcatatggagcctacccttactacggtaaccagcagcttgtgagttgatgagaggcttctctcttgtttcctccaatggaaaacgaggttttggtccagtaagcatagtagcgtgtgatgagatatttatagatggccataaagaagttggtgagacagcaggtattacctgaaatggtacctgcagatttgtgtcagtgagtaccgagtagaacctaaaaagcttgtagacaaaataagagttgttcttattctttcaagaaattttgactcgctaataaaactgagctatgtgatgtgcgactatttccttccttctgcaactggtacaacttctaggattaatcgtcatatacatgatgcttatctaggagaaggtttgttaagcttattacttatgcttctcgtaaacatgatgtgcaaataggatgatttggtgagattataaatgcctcgcagctgggagaattcagttatttctgatgccgct

SEQ ID NO: 970 - DNA, 1647 bp, Oryza sativa
ctccactcctctcgcgaccaccaaccagcggcttcccggcggcggcggcggcgcgcgcgggcgagggcgagggcgcggcgaggcgatgcagatggctgcggcggcggcggcggcgagcaccgaggccccggcggtcgcggcggccgcgcctcaccaccaccacccgcacccccacgcgcacgggatgcacccgcacgcgcaccaccacatccaggcgcagccgaggtgggtggtcatcccgtacccgccgccgcacggcatggtggccgccgcgccgccgcctcccccgccgcagttcgtcaagcacttcgcgccgccggcgtcggtcaccccgccgccgccgcagcaggcgcagcaggcgcaggcggcggcggcggcggccgggggtggatccggcggagggaacggggacgagaaccggacgatttgggtcggggatctccagtactggatggacgagggctacctgcacaactgctttggccccagcggcgaggtggtcacaattaaagttattcgtaatagacattctggagtttctgagggttatggttttgttgagttcttttctcatgcatcagcagagaaagcactccagaatttttctggtcatgtaatgcctaataccgaccgagcttttaagttaaactgggcatcatatagcatgggagaaaagcgcgccgaacttgcttctgatcactcaatatttgttggtgatctggctgttgatgttacggatgaaatgttgatggatctttttgccaaaaaataccgatctgtgaaaggagctaaagttattattgatgcaaacaccggacgttctaggggctacggctttgttaggtttggagatgataacgacaaaactcatgcgatgactgaaatgaatggtgcatattgctctacccggccaattcgtataggacctgcaacacctagaagatcttcaggtgattctggctcctcgccaccaaggcagtcagatagtgactcaactaacaggacgatatatgttggcgggcttgatcccaacgctactgaagatgaactaaggaaagcatttgctaagtatggtgatcttgcctctgttaaaattcctgttggcaaacagtgtggttttgttcaatttgtcaacagacctgatgcagaagaagcactgcaagggttgaatggatcaacaattggaaagcaggcagtgcgtctttcctggggccgcagtccagcaagcaaacagtctaggggtgattccggccaccggcgcaatggcatgtactacggtacacctttctacggtggatatggctatgcgtcgccacttccacacccaaacatgtatgcagcagcatatggagcctacccttactacggtaaccagcagcttgtgagttgatgagaggcttctctcttgtttcctccaatggaaaacgaggttttggtccagtaagcatagtagcgtgtgatgagatatttatagatggccataaagaagttggtgagacagcaggtattacctgaaatggtacctgcagatttgtgtcagtgagtaccgagtagaacctaaaaagcttgtagacaaaataagagttgttcttattctttcaagaaattttgactcgctaataaaactgagctatgtgatgtgcgact

SEQ ID NO: 971 - DNA, 1670 bp, Panicum virgatum
ccctcgcgagcccctccaaccccacacgacccacctcctcggcggcggcggcggctgcggtggcgatgcagatggcggcggccaccaccgactcccaggcggccgtgccgcctcaccaccctcacgcacacccccatgcgccgccacagcacgcgcctccgcaccaccacatgccgcagccgcggtgggtcgtcataccgtacccgccgccgccgcccatggtggccgcgccgccgccgccgccgcagttcgccaagcacttcgccgctgggccgcccccgccgccacaagctgcggcagggcgccgcacgccgaccccgcccgcggccggatccggcgggaacgggtgcgaggagaataagacgatttgggttggcgacctccagtactggatggacgagaactacctacacagctgcttcgggcccagcggcgaggtagtgacaataaaagttatccggaataggcaaactggacaatcggaggggtatggatttgtggagtttttttctcacgcatctgcagaaaaagctcttcagaattttactggtcatgtgatgcctaacaccgatagagcatttaagttaaactgggcatcatatagtatgggtgaaaagcgatctgaagtagcttctgatcactcgatatttgttggtgatctagctgctgatgttaccgatgaaatgctgatggagctttttgctagcaagtaccgatcggtgaaaggagctaaagttattattgatgcaaacacaagccgctctaggggctatggatttgttaggtttggagatgataatgacaaatctcacgcaatgtctgaaatgaatggtgtatattgctctactaggccaattcgcattggacctgctactcccagaagatcttcaggtgattctggctcctcgactcctggtcattctgatggcgattcttctaacagaacggtatatgttggtgggcttgacccaaatgttagtgaggatgaacttaggaaagcctttgctaaatatggcgatcttgcctcagtaaaaattcctctaggaaagcagtgtggctttgttcaatttgttagcagaactgatgctgaagaagcattacaaggattgaatggatcagtcattggaaagcaggcagttcgcctttcatggggccgtagcccatcacataagcagtctaggggtgactccggcaacaggaggaacatgtactatggcacaccattctacggaggatacggctacgcctccccggtgccgcacccaaacatgtatgcccctgcatatggtgcgtacccgttctatggcggcaaccagcagctggtgagctagatatgagctagagagcctctctcggttccgtcccctccgacgggaaacaaggttttggtccggtgagcgtagtagcgtcaggtgagaaggaggtatagccttataggttgtcctaaaaagtgggcgagatatgttgttgaacggatggtatggtgcctgtagttgttgtgtgcgcgcgtcgcaggaactggatggaactcgtggcttgtagtacaccagcgagtcgtgtcggtattctttcaagaaattttgactttgtaataaattaaactattgtttgtgcgtccattttttgccacctctcgattgtacatggcaatcagtttcgtgcttttggat

SEQ ID NO: 972 - DNA, 1793 bp, Setaria italica
caccccaaccacgagctccctctcttttccgccctccaccccctgcgagccctccaaccccacacgacccacctcctcggcggcggcggctgcgttggcgatgcagatggcggcgaccaccaccgactcccaggcggccgtgccgcctcaccatcctcacgcgcacccccacgcgcctccgcagcacgcgcacccgcaccaccacatgccgcagccgcggtgggtcgtcatcccgtacccaccgccgccgcccatggtggccgcgccaccgccgccgccgcagttcgccaagcacttcgccgctgggccgccaccgccgccccaagcagcagggcgccgcacgccgaccccacccgcggccggatccggcgggaacgcgtgcgaggagaacaagacgatttgggttggtgacctccagtactggatggacgagaactacctccacagctgcttcgggcccagcggcgaggtagtgacaataaaagttatccggaataggcaaactggacaatcagaggggtatggatttgtggagttcttttctcacgggtcagcagagaaagctcttcagaattttactggtcatgtgatgcctaacactgatcgggcatttaagttaaactgggcatcatatagcatgggtgaaaagcgatctgaagtagcttctgatcactcgatatttgttggtgatttagctgctgatgttactgatgaaatgctgatggagctttttgccagcaagtaccgatcggtgaaaggagctaaagttattattgatgcaaacacaggccgttctaggggctatgggtttgttaggtttggagatgacaacgacaaatctcatgcaatgtcagaaatgaatggtgtatattgctctactagaccaattcgtataggacctgcgactccccgaagatcttcaggtgattctggctcctcgactcctggtcattcagatggtgattcttctaacagaacggtatatgttggtgggcttgacccaaatgtcagtgaggatgaacttaggaaagcctttgccaaatatggcgatcttgcctctgtaaaaattcctctaggaaaacagtgtggctttgttcaatttgttagcagaactgatgccgaagaagcactacaaggattaaatggatcagtaattggaaagcaggcagttcgcctttcatggggtcgcagcccatcgcataagcagtctaggggtgactccggcaatcggaggaacatgtactacggcacgccattctacggaggatatggctacgcctccccagtgccacacccaaacatgtacgccgctgcatatggcgcatacccattctacggcggcaaccagcagctggtgagctagagaggctctctccgctccgtcccctctgacgggaaacaaggttttggtccggtgagcatagtagcgtcaggtgagaagaaggttatagccttataggttgtcctaaaaaagtgggcgagatgtgttgtggaacggatggtatggtgcctgtagttgtgtgcgcgtgtcgcaagaactggatggaactcgtggctggtagtacaccagggagtcgtgtcggtattctttcaagaaattttgacttggtaataaattaaactattgtttgtgcgtccatttttgctccctcgatcgtgcgtggcaatcagtttcatgcttttggatacatatattttgagttctatgtttcgcggcatgtgatttttatgtttggatttgagtttgggatagttttgcacaagcagtgttgttgcgtacaacctgtttgtac

SEQ ID NO: 973 - DNA, 1629 bp, Oryza sativa
tctcttttccgccctccaccctcgcgagccaagctaccattctcctcctcggcggcggcggcggcggcggcggcggcgatgcagatggcggcgaccaccaccaccaccgactcctcccaggcggccgtgccgcctcaccaccctcaccctcacgcccacccgcacccgcacgcgcacccgcacccgcaccaccccatggcgcaggcgcggtgggtcgtcctgccttacccgcctccgccgccgcccatggtggccgctccgccgcccccgccgccgcagtacgccaagcacttcgcggcggggccgccccccgccgcggcggccgggcggcgcacgccgaccccgcccgcccccgccggatccggcgggaacgggtgcgaggagaacaagacgatctgggttggcgacctccagtattggatggacgagaactacctccacagctgtttcggacccagcggcgaggtagtgacgataaaagttatccgcaatagacaaactggacaatccgagggatatggttttgtagagttctactctcacggatcggcagagaaggctcttcagaattttactggtcatgtgatgcctaacactgatcgacctttcaagttaaactgggcttcatatagcatgggtgaaaagcgatctgaagttgcttctgactactcaattttcgttggtgatctagctgctgatgttactgatgaaatgttgatggagctttttgctaataagtaccgctctgtgaaaggagctaaagttattattgatgcaaacacaggccgttctaggggctatgggtttgttagatttggagatgacaatgacaaatcccatgcaatgactgaaatgaatggtgcgtattgctctactaggccaattcgtattggacctgcaactcccagaaggtcttcaggtgattctggctcctcaacacctgggcattcagatggcgattctactaacagaacggtatatgttggtgggctcgatccaaatgtcagcgaagatgagctgaggaaggcatttgccaaatatggtgatgttgcctctgtaaaaattcctctagggaagcaatgtggctttgttcaattcgtcagcagaactgatgcggaagaagcactgcaaggattgaatggatcagtcattggaaagcaggcagttcgcctttcatggggccgcagcccatcacataaacagtctagggctgattctggcagccgaagaaacaatatgtactatgggacgccattctacggtggatacggttatgcctcccccgtcccgcaccctaacatgtatgctgctgcatatggagcctaccctgtctatggcagtcagcagctagtgagctagagaagagagagagagagagagcttcattccattccctccaatggaaaacaaggttttggtccggtcagcatggtagcgccagatgtgaggttatagaacgtcctaaaagcgagtgaaacaggtaaaatgaatgtatggtatctgtagtgttgtctgtgttgcaagaagtataactcaaggcttgtagacacaagtgagtcgatggtattctttcaagaaattttgacttgctaataaattaaactattgtttgtgtgtccccgttgtgcg

SEQ ID NO: 974 - DNA, 1805 bp, Sorghum bicolor
caccccaaccacgagctccctctcttttccgccctccacccctcgctagccctccaccccccacacgaccctcctcctcggcggcggctgcggcggcgatgcagatggcggcgaccaccaccgactcccaggcggccgtgccgcctcaccaccctcacgcccacccccacgtgcccccgcagcatggtcacccgcaccaccacatgccgccgcagccacggtgggtcgtcatcccgtacccgccgccgccgcccatggtggccgcgccaccgccgccgccgccgcagtttgccaagcactttgctgctgggcctcccccgccgccccaagctgcggccgggcgccgcacgccgaccccacccgcggccggatccggcgggaacgggtgcgaggagaataagaccatttgggtcggcgacctccagtactggatggacgagaactacctccacagctgcttcgggcccagcggcgaggtggttacaataaaagttatccgcaataggcaaacaggacagtcagaggggtatggatttgttgagttcttttctcacgcatcagcagaaaaggctcttcagaattttactggtcatgtgatgccaaacactgaccgggcatttaagttgaactgggcatcatatagcatgggtgaaaagcgatctgaagtagcttctgaccactcaatatttgttggtgatctagctgctgatgttactgatgaaatgctgctggagcttttctctagcaagtaccgctcggtgaaaggagctaaagttattattgatgcaaacacaggccgttctaggggctatggatttgttaggtttggagatgacaacgacaaatctcatgcaatgtctgaaatgaatggtgtatattgctctactaggccaattcgtataggacctgcgactcccagaagatcttcaggagattctggctcctcgactcctggtcattcagatggtgattcttctaatagaacggtatatgttggtgggcttgaccccaatgtcagtgaagatgaacttagaaaagcctttgccaaatatggtgatcttgcctctgtgaaaattcctctaggaaagcaatgtggctttgttcaatttgctagcagaactgatgctgaagaagcactacaaggattaaatggatcactcattgggaagcaggcagttcgcctttcatggggccgcagcccatcgcataagcagtcgaggggtgactccggcaacaggaggaacaacatgtactatggcacaccattctatggcggatatggctatgcctccccagtgccacacccaaacatgtacgccgcagcgtatggcgcgtaccccatgtatggcaaccagcagctagtgagctagagagctcccctccgatgtgtcccctctgacgggaaacaaaggttttggtccggtgagcatagtagggtcaggtgagaaggttatatccttataggttgtccgaaaaagtgggcgagatatgttgttgaacggatggtatggtgcctgtagctgttgtgtgtgtgtgcgtcgcaagaattggatggaactcgtggcttgtagtacaccagggagtcatgtcggtattctttcaagaaattttgacttggtaataaattaaactattgtttgtgcgtccatttattttccctcgattgtggttggcaatcatttttatgctcagttacatataattttgtatttttgtgccatagaatcgttggtaatgatttttatgtttgtattttaagtttggagaaaaaaaatcagtagtgttgctgcttacaatctgtttgt

SEQ ID NO: 975 - DNA, 1933 bp, Sorghum bicolor
cacgcactcaccacgaaatcgccggcccacgcgtcagccacccaccctggcgatcagacggccaagaccataacgaactccaagatctgacggcgcagatccgtttctaaccccgtatatattcacctcaccccaaccacgagctccctctcttttccgccctccacccctcgctagccctccaccccccacacgaccctcctcctcggcggcggctgcggcggcgatgcagatggcggcgaccaccaccgactcccaggcggccgtgccgcctcaccaccctcacgcccacccccacgtgcccccgcagcatggtcacccgcaccaccacatgccgccgcagccacggtgggtcgtcatcccgtacccgccgccgccgcccatggtggccgcgccaccgccgccgccgccgcagtttgccaagcactttgctgctgggcctcccccgccgccccaagctgcggccgggcgccgcacgccgaccccacccgcggccggatccggcgggaacgggtgcgaggagaataagaccatttgggtcggcgacctccagtactggatggacgagaactacctccacagctgcttcgggcccagcggcgaggtggttacaataaaagttatccgcaataggcaaacaggacagtcagaggggtatggatttgttgagttcttttctcacgcatcagcagaaaaggctcttcagaattttactggtcatgtgatgccaaacactgaccgggcatttaagttgaactgggcatcatatagcatgggtgaaaagcgatctgaagtagcttctgaccactcaatatttgttggtgatctagctgctgatgttactgatgaaatgctgctggagcttttctctagcaagtaccgctcggtgaaaggagctaaagttattattgatgcaaacacaggccgttctaggggctatggatttgttaggtttggagatgacaacgacaaatctcatgcaatgtctgaaatgaatggtgtatattgctctactaggccaattcgtataggacctgcgactcccagaagatcttcaggagattctggctcctcgactcctggtcattcagatggtgattcttctaatagaacggtatatgttggtgggcttgaccccaatgtcagtgaagatgaacttagaaaagcctttgccaaatatggtgatcttgcctctgtgaaaattcctctaggaaagcaatgtggctttgttcaatttgctagcagaactgatgctgaagaagcactacaaggattaaatggatcactcattgggaagcaggcagttcgcctttcatggggccgcagcccatcgcataagcagtcgaggggtgactccggcaacaggaggaacaacatgtactatggcacaccattctatggcggatatggctatgcctccccagtgccacacccaaacatgtacgccgcagcgtatggcgcgtaccccatgtatggcaaccagcagctagtgagctagagagctcccctccgatgtgtcccctctgacgggaaacaaaggttttggtccggtgagcatagtagggtcaggtgagaaggttatatccttataggttgtccgaaaaagtgggcgagatatgttgttgaacggatggtatggtgcctgtagctgttgtgtgtgtgtgcgtcgcaagaattggatggaactcgtggcttgtagtacaccagggagtcatgtcggtattctttcaagaaattttgacttggtaataaattaaactattgtttgtgcgtccatttattttccctcgattgtggttggcaatcatttttatgctcagttacatataattttgtatttttgtgccatagaatcgttggtaatgatttttatgtttgtattttaagtttggagaaaaaaaatcagtagtgttgctgcttacaatctgtttgt

SEQ ID NO: 976 - DNA, 1900 bp, Zea mays
tctctcctctctttccgcctccatccgaccacccccgcgagcttcgacagttcgacacacgcggccgccccttcccggctccagccacaccccccggaggcggcgatgcagatggcagcggcagttgcccccaccgacgccccggcctcggcgtctgcggcggcggcgccctcccgcccccacgcgcacgccgcggcagcggtggcggccgcgtcgcctcacccgcacgcactgcatccgcatcaccatatgccgcaaccgcggtgggtggtcatcccataccctcctccacaccatcccatggtggccgcgccgccgccaccttctctgcagtttgtgaagcattttacgccgccgtcctcggtaacaccgccgccgccgactggatccggcgggaacgggggcgaggataaccggaccatctgggtgggcgacctgcagtactggatggacgaaaactatcttcacagctgcttcggctctagcggcgaggtggtgaatattaaagtcattcgcaatagacactcgggagtttctgagggttatggttttatagagttttatactcacgtttcagcagagaaggcactgcagaatttttctggtcacgtaatgcctaatactgaccgggcttttaagttaaactgggcatcatatagtatgggagaaaaacgctcggaaatttcgtctgatcactcgatatttgttggcgatttggctgttgatgttactgatgcgatgttgctggaacttttttctaacaaataccgatcggtgaaaggagctaaagttattattgatgcaaacacaggccgttctagaggctacggctttgttaggtttggagatgataatgacaaaattcatgcaatgactgaaatgaatggtgtttactgttccacaagaccaattcgtgtaggaccagcgactcctagaagatctcaaggtgattctggcacttctccaccaaggcaatctcatgttgactctactaacaggacggtatatgttggtgggcttgaccccaatgttagcgaagatgaactgaggaaagcatttgcaaaatatggtgatcttgcctctgtcaaaattccttttgggaaacaatgtgggtttgttcaatttgtaaacagagttgatgctgaagaagcactgcatgggttgaatggatcaactattgggaagcaggcagttcgactttcctggggccgcagccctgcaagtaaacagtctaggggtgattctggccaccggcgcaatggcaactgcaacggcatgtactacgggacaccattctacggtggatatggctacgcctccccgattccgcacccaaacatgtacgccgcggcctacgaagcctacccgtactatgggaaccagcagctagtgagctgatgtagtgatgtggcgagatgctctctgctcagttttcctcccttggaggaaacgagtttttggtcccagtaaaagcatagtagctatgatgagatatatgataggtggccataaaaatgggcgcgagagacgagacaggcatatgatggtaacgctacctgcagatttgtgctgctagtagaacctaaaagagcttgtagtagacaaataaaaccttttcttttgtcttggaaattttgactcgctaataaaaagtgaagctatctgttgttgtggctgtctgtttggttggtgtgctgtgttttgggtcggtggtccttgcatgttcggtttctcacttcgcatcagttgctgttgctagcttggagttgcatgatgtcacaccgcctgtattattttttgcatgctatgttgatacacgtatccatgttgctatcctgcagccaaccgcggctatcctgtcaatacgaacttcggggatttaggttttttggttctggga

SEQ ID NO: 977 - DNA, 1678 bp, Saccharum officinarum
cgcgagccctccaacccccacacgaccctcctcggcggcggcggctgcggcggcgatgcagatggcggcgaccaccaccgactcccaggcggccgtgccgcctcaccacccgcacgcccacccccacgttcccccgcagcatgctcacccgcaccaccacatgccgcagccacggtgggtcgtcatcccgtacccgccgccgccgcccatggtggccgcgccaccgccgccgccgcctcagtttgccaagcacttcgctgccgggccgcccccgccgccccaagctgcggccgggcgccgcacgccgaccccgcccttggccggatccggcgggaacgggtgcgaggagaataagaccatttgggtcggcgacctccagtactggatggacgagaactacctccacagctgcttcgggcccagcggcgaggtggttacaataaaagttatccgcaataggcaaacaggacagtcagaggggtatggatttgttgagttcttttctcatgcatcagcagaaaaggctcttcagaactttactggtcatgtgatgccaaacactgaccgggcatttaagttgaactgggcatcatatagcatgggtgaaaagcgatctgaagtagcttctgatcactcgatatttgttggtgatctagctgctgatgttactgatgaaatgctgctggagcttttctctagcaagtaccgctcggtgaaaggagctaaagttattattgatgcaaacacaggccgttctaggggctatggatttgttaggtttggagatgacaacgacaaatctcatgcaatgtctgaaatgaatggtgtatattgctctactaggccaattcgtataggacccgcgactcccagaagatcttcaggagattctggctcctcgactcctggtcattcagatggcgattcttctaatagaacggtatatgttggtgggcttgaccccaatgtcagtgaagatgaacttagaaaagcctttgccaaatatggtgatcttgcctctgtgaaaattcctctaggaaagcaatgtggctttgttcaatttgttagcagaactgatgctgaagaagcactacaaggattaaatggatcactcattggaaagcaggcagttcgcctttcatggggccgcagcccatcgcataagcagtcgaggggtgactccggcaacaggaggaacaacatgtactttggcacaccattctatggcggatatggctatgcctccccggtgccacacccaaacatgtacgctgcagcgtatggcgcgtacccgatgtatggcaaccagcagctagtgagctagagagctcccctccgatgtgtcccctctgacgggaaacaaaggttttggtccggtgagcatagtagcgtcaggtgagaaggttataggttgtcctaaaaagtgggcgagatatgttgttgaacggatggtatggtgcctgtagctgttgtgtgtgtgtgtgtgcgtcgcaagaattggatggaactcgtggcctgtagtacaccagggagtcatgtcggtattctttcaagaaattttgacttggtaataaattaaactattgtttgtgcgtccattttaacctctcgattgtgggttggcaatcattttcatgctcctgggtacatataacttgtatttttgtaccccctggac

SEQ ID NO: 978 - DNA, 1666 bp, Panicum virgatum
caccctcgcgagccgctccaacccacacgacccacctcctccccggcggcggcggcggctgcggtggcgatgcagatggcggcgaccaccaccgactcccaggcggccgtgccgcctcaccaccctcacgcgcacccccatgcgcctccacagcacgcgcctccgcaccaccacatgccgcagccgcggtgggtcgtcataccgtacccgccgccgccgcccatggtggccgcgccaccgccgccaccgcagttcgccaagcacttcgccgctgggccgcccccgccgccacaagctgcggcagggcgccgcacgccgaccccgcccgtggccggatccggcgggaacggatgcgaggagaataagacgatttgggttggcgacctccagtactggatggacgagaactacctccacagctgcttcgggcccagcggcgaggtagtgacaataaaagttatccggaataggcaaactggacaatcggaggggtatggatttgtggagttcttttctcacgcatctgcagaaaaagctcttcagaattttactggtcatgtgatgcctaacaccgatagagcatttaagttaaactgggcatcatatagtatgggtgaaaagcgatctgaagtagcttctgatcactcgatatttgttggtgatctagctgctgatgttactgatgaaatgctgatggagctttttgctagcaagtaccgatcggtgaaaggagctaaagttattattgatgcaaacacaggccgctctaggggctatggatttgttaggtttggagatgataacgacaaatctcacgcaatgtctgaaatgaacggtgtatattgctctactaggcccattcgcattggacctgctactcccagaagatcttcaggtgattctggctcctcgactcctggtcattcggatggcgattcttctaacaaaacggtatatgttggtgggcttgacccaaatgttagcgaggatgaacttaggaaagcctttgccaaatatggcgatcttgcctcagtaaaaattcctctaggaaagcagtgtggctttgttcaatttgttagcagaactgatgctgaagaagcactacaaggattgaatggatcagtcattggaaagcaggcagttcggctttcatggggccgtagcccatcacataagcagtctaggggtgactccggcaacaggaggaacatgtactatggcacaccattctacggaggatacggctacgcctccccggtgccgcacccaaacatgtatgcccctgcatatggcgcgtacccgttctatggcggcaaccagcagctggtgagctagatatgagctagagcgcctctctccgttccgtcccctccgacgggaaacaaggttttggtccggtgagcatagtagcgtcaggtgagaaggaggttatagccttataggttgtcctaaaaagtgggcgagatatgttgctgaacggatggtatggtgcctgtagttgttgttgtgtgtgcgtcgcaagaactggatggaactcgtggcttgtagtacaccagggagtcgtgtcggtattctttcaagaaattttgactttgtaataataaattaaactattgtgtgtgcgtccaattttcgccacctctcgattgtgcgtggcaatccgttt

SEQ ID NO: 979 - DNA, 1713 bp, Oryza sativa
cacccccacccacgagctccctctcttttccgccctccaccctcgcgagccaagctaccattctcctcctcggcggcggcggcggcggcggcggcggcgatgcagatggcggcgaccaccaccaccaccgactcctcccaggcgggcgcgtgccgcctcaccaccctcaccctcacgcccacccgcacccgcacgcgcacccgcacccgcaccaccccatggcgcaggcgcggtgggtcgtcctgccttacccgcctccgccgccgcccatggtggccgctccgccgcccccgccgccgcagtacgccaagcacttcgcggcggggccgccccccgccgcggcggccgggcggcgcacgccgaccccgcccgcccccgccggatccggcgggaacgggtgcgaggagaacaagacgatctgggttggcgacctccagtattggatggacgagaactacctccacagctgtttcggacccagcggcgaggtagtgacgataaaagttatccgcaatagacaaactggacaatccgagggatatggttttgtagagttctactctcacggatcggcagagaaggctcttcagaattttactggtcatgtgatgcctaacactgatcgacctttcaagttaaactgggcttcatatagcatgggtgaaaagcgatctgaagttgcttctgactactcaattttcgttggtgatctagctgctgatgttactgatgaaatgttgatggagctttttgctaataagtaccgctctgtgaaaggagctaaagttattattgatgcaaacacaggccgttctaggggctatgggtttgttagatttggagatgacaatgacaaatcccatgcaatgactgaaatgaatggtgcgtattgctctactaggccaattcgtattggacctgcaactcccagaaggtcttcaggtgattctggctcctcaacacctgggcattcagatggcgattctactaacagaacggtatatgttggtgggctcgatccaaatgtcagcgaagatgagctgaggaaggcatttgccaaatatggtgatgttgcctctgtaaaaattcctctagggaagcaatgtggctttgttcaattcgtcagcagaactgatgcggaagaagcactgcaaggattgaatggatcagtcattggaaagcaggcagttcgcctttcatggggccgcagcccatcacataaacagtctagggctgattctggcagccgaagaaacaatatgtactatgggacgccattctacggtggatacggttatgcctcccccgtcccgcaccctaacatgtatgctgctgcatatggagcctaccctgtctatggcagtcagcagctagtgagctagagaagagagagagagagagagcttcattccattccctccaatggaaaacaaggttttggtccggtcagcatggtagcgccagatgtgaggttatagaacgtcctaaaagcgagtgaaacaggtaaaatgaatgtatggtatctgtagtgttgtctgtgttgcaagaagtataactcaaggcttgtagacacaagtgagtcgatggtattctttcaagaaattttgacttgctaataaattaaactattgtttgtgtgtccccgttgtgcgaagtaatttgcctgttactaccgttggccttgaagatggagatggtttgcttatatgcggc

SEQ ID NO: 980 - DNA, 1813 bp, Triticum aestivum
ctcacgagactcccccaaccccaggcgaccctcctcggcggcggcggcgcgggcggcgatgcagatggcggcgaccacaacggagtcacaggtggccgtgccgcctcaccacccccacgcgcacccgcatccgcacccacctccgcatcacccgcacccgcaccaccacatgccgcagccgcggtgggtcgtcctcccctacccgccgccgtccatggtggccgcaccgcccccgccgccgccgcagttcgccaagcactacgcgccggggccgccgcctccccctgccgcggccgggcgacgcacgccgaccccacccgcggccggatccggcgggaacggctgcgaggagaataagacgatctgggtcggcgacctccagtactggatggacgagaactacctccacaactgcttcggccccagcggcgaggtggtaacaataaaagttatccgcaataggcaaactggacaatcagagggatatggttttgtagagttcttttcccatgcatcagcagacaaagctcttcagaattttactggtcatgtgatgcccaacactgatcgagcctttaagttgaactgggcatcctatagcatgggtgaaaagcgatcagaagttgtctctgaccactcaatttttgttggtgatttagctgctgatgttactgatgaaatgttgatggagctttttgctagcaagtatcgctccgtgaaaggagctaaagttatcattgatgcaaacacaggccgttctaggggctatgggtttgttagatttggagatgataccgacaaagctcatgcaatgactgaaatgaacggtgtttattgctctactagaccgattcgcgtaggacctgcaacgcctagaagaacctctggtgattctggttcctcaacacctggccattcagatggtgattcaaataacagaacggtatatgttggtgggctcgacccaaatgttagtgaagacgagctgaggaaatcatttgccaaatatggtgatgttgcctctgtcaaaattcctctagggaagcagtgtggctttgttcagtatgtcaacagaactgacgcagaagaagcactgcaaggattgaatggggctgtcattggaaagcaggcagttcgcctttcatggggccgcagcccatcacacaaacagtctaggggcgattccggcaacaggaggaacaacaacaacatgtactatggcacgccgttctacggcgggtacggctacgcgtcccccgtcccgcaccccaacatgtacgcccctgcgtatggagcctaccccttctacggcaaccagcagctggtgagctagagagagaaagagcttcgtcccactccctccgatggggaacaaggttttgatccggtaagagcatagcagcgtcagaagagagagagagtgagagagagagagagattatatagatcgtcctaaaagtaagagggtgagacaggttattaaaaagtgaaagaaacgagtggtgtctgtactctgtagcgtctgttgtgtgtgtgtgtgtgtgtgtgtgtgtgttgcaagaactagaagagcctctaggcttgtagacacggtcggagcgtcatggatgttgattcattcaagaaattttgacttgcttaataagttacaacactgtttgtgccgcacatctaaaaaaaaaaaaaaaaaactcgaggggggtccggtacctatcggcctatagtgagtcgtattacatcactggcgtcgttacaccgtctgactgaaagcgtggcgtaccactatcaccctggcagacattccccttttgcc

SEQ ID NO: 981 - DNA, 1797 bp, Triticum aestivum
ccgcaacctcacgagactcccccaaccccaggcgaccctcctcggcggcggcggcgcgggcggcgatgcagatggcggcgaccacaacggagtcacaggtggccgtgccgcctcaccacccccacgcgcacccacatccgcacccacctccgcatcacccgcacccgcaccatcacatgccgcagccgcggtgggtcgtcctcccctacccgccgccgtccatggtggccgccccgcccccgccgccgccgcagttcgccaagcactacgcgccggggccgccgcctccccctgccgcggccgggcgacgcacgccgaccccacccgcggccggatccggcgggaacggctgcgaggagaataagacgatctgggtcggcgacctccagtactggatggacgagaactacctccataactgcttcggccccagcggcgaggtggtaacaataaaagttatccgcaataggcaaactggacaatcagagggatatggttttgtagagttcttttcccatgcatcagcagacaaagctcttcagaattttactggtcatgtgatgcccaacactgatcgagcctttaagttgaactgggcatcctatagcatgggtgaaaagcgatcagaagttgtctctgaccactcaatttttgttggtgatttagctgctgatgttactgatgaaatgttgatggagctttttgctagcaagtatcgctccgtgaaaggagctaaagttatcattgatgcaaacacaggccgttctaggggctatggatttgttagatttggagatgataccgacaaagctcatgcaatgactgaaatgaacggtgtttattgctctactagaccgattcgcgtaggacctgcaacgcctagaagaacctctggtgattctggttcctcaacccctggccattcagatggtgattcaaataacagaacggtatatgttggtgggctcgacccaaatgttagtgaagacgagctgaggaaatcatttgccaaatatggtgatgttgcctctgtcaaaattcctctagggaagcagtgtggctttgttcagtatgtcaacagaactgatgcagaagaagcactgcaaggattgaatggggctgtcattggaaagcaggcagttcgcctttcgtggggccgcagcccatcacacaaacagtctaggggcgattccggcaacaggaggaacaacaacaatatgtactatggcacgccgttctacggcgggtacggctacgcatcccccgtcccgcacccgaacatgtatgcccctgcgtatggagcctaccccttctacggcaaccagcagctggtgagctagagagagagcttcgtcccactccctccgatgggaaacaaggttttgatccggtgagagcatagcagcgtcagaagagagagagtgagagagagagagagagattatatagatggtcctaaaagtaagagggtgagacaggttattaaaaagtgaaagaaacgagtggtgtctgtactctgtagcgtctgttgtgtgtgtgtgtgtgtgtgtgtgtgtgtgtgtgttgcaagaactagaagagcctctaggcttgtagacacggtcggagcgtcatggatgattcattcaagaaattttgacttgcttaataagttacaacactgtttgtgccgcacattatttttatctccactgggtggagtgctgcttattcgttgccgttttttagcctataaacaccggtacggtctggctgagcatatgcatgtaaaaaatcaatatttgcatgttgattgcc

SEQ ID NO: 982 - DNA, 1452 bp, Panicum virgatum
ggccccgccgcacccgcacgcgcacgcgccgcacccgcaccaccacatgccgcagccgcggtgggtggtcatcccgtacccgccgccgcaccaccccatggtggccgctcccccgcccccgccgccgcagttcgtcaagcacttcgcgccgctggcctcggtcaccccgccgccgccgcagtcggctggatccggcgggaatggggccgaggacaaccgaacgatctgggtcggcgacctccagtactggatggacgagaactacctccacagctgcttcggccccagcggcgaggtggtgacaattaaagttattcgcaatagacactcgggggtctccgagggttatggttttgtagagttctattctcacgcatcagcagagaaggcactacagaatttttctggtcatgtaatgcctaatactgaccgggcttttaagttgaactgggcatcatatagtatgggagaaaaacgctccgaaattgcatctgatcactctatatttgttggtgatttggctgttgatgttactgatgacatgttgctggaacttttttctagcaaataccgatcagtgaaaggagctaaagttattattgatgcaaacacgggccgttctagaggctacggctttgttaggttcggagatgacaatgacaaaactcatgcaatgtctgaaatgaatggtgtatactgttccacaagaccaattcgagtaggaccagcgacccctagaagatctcaaggcgattcaggctcatctccgccgaggcaatcagattctgactccactaacaggacggtttatgttggagggcttgaccctaacgttagcgaagaggagctgaggaaagcatttgcaaaatacggtgatcttgcctctgtcaaaattcctgttggcaagcaatgtgggtttgttcagtttgtaaacagagctgatgctgaagaagcactacaagggctgaatggatcgacaattgggaagcaggcagttagactttcctggggccgcagcccagccagcaaacagtctaggggtgattatgggcaccgacgcaatggcaatggcatgtactacgggacaccattctacagtggatatgggtatgcctcaccggttccccacccaaacatgtatgccgcggcctatggagcctacccttactacggcaaccagcagctagtgagctgatgggcagagcttctccactcggttccctccaccggaggaaacaaggttttggtccagtaagcatagtagcgtacgatgagataatataggtggccataaaaagtgggcgagagagacgagacaggtatatgatgataatggtacctgcagatctgtgcttctagtagagaacctaaatgaagcttgtagacaataagacctattctttcctgagaaattttgacttgctaataaaactaaagctgtcagttgttgtg

SEQ ID NO: 983 - DNA, 1630 bp, Brachypodium distachyon
gcgccctccatacctcgcgagccaccccccaaggcgaccctctcctcctcggcggcggcggcggcgcagcggtgatgcagatggcagcgaccacaaccgactctcaggtggccgtgccgcctcaccacccgcactctcacccccatccccacccccaccctcctccgcaacacgcgcacccgcaccaccacatgccgcagccccggtgggtcgtcctcccctacccgcctccgccgccgaccatggtggctgcacctcccccgcctccgccgcagtttgccaagcactatgcaccggggccgcctccaccccccgccgcggccgggcgacgcacgccgaccccacccgcggccggatccggcgggaacgcttgcgaggagaataagacgatctgggtcggcgacctccagtactggatggacgagaactacctccacagctgcttcggtccaagcggagaggtggtaacaataaaagttatccgcaataggcaaactggacaaacagagggatatggttttgtagaattctattcccatgcatcagcagataaagcacttcagaattttactggtcatgcgatgcctaacactgatcgaccgtttaaattaaactgggcatcctatagcatgggcgaaaagcgatctgaagttgtctcggaccactcaatatttgttggtgatttagctgctgatgttaccgatgaaatgttgatggagctttttgctagcaagtaccgctccgtgaaaggagctaaagttattattgatgcaaacacaggccgttctaggggttatggctttgttaggtttggagaggatagtgataaatctcgtgcaatgacagaaatgaatggtgtgtattgctctactaggccaattcgtataggacctgcaacacctagaagaaccgctggtgattctggctcctcaacacctggacattcagatggtgattctactaacagaacggtttatgttggtgggctcgaccctaatgttagtgaagatgagctcaggaaatcatttgccaaatatggcgatgttgcctctgtaaaaattcctcaagggaagcagtgtggctttgttcaatatgtcaacagaactgatgcggaagaagcactacagggattgaatggatcagtcattggaaagcaggcagttcgcctttcatggggccgcagcccatcacataaacagccaaggggtgattctggtaaccgaaggaacaacatgtactacgggaccccattctatggcggctacggctacgcctcccctgtcccgcaccccaacatgtacgctgctgctgctgcttatggagcctaccctttctatggcaatcagcagctagtgagctagagagctccgttcgctcctttccctccgatgggaaacaaggttttgatctgatgagagaggatagcagtatcagaagaggtgttatagatcgtcctaaaagtggggtgagacaggtgaaaaatgagatggtgtctgtactctgtagtgtctgttgtgtatgtgttgcaagaactagaactctaggcttgtggacaccgagagtcatgtgtgattctttcaagaaattttgacttggtaataagtttaaaacctatgttgtttgcgctccc

SEQ ID NO: 984 - DNA, 1842 bp, Brachypodium distachyon
caccccacccacgctccctctctttgcgccctccatacctcgcgagccaccccccaaggcgaccctctcctcctcggcggcggcggcggcgcagcggtgatgcagatggcagcgaccacaaccgactctcaggtggccgtgccgcctcaccacccgcactctcacccccatccccacccccaccctcctccgcaacacgcgcacccgcaccaccacatgccgcagccccggtgggtcgtcctcccctacccgcctccgccgccgaccatggtggctgcacctcccccgcctccgccgcagtttgccaagcactatgcaccggggccgcctccaccccccgccgcggccgggcgacgcacgccgaccccacccgcggccggatccggcgggaacgcttgcgaggagaataagacgatctgggtcggcgacctccagtactggatggacgagaactacctccacagctgcttcggtccaagcggagaggtggtaacaataaaagttatccgcaataggcaaactggacaaacagagggatatggttttgtagaattctattcccatgcatcagcagataaagcacttcagaattttactggtcatgcgatgcctaacactgatcgaccgtttaaattaaactgggcatcctatagcatgggcgaaaagcgatctgaagttgtctcggaccactcaatatttgttggtgatttagctgctgatgttaccgatgaaatgttgatggagctttttgctagcaagtaccgctccgtgaaaggagctaaagttattattgatgcaaacacaggccgttctaggggttatggctttgttaggtttggagaggatagtgataaatctcgtgcaatgacagaaatgaatggtgtgtattgctctactaggccaattcgtataggacctgcaacacctagaagaaccgctggtgattctggctcctcaacacctggacattcagatggtgattctactaacagaacggtttatgttggtgggctcgaccctaatgttagtgaagatgagctcaggaaatcatttgccaaatatggcgatgttgcctctgtaaaaattcctcaagggaagcagtgtggctttgttcaatatgtcaacagaactgatgcggaagaagcactacagggattgaatggatcagtcattggaaagcaggcagttcgcctttcatggggccgcagcccatcacataaacagccaaggggtgattctggtaaccgaaggaacaacatgtactacgggaccccattctatggcggctacggctacgcctcccctgtcccgcaccccaacatgtacgctgctgctgctgcttatggagcctaccctttctatggcaatcagcagctagtgagctagagagctccgttcgctcctttccctccgatgggaaacaaggttttgatctgatgagagaggatagcagtatcagaagaggtgttatagatcgtcctaaaagtggggtgagacaggtgaaaaatgagatggtgtctgtactctgtagtgtctgttgtgtatgtgttgcaagaactagaactctaggcttgtggacaccgagagtcatgtgtgattctttcaagaaattttgacttggtaataagtttaaaacctatgttgtttgcgctcccattttacctccctcgtgtttttcgtcgtcaccccccatcatgtagagaagttggattttgcatgtttgtcagcgagtttccgcatcatttatactatgttaggacttatagggttatgagttcctggatagtctacctgaggctgggactcgcgtggatattgaataccagcttttcgttcaccatc

SEQ ID NO: 985 - DNA, 1676 bp, Hordeum vulgare
tctctttccgccctccgcaacctcacgagactcccccaaccccaggcgaccctcctcggcggcggcggcgcggacggtgatgcagatggcggcgaccaccaccgaatcacaggtggccgtgccgcctcaccaaccccacgcgcacccgcatccgcacccgcctccgcatcacgcgcacccgcaccaccacatgccgcagccgcggtgggtcgtcctcccctacccgccgccgtccatggtggccgccccgcccccgccgccgccgcagttcgccaagcactacgcgccggggccgccgcctccgcccgccgcggccgggcgacgcacgcccacgccacccgcggccggatccggcgggaacggctgcgaggagaacaagacgatctgggtcggcgacctccagtactggatggacgagaactacctccataactgcttcggccccagcggcgaggtggtaaccataaaagttatccgcaataggcaaactggacaatcagagggatatggttttgtagagttcttttcccatgcatcagcggataaagctcttcagaattttactggtcatgtgatgcccaacactgatcgagcctttaagttaaactgggcatcctatagcatgggtgaaaagcgatcagaagttgtctctgaccactcaatttttgttggtgatttagctgctgatgttaccgatgaaatgttgatggagctttttggtagcaagtatcgctccgtgaaaggagctaaagttattattgatgcaaacactggccgttctaggggctatggatttgttagatttggagatgatactgacaaagctcatgcaatgactgaaatgaacggtgtttattgctctactagacctattcgtataggacctgcaacgcctagaagaacctctggtgattctggttcctcaacacctggccattcagatggcgattcaaataacagaacggtatatgttggtgggctcgaccaaaatgttagtgaagacgagctgaggaaatcatttgccaaatatggtgatgttgcctctgtgaaaattcctctagggaagcagtgtggctttgttcagtatgtcaacagaactgacgcagaagaagcacttcaagggttgaatggggctgtcattggaaagcaggcagttcgcctttcgtggggccgcagcccatcacataaacagtctaggggtgattctggcaacaggaggaacaacaacaatatgtactatggcacgccgttctatggtgggtacggctacgcctcccctgtcccgcaccccaacatgtatgcccctgcgtatggagcctacccgttctacggcaaccagcagttggtgagctagagcgagagagcttcgtcccactccctccaatgggaaacaaggttttgatccggtgagagcatagcagcgtcagcagagtaagagagagagagtgagtgagagagagagagagaggttataggtcgtcctaaaaagtgggtaagacaggttaaagtgaaagaaacagtggtgtctgtattctgttgtgtgtgtgtgtgtgtggtgtttgtgtatgtgttgcaagaaccagaagagcctctaggcttgtagacacggtcggagagtcatggatgttgattcattaagaagttttgacttgcttaataagttacaacgctgtttg

SEQ ID NO: 986 - DNA, 1519 bp, Secale cereale
tcatccccggccatccccgtccccgttgccaccttgaaccgacgactcccgtcctccacacggtggcgcggccgcgagagatccacaagcttcaccggctgccccgtcagataaaaccacgggagcaccagtcagaaaaaagcaccggtcggaagcaaaggccaaacaaacaccaacgtcagtcaaggcgagaagcaactgccagagccagagccaaccagcctcagcgcgcgcgtgcgtgtgtggtggtgggaagttcgcagcttggctgtggggctacagcagcggcagcgatggcggcgtccgtggccacctccccggcctgcagccggctcatccccagcagccccctctccgcctcggcttacacggccgcgccgtcgctcgtccgcctggcggggtcctccaggcgcctccgccgggccctgcgcgtctcggccgcggcggagccggccgacgcgctgccgggggccgggtccggggagctggacggggtggtgccggcggggctgctcgaggagctgccggagggcctcgccttccagggcgacgtggcggggggttcgcccccggcggcagcggcggaggcggcgacgacggcaacaagatgctcgaccgcggcatcaacgccgccatcgtgctcggcgccagcacctacgcgctcaccaagctcctcaccgtcgaccaggactactggcatgggtggaccatctttgagatcctgcggtacatgccggagcacaactggtcggcgtacgaggaggccctcaaggccaatccggttcttgccaagatgatgatcagcggcgtcgtctattccctcggcgactggatagcccagtgttacgaagggaagcccatcttcgagtttgaccgcactcgtatgttccggtctggcctcgtagggttcaccctccacggatccctttcgcactactactaccatttctgcgagtcgctgtttccgttcaaggattggtgggctgtgcctgtcaaggttgcgtttgatcagacggcttggtctgccctgtggaacagcatctacttcgtcgccctgggcttccttcgctgggaatctccgtccaccatattcagcgagctcaaggccaccttcttccccatgcttactgctggatggaagctgtggccatttgcacacttaatcacatatggtgtggttcctatcgaacaaagacttctctgggtcgactgtgtcgaattaatctgggtcaccatcttgtcaacttactcgaacgagaaatctgaagcaaggatcttggatgattcctccacaacagatacgcaggacaactccagatagcacatacttcatggttttgctgttttatagatagaaacagcagaaactgctccggcttcgttacgttgggattgtataaattgtatgtacagttagttgccagcgccgcgtgtgtaaaaaatccttgcatctattgcaagcaaattgtgctggtcaaacagaaccgaaaaagaaattgtctcaaggagatcaactcct

SEQ ID NO: 987 - DNA, 1512 bp, Secale cereale
accgacgactcccgtcctccacacggtggcgcggccgcgagagatccacaagcttcaccggctgccccgtcagataaaaccacgccagcaccagtcagaaaaaagcaccggtcggaagcaaaggccaaacaaacagcaacgtcagtcaggcgagaagccagttccagagccagagccaacctcagcgcgcgcgtgcgtgtgtggtggtgggaagttcgcagcttggctgtggggctacagcagcggcagcgatggcggcgtccgtggccacctccccggcctgcagccggctcatccccagcagccccctctccgcctcggcttacacggccgcgccgtccctcgtccgcctggtggggtcctccaggcgcctccgccgggccctgcgcgtctcggccgcggcggagccggccgacgcgctgccgggggccggtccggggagctggacggggtggtgccggcggggctgctcgaggagctgccggagggcctcgccttccagggcgacgtgggcggggggttcgccccggcggcagcggcggcggcggcgacgacggcaacaagatgctcgaccgcggcatcaacgccgccatcgtgctcggcgccagcacctacgcgctcaccaagctcctcaccgtcgaccaggactactggcatgggtggaccatctttgagatcctgcggtacatgccggagcacaactggtcggcgtacgaggaggccctcaaggccaatccggttcttgccaagatgatgatcagcggcgtcgtctattccctcggcgactggatagcccagtgttacgaagggaagcccatcttcgagtttgaccgcactcgtatgttccggtctggcctcgtagggttcaccctccacggatccctttcgcactactactaccatttctgcgagtcgttgttcccgttcaaggattggtgggctgtgcctgtcaaggttgcctttgatcagacggcttggtctgcgctgtggaacagcatctacttcgtcgccctgggcttccttcgctgggaatctccgtccaccatattcagcgagctcaaggccacctctcccgatgcttactgctggatgaagctgtggccatttgcacacttaatcacatatggtgtggttcctattgaacaaagacttctctgggtcgactgtgtcgaattaatctgggtcaccatcttgtcaacttactcgaacgagaaatctgaagcaaggatcttggatgattcctccacaacagatacgcaggacaactccagatagcacatacttcatggttttgctgttttatagattgaaacagcagaaactgctccggcttcgctacgttgggattgtataaatttgtataaattgtttgtacagttagttgccagcgctgcttatgtaaaaaatccttgcatctattgcaagcaaattgtgctggccaagcaaaaccgaaaaagaaattgtctcaagggagatcaactcctgatgaaatatgagtttgtgcagcaacca

SEQ ID NO: 988 - DNA, 1573 bp, Secale cereale
cagccggctcatccccagcaaccccctctccgcctcggcttacacggccgcgccgtccctcgtccgcctggcggggtcctccaggcgcctccgccgggccctgcgcgtctcggccgcggcggagccggccgacgcgctgccggggcctggcgccggcgacctggacggggtggtgccggccgggctgctggaggagctgccggagggcctcgccttccagggcgacgtgggcggagggttcgcccccggcggcagcggcgggggcggcgacgacggcaacaagatgcttgaccgcggcatcaacgccgccatcgtgctcggcgccagcacctacgcgctcaccaagctcctcaccgtcgaccaggactactggcatggttggactatctttgagatcctgcggtacatgccggagcacaactggtcggcgtacgaggaggccctcaaggccaatccggttcttgccaagatgatgatcagcggcatcgtctattccctcggcgactggatagcccagtgttacgaagggaagcccatcttcgagtttgaccggactcgtatgttcaggtctggcctcgtagggttcaccctccacggatccctttcgcactactactaccatttctgcgagtcgctgtttccgttcaaggattggtgggctgtgcctgtcaaggttgcgtttgatcagacggcttggtctgcgctgtggaacagcatctacttcgtcgccctgggcttccttcgctgggaatctccgtccaccatattcagcgagctcaaggccaccttcttccccatgcttactgctggatggaagctgtggccatttgcacacttaatcacatatggtgtggttcctattgaacaaagacttctctgggtcgactgtgtcgaattaatctgggtcaccatcttgtcaacttactcgaacgagaaatctgaagcaaggatcttggatgattcctccacaacagatacgcaggacaactccagatagcacatacttcatggttttgctgttttatagattgaaacagcagaaactgctctggcttcgctacgttgggattgtataaatttgtataaattgtatgtacagttagttgccagcgctgcttgtgtaaaaaatccttgcatctattgcaagcaaattgtgctggccaagcaaaaccgaaaaagaaattgtctcaagggagatcaactcctgatgaaatatgagtttgtgcagcaaccatgattttgagtcgcttatggtggtaccaaggaatgcttgatgaaactatgcaagcatgcaaaaaaaagaaaaggacaagcagcaaaacacgagaagttctaaacatttggcagatctgtctttcctaaattgcatctgatggacatatgtctgaacaaaggaagcgcggtgcgaggattatagaactgtagaacacaactcctagccaacatttcatagcaaagaacgacatttttctgcacaagtagagaaatagagatactatagcattgtggtatatatgtgtagcaccgttgtgggatcatatatatatgcccctgcttgacagacgcacaaaaa

SEQ ID NO: 989 - DNA, 1384 bp, Leymus cinereus x Leymus triticoides
  misc_feature (4)..(4): n is a, c, g, or t
gcanacgctaaacaaacaccaacgtcagtcaaggcgagaagcaagggccagagccaaccagcctcagcgcgcgcgtgcgtgtgtggtggtggggggttcgcagcttggctgtggggctagagcggcagcgatggcggcgtccgtggccacctcccccgcctgcagccggctcatccccagcagccccctctccgcctccgcttccaccgccgcgccgtctctcgtccgcctggcgggatcctccaggcgcctccgccgcgccctgcgcgtctctgcctcggcggagccggccgacgtgctgccgggacccggggccggcgagctggatggggtggtgccggcggggctgccggagggcctcgccttccagggcgacatgggcgggggattcgcccctggcggcagcggcggcggcggcgacgatggcaacaagatgctcgaccgcggcatcaacgcggccatcgtgctcggcgccagcacctacgcgctcaccaagctcctcaccgtcgaccaggactactggcatgggtggactatctttgagatcctgcggtacatgccggagcacaactggtcggcgtacgaggaggccctcaaggccaatccggttcttgttaagatgatgatcagcggcgtcgtctattccctcggcgactggatagcccagtgttacgaagggaagcccatcttcgagtttgaccgtacccgtatgttccggtctggcctcgtagggttcacccttcagggatccctttcgcactactactaccatttctgcgagtcgttgtttccgttcaaggattggtgggctgtgcctgtaagggttgcgtttgatcagacggcttggtctgcgctgtggaacatcatctacttcgtcgccctgggcttccttcgctgggaatctccgtccaccatattcagcgagctcaagtccaccttctttcccatgcttactgctggatggaagctgtggccatttgcacacttaattacatacggtgtggttcctatcgaacaaagacttctctgggtcgactgtgtcgaattaatctgggtcaccatcttgtcaacttactcgaaagagaaatctgaagcaaggatcttagacgattcctccacaacagatacgcaggacaactccagatagcacatacttcatggttttgctgttttatagattggaacagcagaaactgctccggcttcgttactttgggattgtataaattgtatgtacagttagttgccagcgctgcgtgtgtaaaaaaaccttgcatctattgcaagcaaattgtgctggccaaacaaaaccaaaaagaaattgtctcaagggagatcaactcttgatgaaaatatgagttgtgcatttgatggacaaaaaaaa

SEQ ID NO: 990 - DNA, 1189 bp, Triticum aestivum
cctctccgcctcggcttacacggccgcgccgtccctcgttcgcctggcggggtcctccaggcgcctccgccgggccctgcgcgtgtcggccgcggcggagccggccgacgcgctgccggggcccggggccggcgatctggacggggtggtgccggcggggctgctcgaggagctgccggagggcctcgccttccagggcgacgtgggcggggggttcgcccccggcggcggcggcgacgacggcaacaagatgctcgaccgcggcatcaacgccgccatcgtgctcggcgccagcacctacgcgctcaccaagctcctcaccgtcgaccaggactactggcatgggtggactatctttgagatcctgcggtacatgccggagcacaactggtcggcgtacgaggaggccctcaaggccaacccggttcttgccaagatgatgatcagtggcgtcgtctatcccctcggcgactggatagcccagtgttacgaagggaagcccatcttcgagtttgaccgcactcgtatgttcaggtctggcctcgtagggttcaccctccatggatccctttcgcacaactactaccatttctgcgagtcgttgttcccgttcaaggattggtgggctgtgcctgtcaaggttgcgtttgatcagacggcttggtctgcgctgtggaacagcatctacttcgtcgccctgggcttccttcgctgggaatctccgtccaccatatacaaagagctcaaggccaccttcttccccatgcttactgctgggtggaaactgtggccatttgcacacttaatcacatacggtgtggttcctatcgaacaaagacttctctgggtcgactgtgtcgaattaatctgggtcactatcttgtcaacttactcgaacgagaaatctgaagcaaggatcttagacgattcctccacaacagacacgcaggacaactccagatagcacatacttcatggttttgctgttttatagattgaaacagcagaaactgctccggcttcgctacgttgggattgtataaattgtatgtacagttagttgccagcgctgcgtgtgtaaaaaaatccttgcatctattgcaagcaaattgtgctggccaaacaaaaccgaaaaagaaattgtctcaagggagatcaactcctgatgaaatatgagttgtgcagcaac

SEQ ID NO: 991 - DNA, 1161 bp, Triticum aestivum
cctctccgcctcggcctacacggccgcgccgtccctcgtccgcctggcggggtccaccaggcgcctccgccgggccctgcgcgtctcggccgcggcggagccggccgacgcgctgccggggcccggggccggcgagctagacggggtggtgccggcggggctgctcgaggagctgccggagggcctcgccttccagggcgacatgggcggggggttcgcacccggcggcggcggcggggacgacggcaacaagatgctcgaccgcggcatcaacgccgctatcgtgctcggcgccagcacctacgcgctcaccaagctcctcaccgtcgaccaggactactggcatggatggaccatctttgagatcctgcggtacatgccggagcacaactggtcggcgtacgaggaggccctcaaggccaatcctgttcttgccaagatgatgatcagcggcgtcgtctactcccttggcgactggatagcccagtgttacgaagggaaacccatcttcgagtttgaccgcactcgtatgttcaggtctggccttgtagggttcaccctccacggatccctttcgcactactactaccatttctgcgagtccttgttccctttcaaggattggtgggcagtgcctgtcaaggttgcgtttgatcagacggcttggtctgccctgtggaacagcatctacttcgtcgccctgggcttccttcgctgggaatctccatccaccatattcagagagctcaaggccaccttcttccccatgcttactgctggatggaagctatggccatttgcacacttaattacgtatggtgtggttcctatcgaacaaagacttctctgggtcgactgtgtcgaattaatctgggtcaccatcttgtcaacttactcgaacgagaaatctgaagcaaggatcttagatgattcctccacaacagatacgcaggacaactcaagatagcacatacttcatggttttgctgttttatagattggaacagcagaaactgctccggcttcgttacggttgggattgtattaattgtatgtacagttagttgccagtgctgcgtgtgtaaaaaagccttgcatctattgcaagcaaattgtgctggccaaacaaaaccgaaaaagaaattgtctcagggagatcaa

SEQ ID NO: 992 - DNA, 1202 bp, Triticum aestivum
ggggtcctccaggcgcctccgccgggccctgcgcgtctcggccgcggcggagccggccgacgcgctgccggggcccggggccggcgatctggacggggtggtgccggcggggctgctcgaggagctgccggagggcctcgccttccagggcgacgtgggcggggggttcgcccccggcggcggcggcgacgacggcaacaagatgctcgaccgcggcatcaacgccgccatcgtgctcggcgccagcacctacgcgctcaccaagctcctcaccgtcgaccaggactactggcatgggtggactatctttgagatcctgcggtacatgccggagcacaactggtcggcgtacgaggaggccctcaaggccaacccggttcttgccaagatgatgatcagtggcgtcgtctattccctcggcgactggatagcccagtgttacgaagggaagcccatcttcgagtttgaccgcactcgtatgttcaggtctggcctcgtagggttcaccctccatggatccctttcgcactactactaccatttctgcgagtcgttgttcccgttcaaggattggtgggctgtgcctgtcaaggttgcgtttgatcagacggcttggtctgcgctgtggaacagcatctacttcgtcgccctgggcttccttcgctgggaatctccgtccaccatatacaaagagctcaaggccaccttcttccccatgcttactgctgggtggaaactgtggccatttgcacacttaatcacatacggtgtggttcctatcgaacaaagacttctctgggtcgactgtgtcgaattaatctgggtcactatcttgtcaacttactcgaacgagaaatctgaagcaaggatcttagacgattcctccacaacagacacgcaggacaacaacttcagatagcacatacttcatggttttgctgttttatagattgaaacagcagaaactgctccggcttcgttacgttgggattgtataaattgtatgtacagttagttgccagcgctgcgtgtgtaaaaaaaacttgcatctattgcaagcaaattgtgctggccaaacaaaaccgaaaaagaaattgtctcaagggagatcaactcctgatgaaatatgagttgtgcagcaaccatgattttgagtcgcttttggtggtaccaaagagtgcttgatgaaactatgcaagcgt

SEQ ID NO: 993 - DNA, 1401 bp, Avena sativa
gagagacaaaagcccaactgcccaagccaaccagcgtcagccggcgcgtgtggtgggacaagtttttagcttggctagcggaggagaggcgctccttgcgatggcggcagccgtggcgaccgtggcctccacccctgcctcccggcggctccccgcccaccccctctccgcctccaccgccgcgccgtctctcgtccgcctgcccggatcctccaggcgcctccgccgcgccatgcgcgtctcggccgcggccgaggacgccgacgcgctgccggggccgggcgccggcgacttggagatggtgccggcggggcttctggaggacctgccgctgccggagggcagccagctcggcatcggagggctcgccttccagggcgacatgggcgggggattcgcccctggcggcggcgacggcggcggcaacaagatgctcgatcgcggcatcaacaccgccatcgtgctcggcgccagcacctacgcgctcaccaagctcctcaccgtcgaccaggactactggcatgggtggaccatcttcgagatcctgcgctacatgccggagcacaactggtccgcctacgaggaggccctcaagaccaacccggtcctcgccaagatgatgatcagtggcgtcgtttattccctcggtgactggattgcccagtgctacgaagggaagccgatcttcgagttcgaccgcacccgcatgttccggtctggcctcgtaggcttcatgctccacggatccctttcgcactactactacagtttctgcgagtccttgttcccgttcaaggattggtgggctgttcctgtgaaggttgcgttcgatcagacggcttggtctgcgctgtggaacagcatctacttcgtcgccctaggcttccttcgttgggagtctccgtccaccatattcagcgagctcaagtccaccttctttcccatgcttactgctggatggaagctatggccttttgcacacttaattacatacggtgtagttccccttgaacaaagactcctctgggtcgactgtgtggaactcatctgggtcacgatcttgtcaacttactcaaacgagaaatctgaagcaaggatttcagatggtccctccataccagcagattcagaggacaactcaagatagcaccaccggatatcatcgttctgctattgtatagattgtaacgtagaaaaagtctgcattgttctggaattgtacaaattgctggtgtaaccttgtatggtgaacaagctgtgctgggcataaaggtatctatagttggtcccttaagattggttggaggagtaaaatttccattctactctaaaactgcacctagccaatccctcaacaatagtcagaggagtaaaattatattataagagtcacccctaaaa

SEQ ID NO: 994 - DNA, 1335 bp, Avena sativa
tcagtgagagacaaaagcccaactgcccaagccaaccagcgtcagccggcgcgtgtggtgggacaagtttctagcttgcctagcggaggagaggcgctccttgcgatggcggcagccgtggcgaccgtggcctccacccctgcctcccggcggctccccgcccaccccctctccgcctccaccgccgcgccgtctctcgtccgcctgcccggatcctccaggcgcctccgccgcgccctgcgcgtctcggccgcggccgaggacgccgacgcgctgccggggccgggcgccggcgacctcgagatggtgccggcggggctgctggaggaccttccgctgccggagggcagccagctcggcatcggagggctcgccttccagggcgacgtgggcgggggattcgcccctggcggcggcgacggcggcggcaacaagatgctcgatcgcggcatcaacaccgccatcgtgctcggcgccagcacctacgcgctcaccaagctcctcaccgtcgaccaggactactggcatgggtggaccatcttcgagatcctgcgctacatgccggagcacaactggtccgcctacgaggaggccctcaagaccaacccggtcctcgccaagatgatgatcagtggcgtcgtttattccctcggtgactggattgcccagtgctacgaagggaagccgatcttcgagttcgaccgcacccgcatgttcaggtctggcctcgtaggcttcatgctccacggatccctttcgcactactactacagtttctgcgagtccttgttcccgttcaaggactggtgggctgttcctgtgaaggttgcgtttgatcagacggcttggtctgcactatggaacagcatctacttcatcaccctaggcttccttcgctgggagtctccgtccaccatattcagcgagctcaagtccaccttctttcccatgcttactgctggatggaagctatggccttttgcacacttaattacatacggtgtagttccccttgaacaaagactcctctgggtcgactgtgtggaactgatctgggtcacaatcttgtcaacttactcaaacgagaaatctgaagcaaggatttcagatggtccctccatatcagcagattcagaggacacctcaagatagcaccaaatatcatcgttctgctattgtatagattgtaacgcagaaaaaaaagtactgcattgttctggaattgtacaaattgctggtgtaaccttgtacggtaaacaagctgtgctgggcataaaggtatctttagttggtcccttaaaatctgttggagtagtaaaatttccgttctactct

SEQ ID NO: 995 - DNA, 1376 bp, Avena sativa
caaaagcccaactgcccaacccaaccagcgtcagccggcgcgtgtggtgggacaagtttttagcttgcctagcggaggagaggcgctccttgcgatggcggcagccgtggcgaccgtggcctccacccctgcctccagggccaggcggctccccgcccaccccctctccgcctccaccgccgcgccgtctctcgtccgcctgcccggatcctccaggcgcctccgccgcgccatgcgcgtctcggccgcggccgaggacgccgacgcgatgccggggccgggcgccggcgacctggagatggtgccggcggggctgctggaggacctgccgctgccggagggcacccagctcggcatcggagggctcgccttccagggcgacgtgggcggggggttcgcccctggcggcggcgacggcggcggcaacaagatgctcgatcgcggcatcaacaccgccatcgtgctcggcgccagcacctacgcgctcaccaagctcctcaccgtcgaccaggactactggcatgggtggaccatcttcgagatcctgcgctacatgccggagcacaactggtccgcctacgaggaggccctcaagaccaacccggtcctcgccaagatgatgatcagtggcgtcgtctactccctcggtgactggattgcccagtgctacgaagggaagccgatcttcgagttcgaccgtactcgcatgttccggtctggcctcgtaggcttcatgctccacggatccctttcgcactactactacagtttctgcgagtccttgttcccgttcaaggattggtgggctgttcctgtgaaggttgcgttcgatcagacagcttggtctgcgctatggaacagcatctacttcgtcgccctaggcttccttcgttgggagtctccgtccaccatattcagcgagctcaagtccaccttctttcccatgcttactgctggatggaagctatggccttttgcacacttaattacatacggtgtagttccccttgaacaaagactcctctgggtcgactgtgtggaactgatctgggtcacaatcttgtcaacttactcaaacgagaaatctgaagcaaggatttcagatggcccctccataccagcagattcagaggacacctcaagatagcactagatgtcgtcgttctgctattgtatagattgtaacgatagaaaaaaaaagtactgcattgttctggaattgtacaaattgctggtgtaaccttgtatggtgaacaagctgtgctgggcataaaggtatctatagttggtcccttaagatcggttagaggagtaaaatttatgttctgctctaaaactgcacctagccaatccctcaacaatagtcagaggagtaa

SEQ ID NO: 996 - DNA, 1364 bp, Avena sativa
cagtgagagacagaagaccaactgcccaagccaaccagcatcagcgggcgcgtgtggtgggagaagtgctacttgcgatggcggcagccgtggcgaccgtggcctccacccctgcctccagggccaggcggctccccgcccaccccctctccgcctccaccgccgcgccgtccctcatccgcctgcccggatcctccaggcgcctccgccgcgccctgcgcgtctcggccgcggccgaggacgccgacgcgctgccggggccgggcgccggcgacctggagatggtgccggtggggctgctggaggacctgccgctgccggagggcacccagctcggcatcggagggctcgccttccagggcgacatgggcggggggttcgcccctggcggcggcgacggcggcggcaacaagatgctcgatcgcggcatcaacaccgccatcgtgctcggcgccagcacctacgcgctcaccaagctcctcaccgtcgaccaggactactggcatgggtggaccatcttcgagatcctgcgctacatgccggagcacaactggtccgcctacgaggaggccctcaagaccaacccggtcctcgccaagatgatgatcagtggcgtcgtctactccctcggtgactggatagcccagtgctacgaagggaagccgatcttcgagttcgaccgaacccgcatgttccggtctggcctcgtaggcttcatgctccacggatccctttcgcactactactacagtttctgcgagtccttgttcccgttcaaggattggtgggctgttcctgtgaaggttgcgttcgatcagacggcttggtctgcgctgtggaacaacatctacttcgtcgccctaggcttccttcgttgggagtctccgtccaccatattcagcgagctcaagtccaccttctttcccatgcttactgctggatggaagctatggccttttgcacacttaattacatacggtgtagttccccttgaacaaagactcctctgggtcgactgtgtggaactcatctgggtcacgatcttgtcaacttactcaaacgagaaatctgaagcaaggatttcagatggtccctccataccagcagattcagaggacaactcaagatagcaccaccggatatcatcgttctgctattgtatagattgtaacgtagaaaaagtctgcattgttctggaattgtacaaattgctggtgtaaccttgtatggtgaacaagctgtgctgggcataaaggtatctatagttggtcccttaaaatcggttgaaggagtaaaatttccattctactctaaactagcacctagtcaatccctccaacaatagtcagaggagtaaattaata

SEQ ID NO: 997 - DNA, 1104 bp, Festuca arundinacea
ggcacgaggctaaaccaagaaacaaagcccaaaccaaccagcgtcagcgcgcgcggcgcgtgtggtgggggaagtttagcttggctgtgggtcagtttagcagaggagaggagctccttgcgatggcggcagccgtggcgaccgtccctgcctccaggcggctccccgcccaccccctctccgcctccaccgccgcgccgtccctcatccgcctggcgggatcctccaggcgcctccgccgtgccctgcgagtctcggccgcggcggaggaggccgacgtgctgccggggccgggtgctggcgagctggagatgctgccggcggggctgctggaggacctgccggagggcgcgctcgggggcagccagctcgacatcggagggctcgccttccagggcgacatcggcgggggattcgcccccggtggcagcaccggcggcaacaagatgctcgatcggggcatcaacacggccatcgtgctcggcgccagcacctacgcgctcaccaagctcctcaccgtcgaccaggactactggcatgggtggaccatctttgagatcctgcgctacatgccggagcacaactggtcggcctacgaggaggccctcaagaccaacccggttctcgccaagatgatgattagtggcgtcgtttactccctaggtgactggatagcccagtgttacgaagggaagcccatctttgagtttgaccgtactcgtatgttccgctctggcctcgtaggcttcacgcttcatggatccctttcgcactactactaccatttctgcgagtcgctgtttccgttcaaggactggtgggctgttcctgtaaaggttgcatttgatcagacagcttggtcggcgctgtggaacagcatctacttcgtggccttaggcttccttcgttgggaatctccatccaccatattcagcgagctcaaagccaccttctttcccatgcttactgctggatggaagctgtggccttttgcacacttaattacatacggtgtagttcccgttgaacaaagactcctctgggttgactgtgtggaactgatctgggtcactatcctgtcaacttactcaaatgagaaatctg

SEQ ID NO: 998 - DNA, 1226 bp, Pseudoroegneria spicata
ggggtgtggggttcgcagctcgcagcttggctgcggggctagagcagcagcgatggcggcgtccgtggccttctcccccgcctgcaggcggctcccctgcaaccccctctccgcctccgcctccaccgccgcgccgtctctcgtccgcctggcgggatcctccaggcgcctccgccgcgcctctgccacggcggagccgggacccggggccggcgagctgctcgaggagctgccggagggcctcaacaagatgctcgaggagctgccggagggcctcaacgacggcaacaagatgctcgaccgcggcatcaacgcggccatcgtgctcggcgccatcaccttggcgctcaccaagctcctcaccgtggaccaggactactggcatgggtggactatcttggagatcctgcggtacatgccggagcacaactggtgggcgtacgaggaggccctcaaggccaatccggttcttgctaagatgatgatcagtggcatcgtctattccctcggcgactggatagcccagtgttacgaagggaagcacatcttcgagtttgaccgtactcgcatgttccggtctggcctcatagggttcacccttcagggatccctttcgcactactactacaatttctgcgagtcggtgtttccgttcaaggattggtgggctgtacctgtcaaggctgcatttgatcagacggcttggtctgcgctgtggaacagcatctacttcgtcgccttgggattccttcggtgggaatctccgtccaccatattcagcgagctcaagtccaccttcttccccatgcttactgctggatggaagctgtggccatttgcacacttaattacatatggtgtggttcctatcgaacatagacttctctgggtcgactgtgtcgagttaatctgggtcaccatcttgtcaacttactcgaacgagaaatctgaagcaaggatcttagacgattcctccacaacagatacgcgggacaactccagatagcacatacttcatgttttgttgttttatagattggaacaacagaaactgctccggcttgctttgggattgtataaattgtatgtacagttagttaccagtgctgcgtgtgtaaaaaaccttgcatctattgcaaacaaattgtgctggccaaacaaaaccgaaaataaatggtctcaagggagatcaactcctgatgaaaatttgagttgtgcaaaaaaaa

SEQ ID NO: 999 - DNA, 1402 bp, Triticum aestivum
caccaatgtctcatttatgagagccaaccagcctcagcgcgcgcgcgcgtgtggtggtgtggggttagagcagcagcgatggcggcgtccgtggccttctcccccgaatgcaggcggctcccctgaaaccccctctccgcctccggctccaccggagcgctgtctctcgtgcgcctggcgggatcctcaaggcgcctccgacgagcctgtgccatggcggagccggccgacgtgctgccgggatccggggccggcgagctggacgggctggtgccggaggggctgctcaaagagctgccggagggcctcgccttccagggcgccgctggcggcagcggaggcggcggcggccacacgatgctcgaccgggggatcaacgcggacatcgtgctcggcgccatcaccttcgggctcaccaagctcctcaccgtcgaccacgactattggcatgggtggactatcttggagatcctgcggtacatgccagagcacaactggtcggcgtacgaggaggccctcaaggccaatccggttcttgttaagatgatgatcagtggcgtcgtgtatcccctgggcgactggatagcccagtgttgcgaagggaagcccatcttcgagtttgaccgtgctcgcatgttccggtctggcctcataggcttcacccttcagggatctctttcccactactactacaatttctgcgagtcggtgtttccgtacaaggattggtgggctgtacctgtcaaggctgcatttgatcagacggcttggactgcgctgtggaacaccatctacttcgtctccttgggattccttcggtgggaatctccgtccaccatattcagcgagctcaagtccaccttcttccccatgcttactgctggatggaagctgtggccatttgcacacataattacatatggtgtggttcctatcgaacatagacttctctgggtcgactgtgtcgagttaatctgggtcaccatcttgtcaacttactcgaacgagaaatctgaagcaaggaccttagacgattcctccacaacagatacgcgggacaattccagatagcacatacttcatgttttgttgttttatacttcctccgtccgaaaaaaattgtcccaagcttgttcctcaaatagatgtatctagcaccaaattagtgctagatacattcatttgagaaacaaactttttcagacggagggagtagattggaacaacagaaactgctccggcttgctttgagattgtataaattgtatgtacagttagttaccagtgctgcgtgtgtaaaaaaccttgcatctattgcaaacaaattgtgctggccaaacaaaaccgaaaataaatggtctcaagggagatcaactcctgatgaaaatttgagttgtgcagc

SEQ ID NO: 1000 - DNA, 1281 bp, Triticum aestivum
aatgtcttttttttgagagccaaccagcctcagcgcgcgcgcgcgtgcgtgtggtggcgtcggggctagagcagcagcgatggcggcgtccgtggccttctcccccgcatgcaggcggctcccctgcaaccccctctccgcctacaccgccgcgccgtctctcgtccgcctggcgggaacctccaggcgcctccgccgcgcctgtgcctcggcggagccggccggcgagctggacgggctggtgccggcggggctgctcgaggagctgccggagggcctcgccttccagggcgcccctggcggcagcggaggcggcggcggccacacgatgctcgaccgcggcatcaacgcggccatcgtgctcggcgccatcaccttcgcgctcaccaagctcctcaccgtcgaccaggactactggcatgggtggactatcttggagatcctgcggtacatgccacagcacaactggtcggcgtacgaggaggccctcaaggccaatccgcttcttgttaagatgatgatcagtggcatcgtctattccctcggcgactggatagcccagtgttgcgaagggaagcccatcttcgagtttgaccgtgctcgcatgttccggtctggcctcatagggttcacccttcagggatctctttcccactactactacaatttctgcgagtcggtgtttccgtgcaaggattggtgggctgtacctgtcaaggctgcatttgatcagacggcttggtctgggctgtggaacaccatctacttcgtcgccttgggattccttcggtgggaatctccgtccaccatattcagcgagctcaagtccaccttcttccccatgcttactgctggatggaagctgtggccatttgcacacttaattacatatggtgtggttcctgtcgaacatagacttctctgggtcgactgtgtcgagataatctgggtcaccatcttgtcaacttactcaaacgagaaatctgaagcaaggatcttagacgattcctccacaacagatacgcgggacaactccagatagcacgtacttcatgttttgttgttttatactccctctttccgaaaatataagaatgtttttaacactacactagtgtaaaaaacgttcttatattatggaacggagggagtagattggaacaacagaaactgctccggcttgctttgagattgtataagttgtatgtacagttagttaccagtgctgcgtgtgtaaaaaaaaccttgcatctattgcaaacaaattgtgctggccaaaca

SEQ ID NO: 1001 - DNA, 1264 bp, Secale cereale
ccaatgtcttttctttgagagccaaccagcctcagcgcgcgcgcgcgtgcgtgtggtggtgcggggctagagcagcagcgatggcggcgtccgtggccttctcccccgcatgcaggcggctcccctgcaacccactctcggcctccaccgccgcgccgtctctcgtccgcctggcgggatcctccaggcgcctccgccccgcctctgccacggtggagccggccgacgtgctgccggtgccgggatccggggccggcgagctggacggggtggtgccggcggcggccgtgctcctagaggagctgccggagggcctcgccttccagggcgcccctagcggcagcggcggcgacaagatgctcgacctcggcatcaacgcggccatcgtgctcggcgccatcaccttcgcgctcaccaagctcctcaccgtcgaccaggactactggcatgggtggactatcttcgagatcctgcggtacatgccacagcacaactggtcggcgtacgaggatgccctcagggccaatccgcttcttgttaagatgatgatcagtggcatcgtctattccctcggcgactggatagcccagtgttgcgaaggcaagcccatcttcgagtttgaccgtactcgcatgttccggtctggcctcatagggttcgcccttcagggatctctttcccactactactacaatttctgcgagtcggtgtttccgtacaaggattggtgggctgtacttatcaaggctgcatttgatcagacggcttggtcggggctgtggaacaccatctacttcgtcgccttgggattccttcggtgggaatctccgtccaccatattcagcgagctcaagtccaccttcttccccatgcttactgctggatggaagctgtggccatttgcacacataattacatatggtgtggttcctatcgaacatagacttctctgggtcgactgtgtcgagttaatctgggtcaccatcttgtcaacttactcgaacgagaaatctgaagcaaggatcttagacgattcctccacaacagatacgcgggacaactccagatagcacatacctcatgttttgttgttttatagattggaacaacagaaactgctcgggcttgctttgaaattgtataaattgtatgtacagttagttaccagtgctgcttgtgtaaaaaaccttgcatctattgcaaacaaattgtgctggccaaacaaaaccgaaaataaatggtcgcaagggagatcaactcctga

SEQ ID NO: 1002 - DNA, 1706 bp, Brachypodium distachyon
gaaaaacaaggggaaacaaccatcgtcagcttcagccttcagcgcgcgcgcgtgtggtgcgggaggttcgagcagcccaggagcgccgtggcgatggcggcggccgtggcctcctcccccttccccgcctccaggcggctgcctagcaaaaaccacatcccggcttgccccgccgccccctccctcctccgcctggcggggggatcctcatcgaggcgcaggcgcctccgccgggccctgcgcgtctcggccgcgccggaggaggctgacgtgctgccggggcctggggtcatcgagctggagatggtctcggcggggctgctggaggagctcccggtggacccgctcgggggcagccagctcgacatcggcgggctcgccttccagggcgacgtgaccggcggcttcaccagtggcggcagcggtggggctggcgccggaggcgatggggggaacaagatgctggatcgcggcatcaacacggccatcgtgctcggcgccagcacctacgcgctcaccaagctcctcaccgtcgaccaggactactggcatgggtggaccatctttgagatcctgcgctacatgccggagcacaactggtctgcctacgaggaggccctcaagaccaacccagttcttgccaagatgatgattagcggcgtcgtttactccctcggcgactggattgcccagtgttatgaagggaagccgatctttgagtttgaccgaactcgtatgttccgttctggccttgtagggttcacactccacggttccctttcgcattactactatcatttctgtgagtctttgtttccattcaaggattggtgggctgttcctgtaaaggttgcatttgatcagacggcttggtctgcattgtggaacagcatctacttcgtggtcttgggctttctccgtttcgaatctccggtcaccatattcagcgagctcaagtccacgttctttcccatgcttactgctggatggaagttatggccgtttgcacacttaattacatacggtgtagttcctgttgaacaaagacttctctgggtcgactgtgtggagctaatctgggtcaccatcttatcaacttactcaaatgaaaaatctgaagcacgaatttcggatgcctccacatcaacagactcccaggacaactccagatagcaccagaattcatcattttgctacctaaagattgtaacaagggaaactgccttgccttcggttaattgggattgtataaaatgtacagttagttaccagttctgcgtgtgtaaccatgcttctacagcctacggactgtgctgggcaaacaaaatcaaaaaagaaactaccaggaggtagatccaacttctgataaaaaaaattgttgcgcaggccagtagaaactatggctttgaaacctcttgtgtcctgacccatggtccatggatgcttgatggaacaatgtgacaaggagaaaagagtgacaagaggttcagaattggcggattttgctatttcattcaatggaaatacagtatgtttgagcaagggaagcacgatgcgcattgtagaagtattgaaaacaagtactcctttcctctgttccgcaattcttgtcgtggttttagttcgaaagattttcctcgagaaaatgacacattccctgtacaaagtatgcttttaactgcacaagtagtgagacattggcattc

SEQ ID NO: 1003 - DNA, 2994 bp, Brachypodium distachyon
tggagaggaaacgtggccagaggaatattcatcggcaccagagatgcagaatctttcgacgggcacggtggtttctgggctttctcgcgatgtatctgtgtatttcgtctcgtctcgctgcactggcccacccgggcagcagaagcttggttcgagttgcacacgcctgcctccagccctccaccacaaaaaaaataaaaaaaaatcactcgccctcgtgctatcctcgaacaaattacccggggtcgacaagcaagaatctcagccgggcacacaatccagggacggctgtcgtccacaccaatctcttctcaggtcgtagcctggatccctttgccgcggcggataaaaccacgccagcggcagtcagaaaacaaaacacgtcagtgagaaaaacaaggggaaacaaccatcgtcagcttcagccttcagcgcgcgcgcgtgtggtgcgggaggttcgagcagcccaggagcgccgtggcgatggcggcggccgtggcctcctcccccttccccgcctccaggcggctgcctagcaaaaaccacatcccggcttgccccgccgccccctccctcctccgcctggcggggggatcctcatcgaggcgcaggcgcctccgccgggccctgcgcgtctcggccgcgccggaggaggctgacgtgctgccggggcctggggtcatcgagctggagatggtctcggcggggctgctggaggagctcccggtggacccgctcgggggcagccagctcgacatcggcgggctcgccttccagggcgacgtgaccggcggcttcaccagtggcggcagcggtggggctggcgccggaggcgatggggggaacaagatgctggatcgcggcatcaacacggccatcgtgctcggcgccagcacctacgcgctcaccaagctcctcaccgtcgaccaggactactggcatgggtggaccatctttgagatcctgcgctacatgccggagcacaactggtctgcctacgaggaggccctcaagaccaacccagttcttgccaagatgatgattagcggcgtcgtttactccctcggcgactggattgcccagtgttatgaagggaagccgatctttgagtttgaccgaactcgtatgttccgttctggccttgtagggttcacactccacggttccctttcgcattactactatcatttctgtgagtctttgtttccattcaaggattggtgggctgttcctgtaaaggttgcatttgatcagacggcttggtctgcattgtggaacagcatctacttcgtggtcttgggctttctccgtttcgaatctccggtcaccatattcagcgagctcaagtccacgttctttcccatgcttactgctggatggaagttatggccgtttgcacacttaattacatacggtgtagttcctgttgaacaaagacttctctgggtcgactgtgtggagctaatctgggtcaccatcttatcaacttactcaaatgaaaaatctgaagcacgaatttcggatgcctccacatcaacagactcccaggacaactccagatagcaccagaattcatcattttgctacctaaagattgtaacaagggaaactgccttgccttcggttaattgggattgtataaaatgtacagttagttaccagttctgcgtgtgtaaccatgcttctacagcctacggactgtgctgggcaaacaaaatcaaaaaagaaactaccaggaggtagatccaacttctgataaaaaaaattgttgcgcaggccagtagaaactatggctttgaaacctcttgtgtcctgacccatggtccatggatgcttgatggaacaatgtgacaaggagaaaagagtgacaagaggttcagaattggcggattttgctatttcattcaatggaaatacagtatgtttgagcaagggaagcacgatgcgcattgtagaagtattgaaaacaagtactcctttcctctgttccgcaattcttgtcgtggttttagttcgaaagattttcctcgagaaaatgacacattccctgtacaaagtatgcttttaactgcacaagtagtgagacattggcattctgtaccccggttccgagataagatcgcacttacagatgtgcagttccaagatgcaatgcccgtagttcacaggtgtgcagttctgtacatgcttcccatgtcaaggcatctccaatagattgtgtgcagtttaagtaaataaaataaatagatcgcatgctagcttgcaagttaaaatgttcatgccatcaaccaacaacatatatacaccaagtacttcaaaatattatacaatcttaattgtccaatgtaagacgaaaggaatatacatggttgctctcctgtcctaacttcgagtttatatatgagtatatagaactttcctctttttctttatttaatatgtgccacattatcagaagctttcacataacaaatttaccagcaactatctttcaactattgttaacggcatgaagctgaatatctacaaacacagattaagctgcacatttgtaaaatactcccagaatcccatgagaacttggataggtttatccacaggctagctacgacccaccattacaaagtggaggtagtagatatattggatcatttgccgctgctgctgcctttagatcttctaacagcgatttcactgccaacttttgggccacagtcttatcgcgaccacttcgagttgcggaatagatagtcccttcaacctgcacctctgcaacaaccgatgatactccaccctcgtgagtttttgtgtaagacctactataagatctgcgatcacaaaattcctgcagctctttcactgggtcacgttcaacggtctctggggtggcaagtggctccaatagcggtttcatgcttctccagaccatctctttgtcatacttgctgtcaagataaattgcaccagctatggactcaataacatccccaagaa

SEQ ID NO: 1004 - DNA, 728 bp, Triticum aestivum
tataatatcctctgctagctctctttacagttccaaccgcaatggctgccaggagaaccattcttctcgccgtggctgcgatggccgtcctgagcaccgcgtcagcggcaatctacaacgtgggcgagccgggcggcgcatgggaccttagcaccaactacggcacttgggcgtcctctaggaacttccaaaccagcgatcagatcgtcttcaagtactcccctcgggcacacgatgtccttgaagtcagcaaggcagactacgactcttgcagcacggccaaccccatcaccaccttcaactccgggaatgatgttgtcaccctcacagccaccggcacccggtacttcatttgtggtttccctggtcattgcgcgggcggcatgaaggttaagatcgatgtcatgccaggctcctcctctacgtcacccgccccggccagcggcccaagtgcaagcaatgctcccccgccgacacctgtctccgctgccaccaatgtggaggccacgggatttggccttgccgttttgcttgccattgccggcctcatggcttgagtgcatctctgtagtcgcaggcacatgtgtattttatgtatattcaagtaattattactagcaactatctgtgtgtatgatcaagttgttatgtgtatgttgggtgtattccggctttgtgtattgctgattcattttggaggatttattaataaatattcttttggtctt

SEQ ID NO: 1005 - DNA, 698 bp, Triticum aestivum
cagcaccgggcttacacttcctctgctagctctcgttgccttccttcaagttccaactgcaatggctgccatgagactcagcctcctcatcatggccgtgatggccgtcctaagcaccacgtcggcggcaagctacaacgttggcgagccgggcggtgcgtgggacctcaacaccaactacggcacctgggcgtcctccaggaagttccaacccagcgatcagatcgtcttcaagtactcccctcaggcgcacaacgtccttgaggttagcaaggccgactacgactcgtgcagcaccgtcaaccctattgcgaccctcaactcagggaacgacatcgtcaccctcaccgccgttggcacccgctacttcatttgtgggttccctggccactgcactggtggcatgaaggtcaagatcgacggcgtgcctggctcctcctcgccatcacccgccccggccagtggccccaatgcaagcaacgctcctccaaccacgcctgtctctaccgccacctccgtgaaggccacggggtttggcttcgccatcctgcttgcctttgtcggtttcatggcttgagtacatctgtatagccccacgcacatacctaatttatgtaaagtcaaataatcattcctagtaaatatatgtgtgtatattccactaattggatacacgactttgagtttcaaaaaaaaaa

SEQ ID NO: 1006 - DNA, 772 bp, Triticum aestivum
aagtcaagcaacacaatctcagcttgaggatcaacacagcacccggcttatacctcctctgctggctctcgttgccttccttcaagttccaactgcaatggctgccatgagactcagcctcctcatcatggccgtgatggccgtcctaagcaccacgtcggcggcaagctacaacgttggcgagccgggcggtgcgtgggacctcaacaccaactacggcacctgggcgtcctccaggaagttccaacccagcgatcagatcgtcttcaagtactcccctcaggcgcacaacgtccttgaggttagcaaggccgactacgactcgtgcagcaccgtcaaccctattgcgaccctcaactcagggaacgacatcgtcaccctcaccgccgttggcacccgctacttcatttgtgggttccctggccactgcactggtggcatgaaggtcaagatcgacggcgtgcctggctcctcctcgccatcacccgccccggccagtggccccaatgcaagcaacgctcctccaaccacgcctgtctctaccgccacctccgtgaaggccacggggtttggcttcgccatcctgcttgcctttgtcggtttcatggcttgagtacatctgtatagccccacgcacatacctaatttatgtaaagtcaaataatcattcctagtaaatatatgtgtgtatattccactaattggatacacgactttgagtttcttttaattcatttttgttgagaacgaagagccgagtgaatcagctcct

SEQ ID NO: 1007 - DNA, 817 bp, Triticum aestivum
aaggatcaatacagcacctgccttataatctcctctcctagctccccttccagttccaaccacaatggctgccatgagaaccattcttctcgtcgtagctgcgatggcagtcctgagctccgcgtcagcggcgatctacaacgtgggcgagcggggcggcgcatgggaccttagcaccaactacgacacttgggcatcctctaggaacttccaaacgagcgatcaaatcgtcttcaagtactcccctcaggcacacgacgtcctcgaggtcagcaaggcagactacgactcctgcagcaccgccagccctgtcaccaccttcaactccgggaatgatgtcgtgaccctcaccgccactggtacccgctacttcatctgcggtttccctggtcattgcgcgggcggcatgaaggttaagatcgatgtcatgccaggctcctcctcttcgtcacccgccccggcgaacggcccaagtgcaagcaatgctcccccgccgactcctgtctccactgccaccaatgtgcaggccaccgggtttggccttgctgttttgcttgccgttgtcggcctcatggcttgagtgcatctctgcattcgcaggcacatgtgtactttatgtatagttaagaaattattactagcaattttctgtgtgtatagtcaagtagttatgtgtatgttggacgtattttgggctttgcgttttgttgattcattttggaggatttgttaaaaaagattcttttggtcttatacaatatttgtcctgaaacacgttcgttttaaaccataagagcccagactttcgtaacttaaa

SEQ ID NO: 1008 - DNA, 747 bp, Triticum aestivum
acacagctagcacctgtcttacaatctcctctcctagctctcctttcagttgcaaccgcaatggctgccatgagaaccattctcctcgccgtggccgtgatggccatcctgaacaccgcatcggcggcaatctacaacgtcggcgagccaggtggtgcatgggacctcagcaccaactacggcacctgggcgtcttccaggaactttcaccccagcgatcaaatcgtcttcaaatactctcctcaagcacatgacgtcctcgaggtcagtaaggctgactacgactcctgcaacaccgccagccccatcgccaccctcaactctgggaatgatgtcgtctccctcaccaccaccggcacccgctacttcctctgtggcttcccgggccactgtgccggcggaatgaaggtcaagatcgacgtcgtgccaagctcatcctcttcctcgccggccccggccagcggccccagtgcaagcaatgctcccccaccggcgcctgtctcagctgccacctctatggaggccacagggtttggcctcaccgtcttgcttgccgttgctggtctgatggcttgagtgcgtctctagaaaaacatagaagccgttgctggtctgatggcttgagtggtgtacatgtatagtcaagtaattatatcgtatgttgtatgtattcaggcttcacgtttttgcatattcattttggaggatgagtaataaagattcttttagtattataaaaaaaaaaaa

SEQ ID NO: 1009 - DNA, 851 bp, Triticum aestivum
gatcaaaggatcaacacagctagcacctgtcttacaatctcctctcctagctctcctttcagttgcaaccgcaatggctgccatgagaaccattctcctcgccgtggccgtgatggccatcctgaacaccgcatcggcggcaatctacaacgtcggcgagccaggtggtgcatgggacctcagcaccaactacggcacctgggcgtcttccaggaactttcaccccagcgatcaaatcgtcttcaaatactctcctcaagcacatgacgtcctcgaggtcagtaaggctgactacgactcctgcaacaccgccagccccatcgccaccctcaactctgggaatgatgtcgtctccctcaccaccaccggcacccgctacttcctctgtggcttcccgggccactgtgccggcggaatgaaggtcaagatcgacgtcgtgccaagctcatcctcttcctcgccggccccggccagcggccccagtgcaagcaatgctcccccaccggcgcctgtctcagctgccacctctatggaggccacagggtttggcctcaccgtcttgcttgccgttgctggtctgatggcttgagtgcgtctctagaaaaacatagaagccgttgctggtctgatggcttgagtggtgtacatgtatagtcaagtaattatatcgtatgttgtatgtattcaggcttcacgtttttgcatattcattttggaggatgagtaataaagattcttttagtattatacaatatttgtcccgaaacatgttcgccaaccataaaaagccaccctcagctctggaatcatgtcatacccctcattatcacagcacccgctatttcatccgt

SEQ ID NO: 1010 - DNA, 728 bp, Triticum aestivum
gatcaacacagcacctgtctttacaatctcctctgctagctctcttttcagttccaaccgcaatggctgccatgagaaccattcttctcgccgtggccgcgatggccatcctgagcaccgcatcggcggcaatctacaacgttggcgagccaggtggtgcttgggacctcagcaccaactacggcacctgggcatcctccaggaacttccaccccaacgaccagatcgtcttcaaatactctccccaggcacacgacgtcctcgaggtcagcaaggccgactacgactcctgcagcaccgcaagccccatcgccaccctcaactccgggaatgatgtcgtctccctcaccaccaccggcacccgctacttcctctgcggcttcccgggccactgcgccgggggaatgaaggtcaagatcgatgtcgtgccaagctcatcctcttcctcgccggccccggccagcggccccagtgcaagcaacgctcccccgccagcgcctgtctcagccgccacctctatggaggccacagggtttggcctcaccatcttgcttgctgttgccggtctcatggcttgagtgtgtctctaaaaaaacatagaagtcactattactatcaagcgtatgtggtgtacattgtattatcaagtaatatcgtacgttgtatgtattcaggcttcatgttttgcatattcattttgaaggatgactaataaagattcttttagt

SEQ ID NO: 1011 - DNA, 758 bp, Triticum aestivum
cacaatctccgctcaaaagatcaacacagcacctgtcttacaatctcctctgctagctctcttttcagttccaaccgcaatggctgccatgagaaccattctcctcgccgtggccgcgatggccatcctgagcaccgcatcggcggcaatctacaacgtcggcgagccaggtggtgcatgggacctcagcaccaactacggcacctgggcatcctccaggaacttccaccccaacgaccagatcgtcttcaaatactctccccaggcacacgacgtcctcgaggtcagcaaggccgactacgactcctgcagcaccgcaagccccatcgccaccctcaactccgggaatgatgtcgtctccctcaccaccaccggcacccgctacttcctctgcggcttcccgggccactgcgccgggggaatgaaggtcaagatcgatgtcgtgccaagctcatcctcttcctcgccggccccggccagcggccccagtgcaagcaacgctcccccgccagcgcctgtctcagccgccacctctatggaggccacagggtttggcctcaccatcttgcttgctgttgccggtctcatggcttgagtgtgtctctaaaaaaacatagaagtcactattactatcaagcatatgtggtgtacattgtattgtcaagtaatattgtacgttgtatgtattcaggcttcatgttttgcatattcattttgaaggatgactaataaaaattcttttagtattatacaatatt

SEQ ID NO: 1012 - DNA, 754 bp, Triticum aestivum
aaacacaatctccgctcaaaggatcaacacagcacctgtcttacaatctcctctgctagctctcctttcagttccaaccgcaatggctgccatgagaaccattctcctcgccgtggccgcgatggccatcctgagcaccgcatcggcggcaatctacaacgtcggcgagccaagtggtgaatgggacctcagcaccaactacggcacctgggcgtcttccaggaactttcaccccagcgaccaaatcatcttcaaatactctcctcaggcacacgatgtcctcgaggtcagcaaggccgactacgactcctgcagcaccgccagccccatcgccaccctcaactccgggaatgatgttgtctccctcactgccaccggcacccgctacttcctctgcggcttcccgggccactgcgccgggggaatgaaggtcaagatcgatgtcgtgccaagctcgtcctcttcctcgccggccccggccagcggccctagtgcaagcaacgcacccccaccggtgcctgtctcagccgccacctctattgaggccacagggtttggcctcgccgtcttgcttgccgttgccggtctgatggcttgagtgcgtctctaaaaaaacatagaagtcactgttactatcaagcatatgtggtgtacatgtatagtcaagtaattatatcgtacgttgtatgtattcaggcttcacgttttgcatattcattttagaggatgagtaataaaaattctttttgtatta

SEQ ID NO: 1013 - DNA, 689 bp, Triticum aestivum
aggatcaatacagcacctgccttataatctcctctcctagctccccttccagttccaaccgcaatggctgccatgagaaccattcttctcgtcgtggctgcgatggcagtcctgagcaccgcgtcagcggcgatctacaacgtgggtgagccgggcggcgcatgggaccttagcaccaactacgacacttgggcgtcctctagaaacttccaaacgagcgatcagatcgtcttcaagtactctcctcaggcacacgacgtcctcgaggtcagcaaggcagactacgactcttgcagcaccgccaaccctgtcaccaccttcaactctgggaatgatgttgtcaccctcaccgccaccggcacccgctacttcatttgtggtttccctggtcattgcgcgggcggcatgaaggttaagatcgatgtcattccaggctcctcctcttcggcacccgccccggccaatggcccaagtgcaagcaatgctcccccgccgactccggtctccgctgccaccaatgtgcgggccaccgggtttggcctcgctattttgcttgccgttgtcggcctcatcgcttgagtgcatctctgtactttatgtatagttaagaaattattgctagcaattttgtgtgtgtatagtcaagtagttatgtgtatgttggacgtattttgggctttgcgttttgt

SEQ ID NO: 1014 - DNA, 709 bp, Triticum aestivum
caaggatcaatacagcacctgccttataatctcctctgcaagctctccttccggttccaactgcaatggctgcgaggagaaccattcttctcgccatggctgccatggccatcctaagcacggcgtctgcggcaatctacaacgtgggtgagccgggcggcgcatgggacctcagcaccaactacggcacttgggcgtcctctaggaacttccaaaccggcgaccagatcgtcttcaagtactcccctcaggcacacgacgtcctcgaggtcagcaaggccgactatgactcatgcagcaccgccagccctgtcaccaccttcaactccgggaatgatgttgttactctcaccaccaccggcacccgctactacatatgcggtttccctggtcattgcgcgggcggcatgaaggttaagatcgatgtcatgccaggctcctcctcatcacccgccccagccagcggcccaagtgcaagcaacgctcccccgccgacccctgtgtccgctgccaccaatgtggaggccacagggtttggcctcgccgttttgcttgccgttgccggcctcatggcttgagtgcatctctgcagtcgcaggcacatgtgtactttgcgtatgtaaagtaattattactagcaactatctgtgtgtatagtcaagtagttatgtgtatgttggacatattcaagttgtgtgttttgctgatc

SEQ ID NO: 1015 - DNA, 709 bp, Triticum aestivum
aaggatcaatacagcacctgccttataatctcctctgcaagctctccttccggttccaactgcaatggctgcgaggagaaccattcttctcgccatggctgccatggccatcctaagcacggcgtctgcggcaatctacaacgtgggtgagccgggcggcgcatgggacctcagcaccaactacggcacttgggcgtcctctaggaacttccaaaccggcgaccagatcgtcttcaagtactcccctcaggcacacgacgtcctcgaggtcagcaaggccgactatgactcatgcagcaccgccagccctgtcaccaccttcaactccgggaatgatgttgttactctcaccaccaccggcacccgctactacatatgcggtttccctggtcattgcgcgggcggcatgaaggttaagatcgatgtcatgccaggctcctcctcatcacccgccccagccagcggcccaagtgcaagcaacgctcccccgccgacccctgtgtccgctgccaccaatgtggaggccacagggtttggcctcgccgttttgcttgccgttgccggcctcatggcttgagtgcatctctgcagtcgcaggcacatgtgtactttgcgtatgtaaagtaattattactagcaactatctgtgtgtatagtcaagtagttatgtgtatgttggacatattcaggttttccgttttgctgattc

SEQ ID NO: 1016 - DNA, 620 bp, Triticum aestivum
cagcacttgtcttacaatctcctctgctagttctcctttcagttcaaatcgcaatggctgccatgagaaccattctcctcgccgtggctgcgatggccatcctgagcaccgcatcggcagcaatctacaacgtcggcgagccaggtggtgcatgggacctcaggaccaactacggcacctgggcgtcatccaggaactttcaccccagcgatcaaatcgtcttcaagtactctcctcaggcacacgatgtccttgaggttagcaaggccgattacgactcctgcagcaccgccagccccatcgccaccctcaactccgggaatgatgtcgtctccctcattgccaccggcacccgctacttcctctgtggcttcccgggccactgcgcggggggaatgaaggtcaagatcgatgtcgtgccaagctcgtcctcttcctccccggccccggccagcagccccagtgcaagcaacgctcccccgccggcgcctgtctctgccgccacctctatggaggccacagggtttggcctcgccgtcttgcttgccgttgccagtttgatggcttgagtgcgtctctaaaaaaacatagaagtcactggtactatcaagcatatgtgg

SEQ ID NO: 1017 - DNA, 709 bp, Secale cereale
cagcacctggcttacaatctcctctgctagctctcctttcagtttcaaccgcaatggctgccaccagaacaattctcctggccgtggccgcaatgaccatcctgagcaccgcatcggcggcaatctacaacgtcggcgagccaggtggtgcgtgggacctcagcaccaactacggcacctgggcgtcctccaggaacttccaccccagcgatcagatcgtcttcaaatactctcctcaggcacacgacgtcctcgaggtcggcaaggccgactatgactcctgcagcaccgctagccccatcgccaccctcaaatccgggaatgatgtcgtctccctcaccgccaccggcacccgctacttcatctgcggtttccctggccactgcgctgcgggaatgaaggtcaagatcgatgtcgtgccgagctcctcttcttcctcgcccgccccggccagcggtccaagtgcaactaacgctcccccgccggcgcctgtctcagccgccacctctatggaggccacagggtttggcctcaccgtcttgctagccgttgccggtctgatggcttgagtgcgtttctaaaaaaacatagaagtcactattgctatcaagcatgtgtggtgtacattgtatagtcaagtagttataccgtacgttgtatgtattcaagcttcacgatttgcatattcattttggaggatgagtaataa

SEQ ID NO: 1018 - DNA, 1000 bp, Hordeum vulgare
ctcgtgccgaatatcggacaccgagctcgtgccgaattcggcacgagctcctctgctagctctcctttcagttccaaccgcaatggctgccacgagaaccattctcctcgccgtggccacaatgaccatcctgagcaccgcatcggcggcaatctacaacgtcggcgagccaggtggtgcatgggacctcagcaccaactacggcacctgggcgtcctccaggaacttccacccaagcgaccggatcgtcttcaaatactctcctcaggcacacgacgtcctcgaggtcagcaaggccgactacgactcttgtagcaccgccagcccaatcgccaccctcaactccgggaatgatgtcgtctccctcacggccaccggtacccgctacttcatctgcggcttcccgggccactgcgccgggggaatgaaggtgaagatcgatgtcgtgccgagctcctcttcttcctcgcctgccccggccagcggtcccagtgcaagtaacgctcccccgccggtgcctgtctcagccgccacctctgtggccaccacagggtttgggctcgccatcttacttatcgttgccggcctcatgtcttgaatgtaatttgcaacggcatacacgtgcaatttccatattagaagtagcgattactagctaccatatatgcgtatattctaaagtgtagtaattatagggtatgttgtatgtatcgaggctccgcatttttacacagtattttacctgaaacaatttgatcaatactgcaagtagagccagatttctccaacattgacttgaaacacggaaaaatgcatatacacatagattatacatgtaatatcattgtttgatttgtgttgaatatgtgaatgagtatcctatagttggagtttttcatgtatttaagttgcagagtcatgtattcatcataattttttagaatactttatgtactccatatatacattttgagcttagcagttgctctattatttcact

SEQ ID NO: 1019 - DNA, 945 bp, Triticum aestivum
acacatgtgcctgtgactgcagatatgcactcaagccatgaggccagcaatggcaagcaaaacggcgaggccatacccgatggcctccacattggtggcagtggagacaggggtcggcgggggagcattgcttgcacttggtccgctggctggggcgggtgacgaggaggaccaatacatcagcacctcccttgtaatctcctctgctagctctccttgcagttcaaacctcaatggctgtcacgagaaccattctcgccgtggctgtaatggccatcctgagcaccgcatcagcggcgatctacaacgttggcgagcccggcggagcgtgggacctcagcaccaactacggcacatgggcgtcctccaggaacttcaaagccgacgaccagatcgtcttcaagtactcccctcaagcgcatgatgtcctcgaggtcagcaaggccgactacgactcctgcagcaccgccagccccatcaccaccctcaactctgggaatgatgtcgtcaccctcaccgcctccggcacccggtacttcatttgcggcttccctggccattgcgcgggtggcatgaaggtcaagatcgatgtcatgtctggctcctcctcgtcacccgccccagccagcggaccaagtgcaagcaatgctcccccgccgacccctgtctccactgccaccaatgtggaggccatcgggtatggcctcgccgttttgcttgccattgctggcctcatggcttgagtgcatatctgcagtcgcaggcacatgtgtactttgtgtatagtcaagtaattattactagcaactatatgtgtgtatagtcaagtagttatgtgtatgttggacatattcaggttttgcgttttgctgattcgttttggagattaataaaaattcgtttggtcttatacaatatttgacttgacacacattcttgctaaac

SEQ ID NO: 1020 - DNA, 597 bp, Secale cereale
atctcctctctgctagctctccttccagttccaatcgcaatggctggcaggagaaccatttttctcgccatggctgccatggccgtcatgagcacggcgtccgcggcgatctacaacgtgggcgagccgggcggtgcatgggatctcagcaccaactacggcacttgggcgtcctctaggaacttccaaaccagcgatcagatcgttttcaagtactcccctcaggcgcacgacgtcctcgaggtcagcaaggcagactatgactcctgcagcaccgccagccctgtcaccaccctcacctccgggaatgatgttgtcaccctcaccgccaacggcacccgctacttcatctgtggattccctggtcattgcgccggcggcatgaaggttaagatcgatgtcatgccaggctcctcctcttcttcacccgccccggccaacggccctagtgcaaacaacgctcccccgccgacccccgtctccgctgccactagtgtggaggccaccgggtttggcctcgccgttttgcttgcctttgtcggcctcatggtttgagtgcgtctctgcagtggcaggcacatgtgtactttgtgtata

SEQ ID NO: 1021 - DNA, 748 bp, Triticum aestivum
ccacgcgtccgcgctcaaggaccaatacatcagcacctcccttgtaatctcctctgctagctctccttgcagttcaaacctcaatggctgtcacgagaaccattctcgccgtggctgtaatggccatcctgagcaccgcgtcagcggcgatctacaacgttggcgagcccggcggagcgtgggacctcagcaccaactacggcacatgggcgtcctccaggaacttcaaagccgacgaccagatcgtcttcaagtactcccctcaagcgcatgatgtcctcgaggtcagcaaggccgactacgactcctgcagcaccgccagccccatcaccaccctcaactctgggaatgatgtcgtcaccctcaccgcctccggcacccggtacttcatttgcggcttccctggccattgcgcgggtggcatgaaggtcaagatcgatgtcatgtctggcttctcgtcacccgccccagccagcggaccaagtgcaagcaatgctcccccgccgacccctgcctccgctgccaccaatgtggaggccaccggttttggcctcgccgttttgcttgccgttgctggcctcatggcttgagtgcatatctgcagccgcaggcacatgtgtactttgtgtatagtcaagtaattattactagcaactatatgtgtgtatagtcaagtagttatgtgtatgttggacatattcaggttttgcgttttgctgattcattttggagataataaaaattcgtt

SEQ ID NO: 1022 - DNA, 746 bp, Secale cereale
acagcacctggcttacaatctcctctgctagctctcctttcagtttcaaccgcaatggctgccaccagaacaattctcctggccgtggccgcaatgaccatcctgagcaccgcatcggcggcaatctacaacgtcggcgagccaggtggtgcgtgggacctcagcaccaactacggcacctgggcgtcctccaggaactttcaccccagagatcagatcgtcttcaaatactcttctcaggcacacgatgtcctcgaggtcggcatggccgactatgactcctgcagcaccgctagccccatcgccaccctcaaatccgggaatgatgtcgtctccctcaccgccaccggcacccgctacttcatctgcggtttccctggccactgcgctgcgggaatgaaggtcaagatcgatgtcgtgccgagctcctcttcttcctcgcccgccccggccagcggtcctagtgcaactaacgctcccccgccggcgcctgtctcagccgccacctctatggaggccatagggtttggcctcaccgtcttgctagccgttgccggtctgatggcttgagcgtgtttctaaaaaaacatagaagtcactattgctatcaagcatgtgtggtgtacattgtatagtcaagtagttataccgtacattgtatgtattcaggcctcatgatttgcatattcattttggaggatgagtaataaagattcttttagtattattattatgcaaaaaaaaaa

SEQ ID NO: 1023 - DNA, 1621 bp, Secale cereale
agcgggagcagagcgcagcagcgtcacctcggaccagcgagggctgctaggcggcagggggagctcaaaaggcgaacaagactctctactttctccctgtttgaggtttgacctctccttcagctccaaggccccgcaagtcttctccgtcctctcgcgaggaccgtcgccggcaatggcggccgcctcggaggaggccatcaagcagttctccgtgctcatggagcagctggaggagccgctcaagaccacattccagaatgtgcaccaaggatatccaagagggaccctgctgcgttttctcaaggccagagaatggaatgttcctaaagcatataaaatgctaatggactgcttaaattggaggcttcagaatgagatcgacagcgttcttgccaaaccaatattgcccgctgatttgtatagatctattcgtgatacactgcttgttggattaacaggatattccaagcagggtcaacctgtctatgcattcggtgttgggctcagtacctttgacagagcatcggtgaactactatttgcagtctcacatacagatgaatgaatatcgagatcgtgttgtcctgccaggtgcatctgagatgtccggaaaacagattaacacctgcttgaaagttatggatatgactggcctgaagctttctgctttgaaccaaataaagatgttgagcacgataacagctgttgatgaccttaattatcctgagaaaaccgagacgtattacattgtgaacgctccatatgttttctcggcatgttggaaggttgtgaagcctcttttacaagagcggaccaaaaagaagatcaaagtcttgtatggccctggaagagatgaattactgaaggttatggactacgcgtcgctcccgcacttctgcaagagggaagggtccggctcgggctcgtcgtcggacgaagtcgactgctactcgtacgaccatccattccaccaggagctgtacaactatgtgaagcagcaagcgctgaggaaccaggacagcgtcggccccgcgaagcaagggtcgatgcatgtgagggtgccgacgccggacctggaggaggccaagatcatggagacgatccagtcggagctccacagcctcaaggggggcgacggcatttcccgctcattcagcaggatcaccatcgaaggcccgtgatgatccgatcccatccatgacgatcggagcgccgcccgagatcgcgccgcggagaaggaggtaatcgcttatcttaatttgaccccaggagattattctggggtctatagcggttcttgcttgcgttgtaaccgctggctgcaaggctccattaggatcacatcgatagaggaagcagcagcagcagtagtggcatcggattctaataaccgagtgagtctgtatcgtgttatccaagatggtattagtgattagttttgattaacctggctaatggatgtaccatttgcgagttactgtttccatgcttctcatggcagggaattgtcgtgctctcccagacatgagcggcaccagctctatgtatcaatcagtatatagtagtatatgtatgtatatgtaatcgccctctgatgttacaactggtatatcattatg

SEQ ID NO: 1024 - DNA, 1675 bp, Triticum aestivum
gagcacatacgcagcgtgcgggagcagagcgcagcagcgtcacctcggaccagcgagggcagctggcagggggagctcaaaaggcaaacaagactctctatctctctgctttctccccgtttgaggtttgacctcgcctccagctccagccccgcaagtctcccccttctcctcccctcgcgacgaccgtcgccggcaatggcggccgcctcggaggaggccatcaagcagttctccgtgctcatggagcagcttgaggagccgctcaagaccacattccagaatgtgcaccaaggatatccacgagggactctgctgcgttttctcaaggccagagaatggaacgttcctaaagcatataaaatgctaatggattgcttgaattggaggcttcagaatgagattgacagcgttctagccaaaccaatattgcccgctgatttgtatagatctattcgtgatacactacttgttggattaacaggatattccaagcagggtcaacctgtctatgcattcggtgttgggctcagtacctttgacagagcatcggtgaactactatttgcagtctcacatacagatgaatgaatatagagatcgtgttgtcttgccaggtgcttctgagatgtccggaaaacagattaacacctgcttgaaagttatggatatgactggcctgaagctttctgctttgaaccaaataaagatgttgagcacgataacagctgttgatgaccttaattatcctgagaaaaccgagacgtattacatcgtgaacgctccatatgttttttcggcatgttggaaggttgtgaagcctcttttacaagagcgaactaaaaagaagatcaaagtcttgtatggccctggaagagatgaattactgaaggttatggactacgcgtcactcccgcacttctgcaagagggaagggtccggttcaggctcgtcgtcggatgaagtcgactgctactcgtacgaccatccattccaccaggagctgtacaactatgtgaagcagcaagctctgaggaaccaggacagcgtcggccccgcgaagcaagggtcgatgcatgtgagggtgccgacgccggacctggaagaggccaagatcatggagacgatccagtcggagctccacagcctcaagggaggcgacggcatttcccgctccttcagcaggatcaccatcgaaggaccatgatggtattatttcctgctcatatccaagatcgccatggatgtgacccatgatgatcggagtgcctcgagatgcgcggagcaggtaatcgcttattttatcttatttgacgccaggaaattattctggggtttatagcagttcttgcttgcattgtaaccgctggctgaaaagctcgactaggatcatatcggtagaggaagcagcagtagtagtaatagtagtagtaaaacaacggattctaataaccgagtgagtctgtatcgtgttgtcgaggatggtagtaattagtttgattaacctggctaatggatgtaccatttgcgttttactgtttccatccatgcttctcatggcagggaaattaccatgctcccagacatgagtagcaccatctctatgtatcgtatcaatcatcagtatatagtatatgtatgtatatgtaatcgccctctgatgttgcaactggtat

SEQ ID NO: 1025 - DNA, 1710 bp, Triticum aestivum
cgtgcgggagcagagcgcagcagcgtcacctcggaccagcgagggcagctggcagggggagctcaaaaggcaaacaagactctctatctctctgctttctccccgtttgaggtttgacctcgcctccagctccagccccgcaagtctcccccttctcctcccctcgcgacgaccgtcgccggcaatggcggccgcctcggaggaggccatcaagcagttctccgtgctcatggagcagcttgaggagccgctcaagaccacattccagaatgtgcaccaaggatatccacgagggactctgctgcgttttctcaaggccagagaatggaacgttcctaaagcatataaaatgctaatggattgcttgaattggaggcttcagaatgagattgacagcgttctagccaaaccaatattgcccgctgatttgtatagatctattcgtgatacactacttgttggattaacaggatattccaagcagggtcaacctgtctatgcattcggtgttgggctcagtacctttgacagagcatcggtgaactactatttgcagtctcacatacagatgaatgagtatcgagatcgtgttgtcctgccaggtgcatctgagatgtccggaaaacagattaacacctgcttgaaagttatggatatgactggcctgaagctttctgctttgaaccaaataaagatgttgagcacgataacagctgttgatgaccttaattatcctgagaaaaccgagacgtattacatcgtgaacgctccatatgttttttcggcatgttggaaggttgtgaagcctcttttacaagagcgaactaaaaagaagatcaaagtcttgtatggccctggaagagatgaattactgaaggttatggactacgcgtcactcccgcacttctgcaagagggaagggtccggttcaggctcgtcgtcggatgaagtcgactgctactcgtacgaccatccattccaccaggagctgtacaactatgtgaagcagcaagctctgaggaaccaggacagcgtcggccccgcgaagcaagggtcgatgcatgtgagggtgccgacgccggacctggaagaggccaagatcatggagacgatccagtcggagctccacagcctcaagggaggcgacggcatttcccgctccttcagcaggatcaccatcgaaggaccatgatggtattatttcctgctcatatccaagatcgccatggatgtgacccatgatgatcggagtgcctcgagatgcgcggagcaggtaatcgcttattttatcttatttgacgccaggaaattattctggggtttatagcagttcttgcttgcattgtaaccgctggctgaaaagctcgactaggatcatatcggtagaggaagcagcagtagtagtaatagtagtagtaaaacaacggattctaataaccgagtgagtctgtatcgtgttgtcgaggatggtagtaattagtttgattaacctggctaatggatgtaccatttgcgttttactgtttccatccatgcttctcatggcagggaaattaccatgctcccagacatgagtagcaccatctctatgtatcgtatcaatcatcagtatatagtatatgtatgtatatgtaatcgccctctgatgttgcaactggtattaccattatgtatttggtgtttacctgaaaaagaatctgctgtctgttt

SEQ ID NO: 1026 - DNA, 1662 bp, Triticum aestivum
gcgggagcagagcgcagcagcgtcacctcggaccagcgagggctgctggcagggggagctgagctcaaaatgcaaacaagactctctctctctctctgctttctccccgtttgaggtttgacctctcctccagctccggagccccgcaagtctccccctcctcctgtcgccggcaatggcggccgcctcggaggaggccatcaagcagttctccgtcctcatggagcagctggaggagcccctcaagaccacattccagaatgtgcaccaaggatatccaagagggactctgctgcgttttctgaaggccagagagtggaacgttcctaaagcttacaaaatgctaatggactgcttaaattggaggcttcagaatgagattgacagcgttcttgccaaaccaatattgcccgctgatttgtatagatctattcgtgatacactgcttgttggattaacaggatattccaagcagggtcaacctgtctatgcattcggtgttgggctcagtacctttgacagagcatcggtgaactactatttgcagtctcacatacagatgaatgagtatcgagatcgtgttgtcctgccaggtgcttctgagatgtccggaaaacagattaacacctgcttgaaagttatggatatgactggcctgaagctttctgctttgaaccaaataaagatgttgagcacgataacagctgttgatgaccttaattatcctgagaaaaccgagacgtattacattgtgaatgctccatatgttttttcggcatgttggaaggttgtgaagcctcttttacaagagcgaactaaaaagaagatcaaagtcttatatggccctggaagagatgaattactgaaggttatggactacgcgtcactcccgcacttctgcaagagggaagggtccggttcgggttcgtcgtcggacgaagtcgactgctactcgtacgaccatcctttccaccaggagctgtacaactatgtgaagcagcaagctctgaggaaccaggacagcgtcggccccgcgaagcaagggtcgatgcatgtgagggtgccgacgccggacctggaggaggccaagatcatggagacgatccagtcggagctccacagcctcaaggcaggcgacggcatttcccgctccttcagcaggatcacgatcgaaggtccatgatgaccttgtttcctgctcatatcgaagatcgtcatggatatgatccatgatgatcggagtggctcgagatgcgcggagcaggtaatcgattatcttatttgacgccaggaaattattctgtggtttatagcagttcttgcttgcattgtaaccgctggctgcatagctcgagtaggatcatatcatatcggtagaggaagtagtagtagtagcagcagcaaaacatcggattctaataaccgagtctgtatcgtgttgtcgaagatggtagtaactagtagctctgattaacctggctaatggatggatgtaccatttgcgcgttactgtttccatgcttctcatggcagggaaattaccgtgctcccagacatgagcagcacgagctctatgtatcttatcaatcagtatatatagtatatgtatgtatatgtaatcgccccctgatgttgcaactggtatatcattatgtatttgat

SEQ ID NO: 1027 - DNA, 1556 bp, Triticum aestivum
ctccccgtttgaggtttgacctcgcctccagctccagccccgcaagtctcccccttctcctcccctcgcgacgaccgtcgccggcaatggcggccgcctcggaggaggccatcaagcagttctccgtgctcatggagcagttggaggagcccctcaagaccacattccagaatgtgcaccaaggatatccaagagggactctgctgcgttttctgaaggccagagagtggaacgttcctaaagcttacaaaatgctaatggactgcttaaattggaggcttcagaatgagattgacagcgttctagctaaaccaatattgcccgctgatttgtatagatctattcgtgatacactgcttgttggattaacaggatattccaagcagggtcaacctgtctatgcattcggtgttgggctcagtacctttgacagagcatcggtgaactactatttgcagtctcacatacagatgaatgagtatcgagatcgtgttgtcctgccaggtgcttctgagatgtccggaaaacagattaacacctgcttgaaagttatggatatgactggcctgaagctttctgctttgaaccaaataaagatgttgagcacgataacagctgttgatgaccttaattatcctgagaaaaccgagatgtattacattgtgaatgctccatatgttttttcggcatgttggaaggttgtgaagcctcttttacaagagcgaactaaaaagaagatcaaagtcttgtatggccctggaagagatgaattactgaaggttatggactacgcgtcactcccgcacttctgcaagagggaagggtccggttcaggctcgtcgtcggatgaagtcgactgctactcgtacgaccatccattccaccaggagctgtacaactatgtgaagcagcaagctctgaggaaccaggacagcgtcggccccgcgaagcaagggtcgatgcatgtgagggtgccgacgccggacctggaagaggccaagatcatggagacgatccagtcggagctccacagcctcaagggaggcgacggcatttcccgctccttcagcaggatcaccatcgaaggaccatgatggtattatttcctgctcatatccaagatcgccatggatgtgacccatgatgatcggagtgcctcgagatgcgcggagcaggtaatcgcttattttatcttatttgacgccaggaaattattctggggtttatagcagttcttgcttgcattgtaaccgctggctgaaaagctcgactaggatcatatcggtagaggaagtagcagcagtagcatcggattctaataaccgagtgagtctgtatcgtggtgtcgaagatggtagtaattagtttgattaacctgtctaatggatgtaccatttgcgagttactgtttccatgcttctcatggcagggaaattgccatgctcccagacatgagtaacaccagcactatgtatcggaccaatcagtatatagtatatgtatgtatatgtaatcgccttctgatgttgcaactggtatatcattatgtatttgat

SEQ ID NO: 1028 - DNA, 1688 bp, Triticum aestivum
gcgggagcagagcacaacagcgtcacctcggaccagcgagggcaggcggtagggggagctcaaaaggcaaacaagacactctgctttctccccgtttgaggtttgacctctccccagctccagagccccgcaagtctccccctcctcccctcgcgacgaccgtcgccggcaatggcggccgcctcggaggaggccatcaagcagttctccgtgctcatggagcagttggaggagcccctcaagaccacattccagaatgtgcaccaaggatatccaagagggactctgctgcgctttctcaaggccagagaatggaacgttccgaaagcatataaaatgctaatggattgcttgaattggaggcttcagaatgagattgacagcgttctagctaaaccaatattgcccgctgatttgtatagatctattcgtgatacactgcttgttggattaacaggatattccaagcagggtcaacctgtctatgcatttggtgttgggctcagtacctttgacagagcatcggtgaactactatttgcagtctcacatacagatgaatgagtatcgagatcgtgttgtcctgccaggtgcatctgagatgtccggaaaacagattaacacctgcttgaaagttatggatatgactggcctgaagctttctgctttgaaccaaataaagatgttgagcacgataacagctgttgatgacctcaattatcctgagaaaaccgagacgtattacattgtgaacgctccatatgttttttcggcatgttggaaggttgtgaagcctcttttacaagagcgaactaaaaagaagatcaaagtcttgtatggccctggaagagatgaattactgaaggttatggactacgcgtcactcccgcacttctgcaagagggaagggtccggttcgggttcgtcgtcggatgaagtcgactgctactcgtatgatcatccattccaccaggagctgtacaactatgtgaagcagcaagctctgaggaaccaggacagcgtcggccccgcgaagcaagggtcgatgcatgtgagggtgccgacgccggacctggaggaggccaagatcatggagacgatccagtcggagctccacaacctcaaggggggcgacggcatttcccgctccttcagcaggatcaccatcgaaggtccatgatatcttatttcctgctcgtatccaagatcgtcgtggatgtgatccatgatgatcggagtgcctcgagatgcgcggagcaggtaatcgcttattttatcttatttgacgccagaagattattctggggtttataacggttcttgcttgcgttgtaaccgctggctgcaaagctcgagtaggatcatatcagtagaggaagtagcagcagtagcatcggattctaataaccgagtgagtctgtatcgtggtgtcgaagatggtagtaattagtttgattaacctgtctaatggatgtaccatttgcgagttactgtttccatgcttctcatggcagggaaattgccatgctcccagacatgagtaacaccagcactatgtatcggaccaatcagtatatagtatatgtatgtatatgtaatcgccttctgatgttgcaactggtatatcattatgtatttgatttgatgttacctgaaccacgacttaaaaagaaatctgctgtctgtttc

SEQ ID NO: 1029 - DNA, 1541 bp, Avena sativa
gacacgttcacatacgcacggcgcgctgcgggaagcagaacggaacagcgtcactccctccctctgaccagtaccaaggttagcggtgggagctaaaaaggcaaacaagactcagctttctccacgtttgacctcaagccccgagccgcctcctcctccgactccgaacgaccttcgccggcaatggcggccccctcggaggaggccatcaagcagttctccgcgctcatggagcagctggaggagcccctcaagaccacattccagcatgtgcaccaaggatacccaaggggaactctggtgcgttttctcaaggcgagagaatggaatgttctgaaggctcataaaatgctcatggattccttaaactggaggcttcagaatgagattgacaccgttcttgcgaaaccaattctaccccctgatttgtatagatctattcgtgatacactacttgttggattaacaggatactccaagcagggacaacctgtgtatgcatttggtgttgggctcagtacctttgacaaggcatcggtgcactactatttgcagtctcacatacagatgaatgaatatcgagaccgtgttgtcctgccgggtgcatctgagatgttcggaaaacagattaatacctgcttgaaagttatggatatgactggcctgaagctctctgctttgaaccaaataaagatgttgagcacgataacagcagttgatgaccttaattacccagagaaaacagagacgtattacattgtgaacgctccgtatgttttttcagcatgttggaaggttgtgaagccccttttacaggaacggacaaaaaagaagatcaaagtcttatctggccctggaagagacgagttgttaaaggttatggactaccagacactgccacacttctgcaaaagggaagggtccggctcgtcgtccgacgaagtggactgctactcctacgaccaccctttccaccagcagctgtacaacttcgtgaagcagcaggctcagagccaggacatggtgggtccgttgaagcaagggtcgatgcacgtcaaggtacccaccccggacctggaggaggccaagatcatgcagaccatcgagtcggagctccagaatctgaggggaggaggcgacggcatgtctcgctcgttcaacaggatcaccatcgagggtccataaatgacagtgctagcatgctgccgtcgtgatcggattgcccgagatgcgccgcatgggtgcggaggaggtattcagctatcttgaccccgggaacgtatatttctggggttatatgtagcgatttcttgcttgcagtctctggctgcaggcttgagtaggagcagtagaggaagtagtagtaacacgcggttcgaataaccgagtctgtatcgtcggagatcgtagtagttagttttaattaacctagctaatgtaccgtttgcacgttgccgctttcatgcttgtcatggcagggtaattatcatgtttcccgcacatgaacgaatgacacgacccctatgtatcaatatatatat

SEQ ID NO: 1030 - DNA, 1641 bp, Brachypodium distachyon
acacgttcttcacaataaacacggtgacgcggtgcgggagcagaatcgcgtcatagagaccagaagcagagagaaagaaggggcagggagctcaaaagccaaacaagactcaactttctccccgtttgacctttccaagccccggaaggtccctcccaccgtcgctggcaatggcggccgtcgtctcggaggaggccatcaagcagttctccgcgcttatggagcagctggaggagcccctcaagaccacattccagcatgtgcaccaagggtatccaagaggaactgtgatgcgttttctcaaggccagagaatggaatgttcccaaagctcataaaatgctaatggattgcttaaattggaggcttcagaatgagattgacagtgttcttgctaaaccaatagtgccatctgatctgtatagatctattcgtgaaacactacttgttggattaacaggatactctaagcagggacaacctgtctatgcatttggtgttgggctcagtacctttgataaggcatcagttcactactatttgcagtctcacatacagatgaatgaatatagagatcgtgttgtcctgccaggtgcatctaacatgttcgggaaacaggttaacacctgtttgaaaataatggatatgactggcctgaagctttctgccttgaaccaaataaagatgttgagcacgataacagctgttgatgaccttaattatcctgagaaaactgagacctattacattgtgaacgctccatatgttttttcggcatgttggaaggttgtgaagcctcttttacaagaaaggactaaaaagaagattaaagtcttatatggccctggaagagatgagttattaaaggtcatggaccatgaggcacttccgcacttctgtaacagagaaggatctggttcattgtcagatggagttgactgctactcctatgatcatccttttcaccagcagctgtataacttcgtgaaacaacaagccctgagccaggatattgttggtcccttgaagcaaggttcgatgcatgtccatgtccccgtgccagacatcgaggacgcaaagattgcggagacgatcgaatcagagctccataaattgagggaaggtaatgggctgtctcgctcattcaacaggatcaacatcgaaggtccttgaccggtgcgatgagactatcggagtgccccgaaataaactatgcggcagcggcggcatttgctttctgaaaattgttatggggttatatatatagcagttcttgcttgcaatcgctggatgcaaagcttggctaaatggctaggatcactagagaaggtagtaaaatgctgttctaataaccgagcctgtactttcgaagattgtactgtagtagttagctctaattaacacagcgaatgtatcattagcgtgttactgttttcatgcttatggcagggaaatgagatgcttccgtctgatgtatcaaccagtcctctgatgtatcaacatatgtatatataagtataactgccctctgatgttggggcatcgtataaagatcaacataagtactaaccgctatgcctacatttgtatcttgtgtcagataacatggcgaaaggtatggctttgagcacaagcttttatc

SEQ ID NO: 1031 - DNA, 1695 bp, Brachypodium distachyon
acacgttcttcacaataaacacggtgacgcggtgcgggagcagaatcgcgtcatagagaccagaagcagagagaaagaaggggcagggagctcaaaagccaaacaagactcaactttctccccgtttgacctttccaagccccggaaggtccctcccaccgtcgctggcaatggcggccgtcgtctcggaggaggccatcaagcagttctccgcgcttatggagcagctggaggagcccctcaagaccacattccagcatgtgcaccaagggtatccaagaggaactgtgatgcgttttctcaaggccagagaatggaatgttcccaaagctcataaaatgctaatggattgcttaaattggaggcttcagaatgagattgacagtgttcttgctaaaccaatagtgccatctgatctgtatagatctattcgtgaaacactacttgttggattaacaggatactctaagcagggacaacctgtctatgcatttggtgttgggctcagtacctttgataaggcatcagttcactactatttgcagtctcacatacagatgaatgaatatagagatcgtgttgtcctgccaggtgcatctaacatgttcgggaaacaggttaacacctgtttgaaaataatggatatgactggcctgaagctttctgccttgaaccaaataaagatgttgagcacgataacagctgttgatgaccttaattatcctgagaaaactgagacctattacattgtgaacgctccatatgttttttcggcatgttggaaggttgtgaagcctcttttacaagaaaggactaaaaagaagattaaagtcttatatggccctggaagagatgagttattaaaggtcatggaccatgaggcacttccgcacttctgtaacagagaaggatctggttcattgtcagatggagttgactgctactcctatgatcatccttttcaccagcagctgtataacttcgtgaaacaacaagccctgagccaggatattgttggtcccttgaagcaaggttcgatgcatgtccatgtccccgtgccagacatcgaggacgcaaagattgcggagacgatcgaatcagagctccataaattgagggaaggtaatgggctgtctcgctcattcaacaggatcaacatcgaaggtccttgaccggtgcgatgagactatcggagtgccccgaaataaactatgcggcagcggcggcatttgctttctgaaaattgttatggggttatatatatagcagttcttgcttgcaatcgctggatgcaaagcttggctaaatggctaggatcactagagaaggtagtaaaatgctgttctaataaccgagcctgtactttcgaagattgtactgtagtagttagctctaattaacacagcgaatgtatcattagcgtgttactgttttcatgcttatggcagggaaatgagatgcttccgtctgatgtatcaaccagtcctctgatgtatcaacatatgtatatataagtataactgccctctgatgttggggcatcgtataaagatcaacataagtactaaccgctatgcctacatttgtatcttgtgtcagataacatggcgaaaggtatggctttgagcacaagcttttatcaggatatgtttcccatcattttctccttccaccattggattctctgccacaccc

SEQ ID NO: 1032 - DNA, 1938 bp, Oryza sativa
atccgactcctacttctaacgtagattttcggcctttataaaccagcatcacccctcccctaatcctcgacctcaccatcgtcggccggacctccacggaccgcatacgcgcgacacgagcacacgaccacgcaatacgcagcagcagcagcagctacccagcagatcgatccgaccgacggaggaagaagataaaagggcagaagagaaggggtgtgtgtggaaaaggcgagtaaagactccagctttctccccgtttgacctcgccctgctcaccgcgaaggctcgcccccctccctcttccctccccgccgccgtcaccggcggcaggcagcaatggcggccgcttcggaggaggccatcaagcagttctccgcgctgatggagctgctggatgagccgctcaagaccacattccagcatgtccatcaaggatacgcaagaggaactctggtgcgttttctaaaggccagagaatggaatgttccgaaagcacataaaatgttaatggattgcttaaattggaggatacaaaatgggattgacagcgttctggctaaacctatagtcccttctgatttatacagaactattcgggatacgctgctggttggattgacaggatactccaagcagggacaacctgtctatgcattcggtgttgggctcagtacccttgacaaggcatcggtgcactattatgtgcaatcacacatacagatgaatgaatatcgagatcgtgttgtactgccgaaagcctctaagatgttcgggaaacagattaacacttgcctaaaggttatggatatgacggggctgaagctttctgccttgaaccaaataaagatgttatctacgataacagccatcgatgaccttaactatcctgagaaaacagagacctatttcattgtcaatgctccatatgttttttcagcatgttggaaggttgtgaagcctcttctacaagaaagaacaaaaaggaaaattaaagtcctgtacggctcaggaagagatgaattactaaaggttatggactatgaggcactcccaaacttttgcaagcgagaaggatcaggctcgtcgaatgattcgtcggatggagttgattgctactcctatgatcacccttttcaccaggagctgtataattacatcaaacagcaagccctgaatgaagacttcatcggtcccataaagcaaggctcaatgcatgtggatgtgcccacacctgatctggaagaggccaagatcatggagacgatcgaatcggagctccacaaattcagtggagctaatggcctctcgcattcattcaacaagatcaagattgaaggtccgtgatgttgcccgtgatcatatctcgtgacggagacgacgatctgcggagatattatgcttatccatctccagccccagggaacctacggtggggttatagcactccttgcttgcaatctctagctgcaggcttgactaggatccacgagtagaaagaggttagtaattgtgatgcgattctaataaccgaatccgtattatctgaaagtgtagccagttctttttctaattaacctagcgactgtatcatctgcgacacgttactatttcagtgcttatggcaactgggaaggaaatgtgatgtttccagtccttccgagtaagttgctgccctaaatatatatgtaacagtgtatgtatagcctctagctgccttttgattgcagtggtatatatcaagtgctgtactcactgctaagaatgaatcatctgcatgtttcatttcactggatgctgtgaaatttggtaaatcgttatatcaatgtttgatgtttgctgccatctgtataaactcgccagtcgcttttggctacataattaagactgcccatgaatgttgttttgcattttgtagaaacaatggatggctgttatgct

SEQ ID NO: 1033 - DNA, 1769 bp, Oryza sativa
acgtagattttcggcctttataaaccagcatcacccctcccctaatcctcgacctcaccatcgtcggccggacctccacggaccgcatacgcgcgacacgagcacacgaccacgcaatacgcagcagcagcagcagctacccagcagatcgatccgaccgacggaggaagaagataaaagggcagaagagaaggggtgtgtgtggaaaaggcgagtaaagactccagctttctccccgtttgacctcgccctgctcaccgcgaaggctcgcccccctccctcttccctccccgccgccgtcaccggcggcaggcagcaatggcggccgcttcggaggaggccatcaagcagttctccgcgctgatggagctgctggatgagccgctcaagaccacattccagcatgtccatcaaggatacgcaagaggaactctggtgcgttttctaaaggccagagaatggaatgttccgaaagcacataaaatgttaatggattgcttaaattggaggatacaaaatgggattgacagcgttctggctaaacctatagtcccttctgatttatacagaactattcgggatacgctgctggttggattgacaggatactccaagcagggacaacctgtctatgcattcggtgttgggctcagtacccttgacaaggcatcggtgcactattatgtgcaatcacacatacagatgaatgaatatcgagatcgtgttgtactgccgaaagcctctaagatgttcgggaaacagattaacacttgcctaaaggttatggatatgacggggctgaagctttctgccttgaaccaaataaagatgttatctacgataacagccatcgatgaccttaactatcctgagaaaacagagacctatttcattgtcaatgctccatatgttttttcagcatgttggaaggttgtgaagcctcttctacaagaaagaacaaaaaggaaaattaaagtcctgtacggctcaggaagagatgaattactaaaggttatggactatgaggcactcccaaacttttgcaagcgagaaggatcaggctcgtcgaatgattcgtcggatggagttgattgctactcctatgatcacccttttcaccaggagctgtataattacatcaaacagcaagccctgaatgaagacttcatcggtcccataaagcaaggctcaatgcatgtggatgtgcccacacctgatctggaagaggccaagatcatggagacgatcgaatcggagctccacaaattcagtggagctaatggcctctcgcattcattcaacaagatcaagattgaaggtccgtgatgttgcccgtgatcatatctcgtgacggagacgacgatctgcggagatattatgcttatccatctccagccccagggaacctacggtggggttatagcactccttgcttgcaatctctagctgcaggcttgactaggatccacgagtagaaagaggttagtaattgtgatgcgattctaataaccgaatccgtattatctgaaagtgtagccagttctttttctaattaacctagcgactgtatcatctgcgacacgttactatttcagtgcttatggcaactgggaaggaaatgtgatgtttccagtccttccgagtaagttgctgccctaaatatatatgtaacagtgtatgtatagcctctagctgccttttgattgcagtggtatatatcaagtgctgtactcactgctaagaatgaatcatctgcatgtttcatttca

SEQ ID NO: 1034 - DNA, 1677 bp, Setaria italica
aaacgttaggatcaccggcggggacagaccaccggagctgagccccacagcaccacacatccacgcggtttgctggtgacctggtgtggtgactggtgaggaagcgcacaagaacacaacaagaaggcgagagcacagagcagagagggagaaaggggaggaacagagagctgaaaaaggtggaaaaaacccggcttttgaccccgccaagcccaccgtcgccggcaatggcggccgcttccgaggaggccatcaagcagttctccgcgctcatggagcagctggaggagccgctcaagaccacattccagaatgtgcatcaaggaaatctgagggggactttggtgcgttatctgaaggccagagaatggagtgtccctaaagctcataaaatgcttatggattgcttaaattggagaatacagaatgagattgacagcgtgttggctaaacccattgtgccacctgatctatatagagctatccgggatacgcttcttgttggattgacagggtactccaagcagggacaacctgtttatgcatttggtgttggtctcagtacctttgacaaggcttcggtgaactactatgttcagtcacacatacagatgaatgaatatcgagaccgtgttgtcctcccggctgcatcaaagaagtttgggagacagatcaatacctgcttgaaggttatggacatgactggcctgaagctgtctgcgttgagccaaataaagatgttgaccatgattaccactgttgatgaccttaattatcctgagaaaactgagacttattacattgtgaatgcaccatatgttttttcggcatgttggaaggttgtgaagccacttctacaagaaagaactaaaaagaagatccaagtcctgtatggctctgggagggatgagttattgaaggttatggactaccagtcacttccgcatttttgcaagagggaaggatcaggttcatccagtgactctctggacggtgttgattgctactcctatgaccatcctttccaccagcagatgtacaactacgtgaagcagcaatctctgaagctggactctgttggtcccataaaacaaggctcactccatgtggatgtgccctcacctggctttgaggaggtcaagatcgcggagaccatcgaatcggagctccacaagttgaggggaggcaacggcctcactcactctttcaacagaatcaagatcgaaggtccatgagggcgcggtgattgagaagcgtgcgccggagacacagcggtccacggtccacagaggtgatcttggtatctgaaccccagtagcctatggtggtggggtggtagtagggcctcttgcttgcaatcactggctgcaggcttgattaggacgagtagagaacgcgattctaataaccgtacccgagattgttatccttcctaattaacctagctagtatcgttgtactttcgcgcttatatggcatgggatctgtcacgtttccacccatggaagctaccagcttggagtgctactatgtatcaatgtactatgtatatgtatatatatgactgccaactcggtgagttggtatctacaaggagagatctgtactccctgctagctttctcagcatgctcatgttttaccccccagtgcagtgaaattccacttgccaatgttc

SEQ ID NO: 1035 - DNA, 1690 bp, Zea mays
ttggagtagaactccgcgctgctataaatgtcaacgtaaataaataaacaacataaatacctggtggaataacctctctcaaaataaaacccgatagagatacagaagaaaagagagaaaaaaactaagctcgcctgatcctttttaagagacgggacccctcaccactctgtaggtcccgaaggcccgaaccttaggatcgccggcgaaccaccggagctgagccccacaaacatcactgtaccacacggtttggtggtgtggcgactggcgacgaagcgcacaagaacaaaacaagagggcgagaaacatagggagaaaggaggagaggaacggagagctggaaaaggcaggaaagacccggcttttgaccccaagtaccctgttgagggcaatggcggccacctccgaggaggcaatcaagcagttctcggcgctcatggagcagctagaggagccgctaaagagcacattccagaatgtgcatcaaggaaatctgagagggactttgatgcgttttctgaaggctagagaatggagtgtgcctaaagcttataaaatgctaatggattgcttaaactggagagtacagaatgagattgacatcgtgttagctaaacccattctgccatctgatatatatagagttattcgggacacgttacttgttggattgacagggtactccaagcagggacaacctgtttatgcatttggtgtgggtcttagtactttcgacaaggcctcggtgaactactatgtgcaatcacacatacagatgaatgaatatcgagatcgtgttgtcctgccggctgcatcaaagaagtttgggagacagattaatacctgcttgaaggttatggatatgactggcctcaagctgtctgcactgagccaaataaagatgttgacgatgattactactgttgatgaccttaattatcctgagaaaacggaaacttattacattgtaaatgctccatatgttttttcagcgtgttggaaggttgtgaagccactcttacaagaaagaactaaaaagaagatccaagtcctgtatggctctgggagggatgagttactgaaggtcatggactacgagtcacttccgcacttctgcaagagagaagggtcaggttcatccagcgactcgctggatggagtagattgctactcctacgaccaccctttccaccagcagctgtacaactacatgaagcagcagcaatctctgaatcaggactccgttggtcccagaaaacaaggctcggtccacgtggatgtgccctcgcctggccttgaggaggccaagattgcggagacgatcaaagcagagctccagaatttgaggggaagcggcggtctcgcccattcattcagcagcatccagatcgaaggtccatgagggcgcgcgccagtgacccgaagagaagctcttggtaatggtgcctcctgcttgcagtcactggctgcaggcttgaccggggcgaatagagagcgggattctaataactgtatccgcgattgttgtgatttctaattaaccaagtgggcgtgtatcgccatgcttgtactatccctgtatgtatgtatatataacggccaactggacggagtttatgtaactccctgctaattacttagaatgctcatcttttattttactccaatatagtgaaaatttcgctta

SEQ ID NO: 1036 - DNA, 1563 bp, Pennisetum glaucum
gtggtgactggtgaggcagcgcacaagaacatagcaagaaggcgagagaacagagcagagagggagaaaggggaggaacagagagctcaaagaggtcactggcttttgaccccgcgaagcccaccgttgccggcaatggcggccgcgtccgatgaagccatcaagcagttctccgcgctcatggagcagctggaagagccgctcaagatcacattccagattgtacaccaaggaaatctgagggggactttggtgcgttatctgaaggctagagaatggagtgtacctaaagctcataaaatgcttatggattgcttacattggagaatacagaatgagattgacagcatgttggctaaacccattgtgccacctgatctatatagagctatccgggatacgcttcttgttggattgacagggtactccaagcagggacaacctgtttatgcatttggtgttggtctcagtacctttgacaaggcttcggtgaactactatgttcagtcacacatacagatgaatgaatatcgagaccgtgttgtccttccggctgcatcaaggaagtttgggagacagatcaatacttgcttgaaggttatggacatgactggcctgaagctatctgcgttgagccaaataaagatgttgaccatgattactactgttgatgaccttaattatcctgagaaaactgagacttattacattgtgaatgcaccatatgttttttcggcatgttggaaggttgtgaaaccacttctacaagaaagaactaaaaagaagatccaagtcctgtatggctccgggagggatgagttattgaaggttatggactaccagtcacttccgcatttttgcaagagggaaggatcaggttcatccactgactctctggacggagttgattgctactcctatgaccatccttttcaccagcagatgtacaactacgtgaagcagcaatctctgaagctggactctgttggtcccgtaaaacaaggctccctccatgtggatgtgccctcacctggctttgaggaggtcaagattgcagagacaatcgaatcggagctccacaagttgaggggaggcaatggcctcactcactcattcaacagaatcaagatcgaaggcccgtgagggcgcggtgattgagaagcatgcgccggagacagcggtctatggtctccagaggtgatcttgttatctgaaccccatatggtggtgcttgcaatcactgctgcaagcttgtttaggacgagtagagacggcagtagagaacacaattctaataaccgtatccaagattgttaccattcctaattaacctagctagtatcgttgtactttcgtgcttgtatggcatgggatctatgacgtctccacccttgaagcttgcattggagtgctccctatgtatccatgtttatgaatatatatgactgccaactcggtgagttggtatctacaaggaagactttatactccctgctagttttctcagtatgctcatgttttacctccaactccaatgcagtgaaaatcaacctgccaatgttc

SEQ ID NO: 1037 - DNA, 1245 bp, Saccharum officinarum
accacagcaccacgcattcacacggtttggttgtgtggcgaggaagcgcacaagaacagaacaagaaagcgagaaacacagagaggaaggaggagaggaacggggagctggaaaaggcagaaaagacccggcttttgaccccaagtcttcggttgccggcaatggcggccacctccgagaaggccatcaagcagttctcagcgctcatggagcagctggaggagccgctcaagaccacattccagaatgtgcatcaaggaaatctgagagggactttgttgcgttttctgaaggctagagaatggagtatccctaaagctcataaaatgctaatggattgcttaaactggagagtacagaatgagattgacagcgtgttagctaaacccattctgccatctgatttatatagagccattcgggacacgctacttgttggattgacagggtactccaagcagggacaacctgtttatgcatttggtgtgggtcttagtacttttgacaaggcctcggtgaactattatgtgcagtcacacatacagatgaatgaatatcgagatcgtgttgtcctgccggctgcatcaaagaagttcgggagacagattaatacctgcttgaaggttatggatatgactggcttgaagctgtctgcactgagccaaataaagatgttgaccatgattacaactgttgatgaccttaattatcctgagaaaacagagacttattacattgtgaatgctccatatgttttttcagcatgttggaaggttgtgaagccacttttacaagaaagaactaaaaagaagatccaagtcctgtatggctctgggagggacgagttactgaaggttatggaccacgagtcacttccacacttctgcaaaagagaaggatcaggctcatccagggactctttagatggagtagattgctactcgtacgatcacccttttcaccagcagctgtacagctacatgaggcagcaatctctgaatcaggactctcttggtcccagaaaacaaggctcagtccatgtggatgtgccttcacctggccttgaggaggtcaagattgcggagacaatcaaagcagagctccagaatttgaggggaagcaatggtctcactcattcattcaacagcatacagatcgaaggtccatgagggcgccaagcgtgagacgcgtctggtgtagaggagctcaggtaagcgacatgcgatgtcatagtaatgctagcct

SEQ ID NO: 1038 - DNA, 1520 bp, Panicum virgatum
ggaggaaggggacaaatagggagctgaaaaaaaagcggaacagacccggcttttgaccccgccaagcccaccttcgccggcaatggcggtcgcctccgaggaggccatcaagcagttctccttgcaaaatgactaattggaggagccgctcaagaccacattccagaatgtgcatcaaggaaatctgagggggactttggtgcgttttctgaaggccagagaatggagtgtacctaaagctcataaaatgcttatagattgcttaaattggagaatacaaaatggtattgacagcgtgttggctaaacccattgtgccatctgatttatatagagctatccgggatactctacttgttggattgacagggtactccaagcagggacaacctgtttatgcatttggtgttggtctcagtaccttcgataaggcttcggtgaactactatgttcagtcacacatacagatgaatgaatatcgagaccgtgttgtcctgccggctgcatcgaagaagtttgggagacagattaatacctgcttgaaggttatggatatgactggcctcaagctgtctgcattgagccaaataaagatgttgaccatgattacaactgttgatgaccttaattatcctgagaaaacggagacttattacattgtgaatgcaccatatgttttttcggcatgttggaaggttgtgaagccacttttacaagaaagaactaaaaagaagatccaagtcctgtatggctctgggagggatgagttattgaaggttatggattatgagtcacttccacacttttgcaagagggaaggatcaggttcatccagtgactctctcgatggagttgactgctattcctatgaccatcctttccaccagcagctgtacaactacatgaagcagcaatctctgaaactggactctgttggccccataaaacaaggctcactccatgtggatgtgccctcgcctggccttgaggaagtcaagatcgccaagaccatcgaatcagagctccacaagttgaggggaggcaacggcctcactcactcattcaacagaatcaagatcgaaggtccatgagggcgcggtgattgagaagcgtgcgcccaagacaatggtctatggtccacggaggtgatcttgttatgggggtagtagtgcctcttgcttgcaatcactggctgcaggcttgagtaggacaagtagagaatgtagtagagaacgcgggattctaataaccggtatccgagattgttatcatcctaatcaacctagcgactatcgttgtattttcgtgcttattatgtcatgggaattgtgacgtttccacccatgaaagttaccaggttggagtgctccctatgtacctatgtatatgtatatatgtctgccaactcggtgaagttggtatctcaggagacttgtacttgctagcacctaagttacttgaaaagtgatccttcggtttgcgcgcagtttttatcaataaagttttgcgtgctgttgaact

SEQ ID NO: 1039 - DNA, 1457 bp, Cynodon dactylon
ggggagcccaccaccggagctgcccccacaccaccacacacatacacacacggtgtggtgtgagtctgtgaggtggtgcgggaacgcgcaagacactgctagagcagaccaagaacagaggtggaaaggggaggaacggaactcgaaaagggggcgcagacccggctttccccccgtttgacgccgccgtcgccgacaatggcggccacctccgaggaggccatcaagcagttcgctgcgctcatggagcacctggaagagccgctcaagaccacattccagaacgttcatcaaggatacccgagggggactctggtccgttttctaaaggccagagaatggagtgttcccaaagctcataaaatgttaatggatagcttaaattggagggtacagaatgagattgacagcgtgcttgcgaaacccatagtgccatctgatttgtatagatctattcgggacacactacttgttggattgacaggatactccaagcagggacaacctgtttatgcatttggtgttggtctcagcaccttcgacaaagcatcggtgaactactatgtccagtcacacatacagatgaatgaatatcgagaccgtattgttctgcctgctgcatcgaaaaagtttgggagacagattaatacctgcttgaaggttatggatatgactggcctgaagctgtctgcactgaaccaaataaagatgctgaccatgattacaagtgttgatgatcttaactatcctgaaaaaactgagacgtattacattgtgaatgctccatatgttttttcagcatgttggaaggttgtgaagccacttttacaagaaagaactaaaaagaagatccaagttttgcatggctccggaagggatgagttggtgaaggttatggactatgagtcacttccacacttttgcaagagagaaggatcagggtcatcccgtgattcattcgatggagttgtttgctactcttatgatcatcctttccaccagcagctgtacaactacatgaagcagcaagctgtaaagcaggatgttgttgtaaaacaagaatcgtttcatgtggatttgcctacacctgagcttgaagaagttaagattgctaagaagatcgaatccgagattcaccatctgaggggacacaacgggctctctcaccagttcaacagcatcgagatcgaaggtccatgagggtgtgatatttcagagttcgcaccatagactgcgatcgacggagattttctgcttatctgaaccccaagaatctatgctggggtggtagtacctcttgcttgcaatcactggctgcaggcttgattaggacgagtagaggcgtagtagagaacaaaattctaataactgaatctttgatatccaggatttctattattcctaattaaccattctgtaatctttgtattttcatgcaatgttgtggaaatgttatg

SEQ ID NO: 1040 - DNA, 2116 bp, Triticum aestivum
ttttgtcggcgcggcgcctcccatgttcgttgtttggagctccaacgctgtttttcttcgtattcaagtcgtgcctgccggcttgccggagtgttgcttccaagcacgcttctagagtgacaaagaccttgtaaggtcaagcacgccatgagcccatgatcacaccggtaggagagagctaggctctgcagtctgcgccgtgtaccactccacacgcgaggactaaactaagctgaacttgggccacctgtccaggcagcgtgtggagctcggcgagcgcgagttaatggccggagaagttgccgtcgtttgatcttgacgcaccttgtttttatgtgttcttgtgtggtcttgactgactgttctaggggagaggtctgaatcggcgatttggacctttactcggtccatgacgagtccttgtcctgacgagcatgctcgccttcgtggacctctcgggtggaaccgtttggatgcgcaccgcgcaagcactgatgatgcatcgcaattcgatagctccaccgagaaacaacagttccttttctttcttatctcttctgcgcggtggaatcacgatatcagtagcgcctttttcatgatttttataccgtatagtgtcgcgttgccgaccagttagtttctggcactgttgcttgagattaaagctcttggcaggggttaacaaatagtgcttaattactgttatgtgtacagaatgtgcaccaaggatatccaagagggactctgctgcgctttctcaaggccagagaatggaacgttccgaaagcatataaaatgctaatggattgcttgaattggaggcttcagaatgagattgacagcgttctagctaaaccaatattgcccgctgatttgtatagatctattcgtgatacactgcttgttggattaacaggatattccaagcagggtcaacctgtctatgcatttggtgttgggctcagtacctttgacagagcatcggtgaactactatttgcagtctcacatacagatgaatgagtatcgagatcgtgttgtcctgccaggtgcatctgagatgtccggaaaacagattaacacctgcttgaaagttatggatatgactggcctgaagctttctgctttgaaccaaataaagatgttgagcacgataacagctgttgatgacctcaattatcctgagaaaaccgagacgtattacattgtgaacgctccatatgttttttcggcatgttggaaggttgtgaagcctcttttacaagagcgaactaaaaagaagatcaaagtcttgtatggccctggaagagatgaattactgaaggttatggactacgcgtcactcccgcacttctgcaagagggaagggtccggttcgggttcgtcgtcggatgaagtcgactgctactcgtatgatcatccattccaccaggagctgtacaactatgtgaagcagcaagctctgaggaaccaggacagcgtcggccccgcgaagcaagggtcgatgcatgtgagggtgccgacgccggacctggaggaggccaagatcatggagacgatccagtcggagctccacaacctcaaggggggcgacggcatttcccgctccttcagcaggatcaccatcgaaggtccatgatatcttatttcctgctcgtatccaagatcgtcgtggatgtgatccatgatgatcggagtgcctcgagatgcgcggagcaggtaatcgcttattttatcttatttgacgccagaagattattctggggtttataacggttcttgcttgcgttgtaaccgctggctgcaaagctcgagtaggatcatatcagtagaggaagtagcagcagtagcatcggattctaataaccgagtgagtctgtatcgtggtgtcgaagatggtagtaattagtttgattaacctgtctaatggatgtaccatttgcgagttactgtttccatgcttctcatggcagggaaattgccatgctcccagacatgagtaacaccagcactatgtatcggaccaatcagtatatagtatatgtatgtatatgtaatcgccttctgatgttgcaactggtatatcattatgtatttgatttgatgttaaaaaaaaa

SEQ ID NO: 1041 - DNA, 2535 bp, Hordeum vulgare
acaaacggcgagagctcagctcagctcacggtcacgcgcaccgctgctgagctagctccaatggattactccacctccctcctccgcctcaccttcctcgccctcggcgccgccctcatcctcctcgtcacccgctccgcctttcgcctgccgctcgccatcgacgcaccagccgcctccttcttacacggctccggcggctgcacccggttctcgccgtgggcctgccgcccaccacgaaccggcaagtccccgccacgtcgttcgtcacacgagtccgacgtcccgcgccacccgctcgacccgctcacggtgacggagatcagccgcgcgcgcgagctcctccgcgcgcacccgccgttcgcgtcggcgccgtcggccctggtcgtgcacgcgctcgcgctcgacgagccggacaagcccgccgtccggcgctggcggaagggcgcccacgcgctcccgcctcgccgcgccgtcgcggtcgtccgcttccgtggggagtcccatgtgctcgccctcgaccttgccaccggctcggtcacccctctgcccacgccggcctcgggctacccgacgatgaccatggacgagatgaccgccctctgcgcggcgccgttcagcgacccggcgttcaacgccaccatcctgcgccgcggcgtgcgcctggccgacgtcgcgtgcctgcccatctcccccgggtggtacggccccgccgaggacgacggcggccgccggttcatcaagagccagtgctactcgacggagggcaccgccaatttctacatgcgccccatcgagggcctcaccgtcctcatcgacatggacaccgggaaggtcgtccacatctccgaccgcggcgccggcatccccatcccggccgccaagaacaccgaataccgccacgccgccaacgacgacgccgatgataaattcgggtaccagacggtgcgggcgccgtcgatggagccggcgccggaggggccggggttcgaggtgtcggacgggcacacggtgcggtgggccgggtgggagttccacctgaaggcggacgcgcgggcggggctgatcgtgtcccgcgcgacggtgcaggacccggcgaccggggcgcggagggaggtgatgtacaagggcatggcgtcggagctgttcgtgccctacatggacccgacggaggcgtggtacttcaagacgtacatggacgccggcgagtacggcttcgggctgcaggccatgccgctggtgccgctcaacgattgcccccggcacgcgcggtacatggacggcgtgttcgtggccgccgacggccggccgtacgtgagggagaagatgatctgcgtcttcgagcggtacgccggcgacatcgcgtggcgacactccgagagccccatcaccggcatggacataagggagtcccgggcgaaggtgacgctggtggcgcgcatggcggcgtcggtggccaactacgactacatcgtcgactgggagttccagaccgacgggctcatccgcatcaaggtggggcttagcgggatcctgatggtgaagggctcgccctactcccacatgaaccaggtccggaaaaacgaggagatgcacggcaccctcctctcggagaacatcatcggcgtcatccatgaccactatgtcaccttccgcctcgacatggacgtcgacggcgccgacaactccttcgtccgggtcgacatggctcgccaggacaccgcacccggcgagtccccgcggaggagctacctcaaggcaacacgccacgtcgcgagcaccgagaaagacgcaaaggtgcgtctgaagctctatgagccggccgagttccacgtaatcaacccgaccaagaagacgcgtgtcgggaacccggtgggctacaaggtcgtccccgccggcaccgccgccagcctgctggaccccgaggacccgccgcagaagaggggtgcattcacaaacaatcagatttgggtcacgccctacaacaagagtgaagaatgggccggtgggctgttcgtgtaccagagcaaaggggaggacacgctggctacttggacggagagggaccgtccgatcgagaacaaggacctggtgctgtggtacacgctggggttccaccacatcccttgtcaggaggacttccccatcatgcccactgtgtcgtccagcttcgacctcaagccggtcaacttcttcgagagcaaccccatcctcaagcagcgacccaccatggagaaggatctccccgtctgcgtcgctaccgcgtgagaacatgcaccacaatacatgtgtgctctcgacgtcgacgtacaaacactgggatgttgcccggggcatgaggtcgtgcgtaggcttccggaatcaccatggtgtgtccagtatactgaagttggcgccggggacttacctaatcttgcctccgtgtgtggttagccaatagcctagtatgtatagctctatgtttgtgttgtatcctactttgagtgtggacgatctgaacccatgcgttgttggcttttgaacgtgcgtatgcag

SEQ ID NO: 1042 - DNA, 2576 bp, Triticum aestivum
gatagcggcgagagctcagctcactcacggtcacgcgcaccgctagctcccatggactactccacctccctcctccgcctcaccttcctcgccctcggcgccgccctggtcctcatcgtcgcccgctccgccttccgcctgccgctcgccatcaacgccccggccgcctccttcttgcacggcgccggcggctgcacccgattctcgccgtgggcctgccgctcgccacgaaccggcaaggccccgccacgccgcccatcgcacgagtccgacgtgccgcgccacccgctcgacccgctcacggtgacggaggtcaaccgcgcgcgcgagctcctccgagcgcacccgccgttcgcgtcggctccgtcggccctggccgtgcacgcgctcgcgctcgacgagccggacaagcccgccgtccggcgctggcggaagggcgcccacgcgctcccgccgcgccgcgccgtcgcggtcgtccgcttccagggggagtcccacgtgctcgccgtcgacctcgcggccggcaaggtcgcccctctgcccgtgccggcctccggctacccgacgatgaccatggacgagcagaccgccctctgcgcggcgccgttcagagacccggcgttcaacgccaccatccggcgccgcggcgtgcgcctggccgacgtcgcgtgcctgcccatctcccccgggtggtacggccccgccgaggacggcggccgccggctcatcaaaagccagtgctactccaccgagggcaccgccaacttctacatgcgccccatcgagggcctcaccgtgctcatcgacatggacaccgggaaggtcgtccacatctccgaccgcggcgccggcatccccatcccggccgccaagaacaccgactaccgccttgccgccaacgacgacgccgatagattcgggtaccagacggtgcgggcgccgtcgatggagccggcgccggagggcccaggaatccagattgaggacgggcacacggtgcggtgggccgggtgggagttccacctcaaggcggacgcgcgcgcgggactggtcgtgtcccgcgcgacggtgcaggacccggccaccggggcgcggagggaggtgatgtacaagggcatggcgtcggagctgttcgtgccgtacatggacccgacggaggcgtggtacttcaagacctacatggacgccggcgagtacggcttcggcctgcaggccatgccgctggtgccgctcaacgactgcccgcgccacgcgcggtacatggacggtgtcttcgtcgccgccgacggccggccgtacgtccgggacaacatgatctgcgtcttcgagcgctacgccggcgacatcgcgtggcgacactcggagagccccatcaccggcatggacataagggagtcccggccgaaggtgacgctggtggcgcgcatggcggcgtcggtggccaactacgactacatcgtcgactgggagttccagaccgacggcctcatccgcatcaaggtcgggctcagcgggatcctgatggtgaagggcacgccctactcccacatgaaccaggtccggcaaaacgaggagatgcacggcaccctcctctccgagaacgtcatcggcgtcatccacgaccactacgtcaccttccgcctcgacatggacgtcgatggcgccgacaactccttcgtccgcgtggacatggcccgccaagacaccgcgcccggcgagtccccacggaggagctacctcaaggccacacgccacgtcgcgagcacggagaaggacgcccgggtccggctgaagctctacgagccggccgagttccacatcatcaacccgacgaagaagacacgtgtcggcaaccccgtgggctacaaagtcgtcccggccggcactgccggtagcttgctggaccccgaggaccctccgcagaagaggggcgcattcacaaacaatcagatttgggtcacgccctacaacaagaacgaagaatgggccggtgggctgttcgtgtaccagagcaaaggggaggacacgctggctacttggtcggagagggaccgtccgatcgagaacaaggacctggtgctgtggtacacgttggggttccaccacatcccttgtcaggaggacttccccatcatgcccactgtgtcgtccagcttcgacctcaagccagtcaacttcttcgagagcaaccccatcctcaagcagcggcccaccatggagaaggacctccccgtctgtgccgctaccgcctgagaccatgcaccaggatacatatgtgctcgaagacaaaccccgggcacactgggctgttgcccggggcatgaggccgtgcgtaggcttccggcagcaccatgcagtgcccctagccttacataatccggcctccgcctctggctagccaatagcctagtatgtatagctctatgtttgtgttgtatggtgcttcccccttcatgaatatgaagtgtatttaggctgtctaagaatcttggaccgatggtaataaattgggtgccgacgtgaaggaaaattaaaccattggattcatgtttaaaagtaaaaaaaaaaaaaaacga

SEQ ID NO: 1043 - DNA, 2480 bp, Avena sativa
tgacgcagtaacactgctcacaccactgaccgctccgatggattactccacctccctgctccgcctcaccttcctcgccctaggcgccgccctggtcctcctcgtcgtccgctcggccttccgactccccggacatggcatcgacaccgcaacatcctcgctcttcgatgacggcgccggctgcacccggttctcgccgtgggcctgccaccaacgccaacggcagacggacaagacatcaaagtcaaagccgtccccgccacgctcctcgcacgagtccgacgtgccgcgccacccgctggacccgctcacggtgacggaggtcaaccgcgcgcgcgagctcctgcgcgcttacccgccgttcgcgtcgtcgccgtcgtccctggccgtgcacgagctcgcgctcgacgagccggacaagcccgtcgtccggcgctgtcgcaagggcgacgggaacgcgctcccgccgcgccgcgccgtggcggtcgtccggttccggggcgagtcccacgtgctcgccgtggacctcgaagctgggacggtcacgcctctgcctgcccctgcttccgggtacccgacgatgaccatggacgagcagagagcgctctgcgcggcgccgttcgcggacccggcgttcaacgccagcatccgccgccgcggcgtgcgcatggccgacgtggcgtgcctgcccatctcgccggggtggtacggccccgtggaggacggcgggcgccggctcatcaagagccagtgcttctcgacggagggcacggccaacttctacatgcgccccatcgagggcctcacggtgctgatcgacatggacaccagggaggtggtccacctctccgaccgcggcgccggcatccccatcccggccgccaagaacaccgactaccgccgcgccgccgcagccgaagaagaagaagacgctggtggggctaaaacgttcgggtaccagaccgtacgtgcgccgtcgatggagccggcgccggaggggccggggttcgaggtggaggacgggcacacggtgcggtgggccgggtgggagttccacctgaaggcggacgcgcgcgccgggctgatcgtgtcccgcgcgggcgtgcaggacccgtcgacgggcgcgcggagggaggtgatgtacaagggcatggcgtcggagctgttcgtgccgtacatggacccgacggaggcgtggtacttcaagacgtacatggacgcgggcgagtacgggttcgggctgcaggccatgccgctggtgccgctcaacgactgcccgcgccacgcgcggtacatggacggcgtgttcgtcgccgccgacgggcggccctacgtgcgggagaacatgatctgcgtcttcgagcgctacgccggcgacatcgcgtggcgccactccgagagccccatcaccggcatggacataagggagtcgcggccgaaggtgacgctggtggctcgcatggcggcgtcggtggccaactacgactacatcatggactgggagttccagatggacggcctcatacgaatcaaggtcgggctcagcgggatcctgatggtgaagggcacgccctactcccacatgaaccaggtccggcggaacgaggagatgtacgggaccctcctctccgagaatgtcgtcggggtcatccacgaccactacgtcaccttccgactcgacatggacgtcgacggcgccgacaactccttcgtccgggtcgagatggcccgccaggacaccgccccgggcgagtcaccccggaggagctacctgaaggccacccgccacgtcgcgagcacggagaacgacgcgaagatccggatgaagctctacgagcccgccgagttccacgtcatcaacccgacgaagaagacgcgtgtcggtaacccggtgggctacaaggtcgtcgccgccggcaccgccgctagcttgctcgaccccgaggacccgccgcagaaaaggggtgcattcacaaacaatcagatttgggtcacgccctacaacaaaagcgagcaatgggctggtgggctgttcgtgtaccagagcaaaggggaggacacgctggctacctggtcggagagggaccgtccgatcgagaacaaggacatcgtgctgtggtacacgctggggttccaccacgtgccgtgccaggaggacttccccatcatgcccacggtgtcgtccagcttcgacctcaagccggtcaacttcttcgagagcaacccgatcctcaggcagcggcccacccaagtgaacgacctcccggtctgtgccgtgaccgcctgagatcgtcgaccattgattcgcgatcatgtagccgtatcatcatctgtgctagtatgtggctagctagtagcctggcagcacgtgatatggctctacgtttgtgttgtatattgtgcttcctatgtccatgatacagggtgtagttcgatcgacactggatgatgacctagtaataaatggatggcatatatga

SEQ ID NO: 1044 - DNA, 2584 bp, Oryza sativa
tcactacaaagcacaaaggccagagcgaaggccactccaatggatcactccacctccctgctccggctcatcttcctcgccctcggcgcagccctcgtcgtccttgtcgttcgctccgcgttccgccttcccggcgacatcgacacgactacgacctctctgttcgatgatggcaacggcggcagctgcaccaggttctcgccgtgggcgtgccggcaagggcggggcgacccgaggtcgaagccgtccaagccgcggcgaccgtcgcacgagtccgacgtgccgcggcacccgctcgacccactcacggtgagggaggtgaaccgcgtccgcgagctcctccgcgcgcacccgctgtttgcgtcggcgccgtcgtccctgttcgtgcactcgctggagctcgacgagccggaaaagtccgtcgtcaagagctggcggaagggcgccgacccgctcccgcctcgccgcgccgtggccgtcgtccggttccgcggcgagtcccacgtcctcggcgtcgacctcagcgagggcgacggcgcggtgactcctctgcctgtccctgcctccggttacccgatgatgaacatggacgagcagaccagcctctgcttcgcgccgttcaaggacgaggcgttcaacgccagcctcctccgccgtggcgtcagggcctccgacgtcgcctgcctgcccatctccctcggctggtacggcccagcggaggagaaccggcgactcatcaagagccagtgcttctccaccgagggcacggccaacttctacatgcgccccatcgagggcctcaccgtgctggtcgacatggacacggcggaggtcctccacgtctccgaccgcggcgccggcatccccatccccgccgccgcgaacaccgactaccggcacggacactcggcgccgactccggcggaggcgcaagcgcaggggcggcacgggtaccagaccgtccgcgtgccgtcgatggagccgccggcgggcgggccggggttcgagctggtcgacgggcacacggtgcggtggggcgggtgggagttccacctgaagcccgacgcgcgcgccggcatggtggtgtcgcgggcgcgggtgcaggacccggcgaccggcgagcaccgcgacgtgatgtacaagggcatggcgtcggagctgttcgtgccgtacatggacccgacggaggcgtggtacttcaagacgtacatggacgccggcgagtacggcttcgggctgcaggccatgccgctcgtcccgctcaacgactgcccgcgccacgcccgctacctcgacgccgtcttcgtcgccgccgacggccgcccctacgtgcgcgagaacatgatctgcgtcttcgagcgctacgccggcgacatcgcgtggcgacactccgagagccccatcaccggcatggacataagggagtcgcggccgaaggtgacgctggtggcgcgcatggcggcgtcggtggccaactacgactatatcgtcgactgggagttccagatggacggcctcgttcgcatcaaggttgggctaagtgggatcctcatggtgaagggcacccagtactcccacatgaaccaggtccatcaaaatgacaatatgtacggcacccttctgtctgagaacgttattggcgtcatccatgaccactttgtcactttccggctcgacatggacattgacggcgccgacaactccttcgtcaaggtggcgatggcacgacagaacaccggcgccggcgaatcccctcgtaagagctacctgaaggctacccgacatgtcgcaaggacggagaaagatgcccaggtccgcctgaagctatatgagccatccgagttccacattgtcaaccccatgaagaagacacgagttgggaaccctgttggttataaggttgtcccagccggtactgcagctagcctgttggatccagaggacccacctcagaagaggggtgcattcacaaataatcagatttgggtgacaccctacaacaaaacagaggaatgggctggtggtctatttgtctaccagagcaaaggggaggacacacttgcaacttggtccgaaagggaccgtccgatcgagaacaaggacctggtgctgtggtacacgctggggtttcaccatgtcccgtgccaggaggacttccccatcatgcccacggtgtcgtccagcttcgaccttaagccagtgaacttctttgagagcaaccccatcctagggcagcgtccgacccaggagaacgacctgccggtgtgtgccgccgctgccacgacctcttgagacgacagcggatcaccgacatgtgtgcgtgcatggtcgatgcttcggtgtatcgatctactgatatggattgttcatagtgaaagaatgtatcggtacatctacggatttggagctagccatggctggctatctatgttgctctatatatgtatgagcggatgtatgtgcactgcagtggtatgaacataattgagaacctgaaaggagcaggcttcaaggctgcactcaagtttcccttggaactactatggcggaccattacaatacaaacccacaaaagggaagaagc

SEQ ID NO: 1045 - DNA, 2730 bp, Setaria italica
tcaccatatatacaccgctcctcactgagctagctcagcgccgtgcacacaccgaggcaagaggacacaacaccaccgctccaatggatcactccacctcccttctccggttcatcttcctctccctcggcgccgccctcatcctcctcgtggtccgctccgccttccgcctgccacgcggcatcgacacgtcgacagcctctctcttggacgccgccgccgccgcgggcagcggctgcacccggttcgcgccgtgggggtgccgccaggccaaccggatgacgaagccgaagccgccgtcacacgaggacgacgtgccgcggcacccgctggacccgctgacgatcggtgagatcaaccgcgcgcgcgagctcctccgcgcgcacccgcctttcgcgtcgtcgccgtcatccctgttcgtgcactcgctggcgcttgacgagccggagaaggccgtcgtcctgggctggcggaagggcgacccgctgcctccccgccacgccgtggcggtcgtccggttccgcggcgaggcctccgtgctcgccgttgacctcgccggcagcgccgtgacccctctccccgtccccgcctccgggtacccgaccatgaccatggacgagcaggtgtcactctgcttcgcgccgttcgctgaccccaagttcaacgccaccatccggcggcgcggcgtccggatgtccgacgtcgcgtgcctgcccatctccctcgggtggtacggccccaccgaggagaaccgccggctgatcaaggttcagtgcttctccgccgagggcacggccaacttctacatgcgccccatcgagggcctcaccgtgctggtcgacatggacacgagtgaggtcgtccacatctccgaccgcggcgccggcatcccgatcccggacgccgccaacaccgactaccgcctcgcacgccacatgcaggaacgacaagatgctggcctcgggtaccagaaggtgcgcgcgccgtcgatggagccggcgccgtcgggcccaggcgtcgagctggtggacgggcacacggtgcggtggggcgggtgggagctccacctgaaggcggatgcgcgcgccggcatggtggtgtcgcgcgcgcgggtgcaggacccgggcacgggcgcgcaccgggaggtgatgtacaagggcatggcgtcggagctgttcgtgccgtacatggacccctccgaggcgtggtacttcaagacgtacatggacgccggcgagtacggcttcgggctgcaggccatgccgctggtgccgctcaacgactgcccgcgccacgcgcagtacgtcgacggcgtcttcgtggccgccgacggccggccctacgtgcgcgggaacatgatctgcgtcttcgagcggtacgccggcgacgtcgcgtggcgacactcagagagccccatcaccggcatggacataagggagtcgcggccgaaggtgacgctggtggcgcggatggtagcgtccgtcgccaactacgactacatcatggactgggagttccagatggacggcctcgtccgcatcaaggttgggctcagcggcatcctcatggtgaagggcacggcctactcgcacctaagcgaggccagcgagaacgaggacatgcacggcacgctcctctccgagaacgtcatcggcgtcatccacgatcactacgtcaccttccgcctcgacatggacgtcgacggcaccgacaactccttcgtgcgcgtcgagatggcgcgccaggagaccggccccggcgagtccccccggaggagctacctcaaggccacccgccacgtcgcgcagaccgagaaggatgcccaggtgcgcctcaagctctaccagccggaggagttccacgtcatcaacccgaccaagaagacgcgcgtcggcaaccccgtcggttacaaggtcgtccccgccggcaccgccgccagcttgctcgaccccgaggatccgccgcagaagagaggcgccttcacaaacaatcagatatgggtgacaccctacaacaagagcgaggaatgggcaggtggtctgttcgtgtaccagagcaaaggggaggacacgctggccacttggtccgagagggaccgtccgatcgagaacagggatctggtgctgtggtacactctgggattccaccacatcccctgccaggaggacttccccatcatgcccaccgtgtcctccagcttcgacctcaagcccgtcaacttcttcgagagcaaccccatcctcaagcagcggccgaccgaggacgacgacctgccggtctgtgccgccgccgctagatgagtgcgcgctgtcgcgacaccgtccatcagcggccgtggacgcgtgttcccctgtgcctgttatgtaccgttgggcatgtagccatgtccctgtgctcgtgctagtagctatagtatgtgatgcagctgcgtcatctcctctgccatgtatgaccaaactaaatgaggactttgagtcaatgcattgcatatcagttgcgacgacgtctatctccaggagccctgcagatttatactccctccgttctcacatgcaattagtttattttaagctagatagcttgtcctaaacatcatatatttagagagatagtacacattagcaaactaaagtgcttgcagtgtttatccttgtgtttgttggatatgattcaaattataatatgagtagtggggacatctggactgcccacggtttggatcgtgtgatt

SEQ ID NO: 1046 - DNA, 2686 bp, Sorghum bicolor
atgcatatatactgaccggcttctcacttggtagctcactccgagaccaaaaagaagacagccgccctgatggatcactccacctccctgctccggctcatcttccttgctcttggcgcagccctggttctccttatcgtccgctccgccttccgcctcccacgtggaatcgacacacccaccacctcactcttcgatgacgccaccgccggcagcagctgcacacggttcgcgccatgggggtgccgccaggccgaccggattaagcaggagcagaagccgaagccggagccgccgtcgcacgagaacgacgtgccgctgcacccgctcgacccactgacggtcaccgagataaaccgtgcgcgcgagctcctccgcgcgcacccgccgttcgcgtcgtcgccgtcgtccatgttcgtgcactcgctggcgctcgacgagccggacaagcccgtcgtcctgagctggcggaagggcgccgacccgctgcccccgcgacgcgccgtggcggtggtccggttccgcggcgaggccttcgtcctcgccatcgacctcgccagcggcgccgtgactcctctgcctgccccagcttccgggtacccgaccatgaccatggacgagcaggtgtccctctgctatgcccctttcagtgacccggcgttcaacgccaccgtccagcggcacggcgtccgtatgtccgacgtcgcctgcctgccgatctccctcgggtggtacggccccaccgaggagaaccgccggctgatcaagatccagtgcttctccgcggagggcacggccaacttctacatgcgccccatcgagggcctcaccgtgctgctggacatggacacgagggaggtcatccgcatctccgaccgcggcggcggcatccccatcccgcccgccgccaacaccgactacaggtatgcccgccacatgcaagaagacgtcggcggcgaccagacgacgtcgaggagtgaggcggggttccagaaggtgcgggcgccgtcgatggagccggggccgtcgtcggggccgggagtggagctggtggacgggcacacggttcggtggggcgggtgggagttccacctcaaggcggacgcgcgcgccggcatggtggtgtcgcgcgcacgggtgcaggaccccggcacgggcgcgcaccgggaggtgctgtacaagggcatggcgtcggagctcttcgtgccgtacatggacccgaccgaggcgtggtacttcaagacgtacatggatgccggcgagtacggcttcggcctgcaggccatgccgctggtgccgctcaacgactgcccacgccacgcacggtacctcgacggcgtgttcgtggccgccgacggccggccctacgtgcgggagaagatgatctgcgtcttcgagcggtacgccggcgaggtcgcgtggagacactcggagagccccatcaccggcatggacataagggagtcgcggccgaaggtgacgctggtggcgcggatggttgcgtccgtggccaactacgactacatcatggactgggagttccagatggacggcctcgtccgcatcaaggtgggcctgagcgggatcctgatggtgaagggcacggcctactcccacctacgggaggcccgcgagaacgaggacacgcacggcacgctgctctccgagaacgtcatcggcgtcatccacgaccactacgtgacgttccgcctggacatggacgtcgacggcgccgacaacaactccttcgtgcgcgtggagatggcgcggcaggagacggcccccggcgagtccccccggaggagctacctcaaggccacccggcacgtggcgcggaccgagaaggacgcccaggtgcgcctcaagctctacgatccggccgagttccatgtcgtcaacccgaccaagaagacgcgggtcggcaaccccgttggctacaagctcgtccctgccggcaccgccgccagcttgctggacccggaggatccgccgcagaagaggggtgctttcacaaacaatcagatctgggtgacaccctacaacaagagcgaggaatgggccggtggtctgttcgtgtaccagagcaaaggggaggacacattggctacttggtccgagagagaccgtccgatcgagaacaaggacctggtgctgtggtacacgctggggttccaccacatcccgtgccaggaggacttccccatcatgcccaccgtgtcctcaagcttcgacctcaagcctgtcaacttcttcgagagcaaccccatcctcaagcagaggcccaccaaggaggatgatctgcccatctgttccgccaccgccgtgtaatataatcagcgctgcatgcgacgccatccatggacgacggcggcgatcgatgtttcggtggccatgggcgtgggcgcatatgtatttcctagcctaggagggcgaactgattaactggacccatgcataagcttgcatcgctgtgtgttcttcctagctttagtacgtacctggtgcagccatatctcatctgtgtttgttatgtcaaatcagaactttgatcagctaatgcatggagcatatttggttgttatatgatgacttctgtctcatagagccactaaggcacaatagcagattcaagccctgcttacagtgtttcatcgttgagtaatacatgatttgtggcttatagaaa

SEQ ID NO: 1047 - DNA, 2876 bp, Sorghum bicolor
aaatttgcgcgctctgaccacaatcctgacgaaattattggacgtctacgtctcccatcttcaaactcgccggccagtagccaaaggaaaaaaaaatatttgcgcttcgaacaacgtagttccttcaaaaacagtagtccgtacacgtcgccccgatgctacacactacacattggatattcccaaccatgcatatatactgaccggcttctcacttggtagctcactccgagaccaaaaagaagacagccgccctgatggatcactccacctccctgctccggctcatcttccttgctcttggcgcagccctggttctccttatcgtccgctccgccttccgcctcccacgtggaatcgacacacccaccacctcactcttcgatgacgccaccgccggcagcagctgcacacggttcgcgccatgggggtgccgccaggccgaccggattaagcaggagcagaagccgaagccggagccgccgtcgcacgagaacgacgtgccgctgcacccgctcgacccactgacggtcaccgagataaaccgtgcgcgcgagctcctccgcgcgcacccgccgttcgcgtcgtcgccgtcgtccatgttcgtgcactcgctggcgctcgacgagccggacaagcccgtcgtcctgagctggcggaagggcgccgacccgctgcccccgcgacgcgccgtggcggtggtccggttccgcggcgaggccttcgtcctcgccatcgacctcgccagcggcgccgtgactcctctgcctgccccagcttccgggtacccgaccatgaccatggacgagcaggtgtccctctgctatgcccctttcagtgacccggcgttcaacgccaccgtccagcggcacggcgtccgtatgtccgacgtcgcctgcctgccgatctccctcgggtggtacggccccaccgaggagaaccgccggctgatcaagatccagtgcttctccgcggagggcacggccaacttctacatgcgccccatcgagggcctcaccgtgctgctggacatggacacgagggaggtcatccgcatctccgaccgcggcggcggcatccccatcccgcccgccgccaacaccgactacaggtatgcccgccacatgcaagaagacgtcggcggcgaccagacgacgtcgaggagtgaggcggggttccagaaggtgcgggcgccgtcgatggagccggggccgtcgtcggggccgggagtggagctggtggacgggcacacggttcggtggggcgggtgggagttccacctcaaggcggacgcgcgcgccggcatggtggtgtcgcgcgcacgggtgcaggaccccggcacgggcgcgcaccgggaggtgctgtacaagggcatggcgtcggagctcttcgtgccgtacatggacccgaccgaggcgtggtacttcaagacgtacatggatgccggcgagtacggcttcggcctgcaggccatgccgctggtgccgctcaacgactgcccacgccacgcacggtacctcgacggcgtgttcgtggccgccgacggccggccctacgtgcgggagaagatgatctgcgtcttcgagcggtacgccggcgaggtcgcgtggagacactcggagagccccatcaccggcatggacataagggagtcgcggccgaaggtgacgctggtggcgcggatggttgcgtccgtggccaactacgactacatcatggactgggagttccagatggacggcctcgtccgcatcaaggtgggcctgagcgggatcctgatggtgaagggcacggcctactcccacctacgggaggcccgcgagaacgaggacacgcacggcacgctgctctccgagaacgtcatcggcgtcatccacgaccactacgtgacgttccgcctggacatggacgtcgacggcgccgacaacaactccttcgtgcgcgtggagatggcgcggcaggagacggcccccggcgagtccccccggaggagctacctcaaggccacccggcacgtggcgcggaccgagaaggacgcccaggtgcgcctcaagctctacgatccggccgagttccatgtcgtcaacccgaccaagaagacgcgggtcggcaaccccgttggctacaagctcgtccctgccggcaccgccgccagcttgctggacccggaggatccgccgcagaagaggggtgctttcacaaacaatcagatctgggtgacaccctacaacaagagcgaggaatgggccggtggtctgttcgtgtaccagagcaaaggggaggacacattggctacttggtccgagagagaccgtccgatcgagaacaaggacctggtgctgtggtacacgctggggttccaccacatcccgtgccaggaggacttccccatcatgcccaccgtgtcctcaagcttcgacctcaagcctgtcaacttcttcgagagcaaccccatcctcaagcagaggcccaccaaggaggatgatctgcccatctgttccgccaccgccgtgtaatataatcagcgctgcatgcgacgccatccatggacgacggcggcgatcgatgtttcggtggccatgggcgtgggcgcatatgtatttcctagcctaggagggcgaactgattaactggacccatgcataagcttgcatcgctgtgtgttcttcctagctttagtacgtacctggtgcagccatatctcatctgtgtttgttatgtcaaatcagaactttgatcagctaatgcatggagcatatttggttgttatatgatgacttctgtctcatagagccactaaggcacaatagcagattcaagccctgcttacagtgtttcatcgttgagtaatacatgatttgtggcttatagaaata

SEQ ID NO: 1048 - DNA, 2904 bp, Zea mays
tccgtagtccgtacacgtccacattggatattccctgccaagtgccaccgactgccaaagagcgcagccacacacctcgccatatgtacatatactgacccgcttctcactcggtagctcactcttaagaccaaaaaagaaacgagaaaaaaagaagagagctgctctgatggatcgctccacctccctgctccggctcatcttgcttgctcttggcgcagccctggtgctcctcgtcgtccgctccgccttccgcctcccacgtggaatcgacacacccaccacctcactcttcgatgacgaagccaccgcgggcagcagctgcacccggttcgcgccgtgggggtgccggcaagccgaccggattaagcagaagccgccgtcgcacgagaacgacgtgccgcggcacccgctcgacccactgacgatcagcgaggtaaaccgtgcgcgcgagctcctccgcgcgcacccgccgttcgcatcgtcgccgtcgtccatgttcgtgcactcgctcgcgctcgacgagccggacaagcccgtcgtcctgagctggcggaagggcgtcgacccgctgcccccgcggcgcgcggtggcggtggtccggttccgcggtgaggccttcgtcctggccattgacctcgccagcggcgccgtgactcctctgcctgtcccagcttccgggtacccgaccatgaccatggacgagcaggtgctcctctgctacacgcctttcagggacccggcgttcaacgcgaccatccagcggcacggcgtccgcctgtccgatgtcgcctgcctgcccatctcgctcgggtggtacggccccagcgaggagaaccggcggctgatcaagatccagtgcttctccgcggagggcaccgccaacttctacatgcgccccatcgagggcctcaccgtgctggtggacatggacacgagggaggtggtccgcatctccgaccgcggcgccggcatccccatcccgcccgccgccaacaccgactaccggtactcccgccacatgcaagacgaaggcgacgaccagcagacagcggggttccagaaggtgcgggcgccgtcgatggaaccggggccgtcgtcagggccgcgggtggagctggtggacggccacacggtgcggtggggcgggtgggagttccacctcaaggcggacgcgcgcgccggcatggtggtgtcgcgcgcacgggtgcaggaccccggcacgggcgcgcaccgggaggtgctgtacaagggcatggcgtcggagctgttcgtaccgtacatggaccccaccgaggcgtggtacttcaagacgtacatggacgccggcgagtacggcttcggcctgcaggccatgccgctggtgccgctcaacgactgcccgcgccacgcgcgctacctggacggcgtgttcgtggccgccgacggacggccctacgtgcgcgagaagatgatctgcgtcttcgagcggtacgccggtgaggtcgcgtggagacactcggagagccccatcaccggcttggacataagggagtcgcggccgaaggtgacgctggtggcgcggatggttgcgtccgtggccaactacgactacatcatggattgggagttccagatggacggtctcgtccgcattaaggttgggctgagcgggatcctgatggtgaagggcacgtcctactcccacctgagcgaggcccgcgggaacgagggcgacatgcacggcacgctgctctcggagaacgtgatcggcgtcatccacgaccactacgtgaccttccgcctggacatggacgtcgacggcgccgacaactcgttcgttcgcgtggagatggcgcggcaggagacgggccccggcgatgagtcgccccggaggagctacctcagggccacccgccgcgtggcggagaccgagaaggacgcgcgggtgcgcctcagcctctaccacccggcggagttccacgtcgtcaaccccgccaagaagacgcgcgtcggcaaccccgttggctacaaggtcgtccctgccggcaccgccgcgagcttgctggacccggaggatccgccgcagaagaggggtgctttcacaaacaatcagatatgggtgacgccctacaacaagagcgaggaatgggccggcggcctgttcgtgtaccagagcaaaggggaggacactctggatacttggtccgagagagaccgtccgatcgagaacaaggacctggtgctgtggtacacgctggggttccaccacatcccgtgccaggaggacttccccatcatgcccaccgtgtcgtcaagcttcgacctcaagccagtcaacttcttcgagagcaaccccatcctcaagcagcgcccgaccaaagaggatgatctgcccatctgtactgcctccaccgccgcgtagcctactaggagggccgggggcgaactgattaaccggagacccatcaatcagcttgcatgcattgctgtgtgttgtgctcttgctaagctttattagtacgtaccacgaacctaatgcatgggccgtatctcatagtactccgtcagttctattttatttgtcacggtttagtttaaaaatgaactaacgaacaacgaatattcgaaaacggttatgataaatgagaactttgttggtatgatcagctaatgcatggagctatcggttgtgatggactttggatgctcgctttcttttcgatctaacccgggtgttaaccctttagtcctggctggtgtaacaccaattgggactagtgcagaccttttagtcacgacgtctataaaacttgggtccgaaactaatactcacatataatcttggtcggttggaggctcgggattcagggaactaatactcacatataatcttggttggttggaggctcgggattcagaggg

SEQ ID NO: 1049 - DNA, 721 bp, Secale cereale
gactagtaccaccaaggcctacccctacccctaccggtacccttacggcccgccgcccgccgcccgccgaggtcggtcgccggacgccatggctcccaccaagaagtcgaagaagagcacggagaacatcaacaacaagctgcagctggtgatgaagagcggcaagtacacgctcggctacaagaccgtcctcaagacgctccggagctccaaggggaagttgattatcctcgcaaacaactgccctccgctcaggaagtctgagatcgagtactatgctatgctgtccaagatcagcgttcatcatttccatggaaacaatgtggatcttggaactgcgtgcggcaagtactaccgggtgtgctgtttgagcatcctggaccctggtgactcggacatcatcaccaccgttcctcagtgaagacaagcttacccatcctagccttaagattatgtagtgtggagagtcgtgcttacagggccgatggccgtctctctcgttatcgagccggtgctgccaagcgcagtttgaaaccagacatggctgtttttgtaaggcattcctatgggtttcgttttgtgatgagatgtttattcctatggtcttttcaccgaatgcaattggatgattagttatgaccaaaaaaaaaaacaaaaaaaaaataaaatctcgtgtatactacactctcttcgacgctcgacgacgcacaggaggagcgcc

SEQ ID NO: 1050 - DNA, 812 bp, Secale cereale
ctacctaccttacctacgcccgtccgcccgccgcccgccgaggtcggtcgccggacgccatggctcccaccaagaagtcgaagaagagcacggagaacatcaacaacaagctgcagctggtgatgaagagcggcaagtacacgctcggctacaagaccgtcctcaagacgctccggagctccaaggggaagttgattatcctcgcaaacaactgccctccgctcaggaagtctgagattgagtactatgctatgctgtccaagatcagtgttcatcatttccatggaaacaatgtggatcttggaactgcgtgcggcaagtactaccgggtgtgctgtttgagcatcctggaccctggtgactcggacatcatcaccaccgttcctcagtgaagacaagcttacctatcctagcctaagatgatgtagtgtggagagtcgtgcttacaaggccgatggccgtctctcgttatcgagccggtgctgccaaacgcagtttcaaaccaaacatggctgtttttgtaaggcattcctatggttttgtttgatgagatgtttattcctatggtccttttaccgaatgcaattggatgattagttctgttaacattgctttaccttgctcctctagtgagacagaactagaacaagaattgcgtgcaactggttgatgcctgtgcaatctttgctttgccacggtcgagcagagatgctgttttttttgtgatgatatgatttcaccgaacctggcacactaatttcactacattgcagaactttaccaaacgatgagagtgaatttgttactgctga

SEQ ID NO: 1051 - DNA, 904 bp, Secale cereale
aggtcggtcgccggacgccatggctcccaccaagaagtcgaagaagagcacggagaacatcaacaacaagctgcagctggtgatgaagagcggcaagtacacgctcggctacaagaccgtcctcaagacgctccggagctccaaggggaagttgattatcctggcaaacaactgccctccgctcaggaagtctgagatcgagtactatgctatgctgtccaagatcagcgttcatcatttccatggaaacaatgtggatcttggaactgcgtgtggcaagtactaccgggtgtgctgtttgagcatccttgaccctggtgactcggacatcatcaccaccgttcctcagtgaagacaaaccttacccatcctagcctaagatgatgtagtgtggagagtcgtgcttacaaggccgatggccgtctctctcgttatcgagccggtgctgccaagcgcagtttgaaaccagacatggctgtttttgtaaggcattcctatgggttttgttttgtgatgagatgtttattcctatggtcttttcaccgtatgcaattggatgattagctctgtcagcattcgtttggcttgccttgctcctctagtgaaactggactagaacaactagctttgctgatctgaagaattgcgtcaaactgggtgatgcttgtgcaatctttgctttgccgcggtcgattagagatgctaggtttgtttgtgatgatacgatttcactggacctggcacactaatttctttgaggcgtgtgcacatatgtgatatgattgcatcgtaggcgaattctacaatatactttttgtagtgtacctcacattttgttggtcaaatatacaaaacttgcgcctaacatgaggagctaataagagtatggtggaaacaaatttag

SEQ ID NO: 1052 - DNA, 750 bp, Triticum aestivum
caccagcctcctcctccctcacccgccgctcgccgcccgccgaggttggtcgccggacgccatggctcccaccaagaagtcgaagaagagcacggagaacatcaacaacaagctgcagctggtgatgaagagcggcaagtacacgctcggctacaagaccgtcctcaagacgctccggagctccaaggggaagttgattatcctcgcaaacaactgccctccgctcaggaagtctgagatcgagtactatgctatgctgtccaagatcagcgttcatcatttccatggaaacaatgtggatcttggaactgcgtgcggcaagtactaccgggtgtgctgtttgagcatccttgaccctggtgactcggacatcatcaccaccgttcctcagtgaagacaagcttacctatcctagcctaagatgatgtagtgtggagagtcgtgcttacaaggccgatggccgtctctcgttatcgagccggagctgccaaatgcagtttcaaaccaaacatggctgtttttgtaaggcattcctatgggttttgtttgatgagatgtttattcctatggtctttttacttgcgcaattggatgattagttctgtcaacattgttttgccttgctcctccagtgaaacggaactagaacaactagtcacttaactgaagaattgcgtgagagttggtgatgcttgtgtaatctttgctccggagaaatggaatggtttggaatggtttttgtttcgccgc

SEQ ID NO: 1053 - DNA, 611 bp, Secale cereale
cacgagggccaccagcctccccctccccctcctccctcgcccgccgcccgccgcccgccgaggtcggtcgccggacgccatggctcccaccaagaagtcgaagaagagcacggagaacatcaacaacaagctgcagctggtgatgaagagcggcaagtacacgctcggctacaagaccgtcctcaagacgctccggagctccaagggtaagttgattatcctcgcaaacaactgccctccactcaggaagtctgagatcgagtactatgctatgctgtccaagatcagcgttcatcatttccatggaaacaatgtggatcttggaactgcgtgcggcaagtactaccgggtgtgctgtttgagcatcctggaccctggtgactcggacatcatcaccaccgttcctcagtgaagacaagcttacccatcctagccttaagattatgtagtgtggagagttgtgcttacagggccgatggccgtctctctcgttatcgagccggtgctgccaagcgcagtttgaaaccagacatggctgtttttgtaaggcattcctatgggtttcgttttgtgatgagatgtttattcctatggtcttttcaccgaatgca

SEQ ID NO: 1054 - DNA, 786 bp, Triticum aestivum
tgcatgccaatgactatgttacatctgcgaattacctgatgcatatatgccaactttcttcctcgtgccgaattcggcacgaggcaccagcctcctcctcctcttccctcgccgcccgccgcccgccgcccgccgaggttggtcgccggacgccatggctcccaccaagaagtcgaagaagagcacggagaacatcaacaacaagctgcagctggtgatgaagagcggcaagtacacgctcggctacaagaccgtcctcaagacgctccggagctccaaggggaagttgattatcctcgcaaacaactgccctccgctcaggaagtctgagatcgagtactatgctatgctgtccaagatcagcgttcatcatttccatggaaacaatgtggatcttggaactgcgtgtggcaagtactaccgggtgtgctgtttgagcatccttgaccctggtgactcggacatcatcaccaccgttcctcagtgaagacaagcttacctatcctagcctaagatgatgtagtgtggagagtcgtgcttacaaggctgatggccgtctctcgttatcgagccggagctgccagatacagtttcaaaccaatcatggctgtttttgtaaggcattcctatggttttgttctatgagatgtttattcctatggtcctttacataggcaattggatgattagtactgtcagcattgtttagcttgccttgctcctccagcgaaacgccacacattgctcttttttccccgcaaagaaagggaactaggacaacctgtg

SEQ ID NO: 1055 - DNA, 597 bp, Triticum aestivum
cctcctcctcttccctcgccgcccgccgcccgccgcccgccgaggttggtcgccggacgccatggctcccaccaagaagtcgaagaagagcacggagaacatcaacaacaagctgcagctggtgatgaagagcggcaagtacacgctcggctacaagaccgtcctcaagacgctccggagctccaaggggaagttgattatcctcgcaaacaactgccctccgctcaggaagtctgagatcgagtattatgctatgctgtccaagatcagcgttcatcatttccatggaaacaatgtggatcttggaactgcgtgtggcaagtactaccgggtgtgctgtttgagcatccttgaccctggtgactcggacatcatcaccaccgtccctcagtgaagacaaccttacctatcctagtctaagatgatgtagtgtggagagtcgtgcttatggagccggagctgcgaaatgcagtttcaaaccaaacatggctgtttttgtaaggcattcctatgggttttattttatgagatattcattcctatggtccttgtaccgtgcgcaattggatgattagttctgtcaacattgttttgcct

SEQ ID NO: 1056 - DNA, 730 bp, Hordeum vulgare
gccgcacctatatagcccctgtctctaaaccctagcgagccctccatttgcgtctgcgccgccgcctcccccgaagccatccgcatccccacgctcgctcgccgcggccgcccgacgcgatggctcccaccaagaaggcgaagaagagcggggagaacatcaacaacaagctgcagctggtgatgaagagcggcaagtacacgctcggctacaagaccgtcctcaagacgctccgcagctccaaggggaagctgatcatcctcgcgaacaactgccctccccttaggaagtcagagattgagtactacgctatgttggcgaaaattagcgtgcaccatttccacggaaacaatgttgatcttggaactgcctgcggcaagtactaccgggtgtgctgcctcagcatccttgaccctggtgactcggacatcatcaacaccaccaccaccacccagtgaagagaagagagctctctacctattttatttagtcgagttgtaggttccagttgtgctcttgaaaccaccattgttatctttggtttatgtactcttttgcgacgctgagttggagctgtcatacagataatccttcatatggttgttctgctggacattcatgtggttttgtttccatgatatcgttgtttccattatacttatactgaatgtgcgtggtttggattgctcagctttgttcgtttaagcattgcgtgattcactgattagca

SEQ ID NO: 1057 - DNA, 607 bp, Secale cereale
cggccgcccgacgcgatggctcccaccaagaaggcgaagaagagcggggagaacatcaacaacaagctgcagctggtgatgaagagcggcaagtacacgctcggctacaagaccgtcctcaagacgctgcgcagctccaaggggaagctgataatcctcgcaaacaactgccctccccttaggaagtcagagattgagtactacgctatgttggcgaaaatcagcgtgcaccatttccacggaaacaatgttgatctgggaactgcctgcggcaagtactaccgggtgtgctgcctcagcatccttgaccctggtgactcggacatcatcagcaccaccaccaccacccagtgaagaggagagagctctccacctattttatttagtcgagttgtagggtcctgttgtgctctcggaatcactcttgttatctttggtttatgtacctttttgcgacgctgagttggagctgtcatacagataatacttaatatgattgttctgctggacattcatgtggttttgttttcatgatgtcgttgtttctatcttacttactgttgttagttaagtgctttttgatttcacacaaaaaaaaaaaaactga

SEQ ID NO: 1058 - DNA, 571 bp, Secale cereale
cccgaagccatccgcatccccacgctcgttcgctcgccgcggccgcccgacgcgatggctcccaccaagaaggcgaagaagagcggggagaacatcaacaacaagctgcagctggtgatgaagagcggcaagtacacgctcggctacaagaccgtcctcaagacgctgcgcagctccaaggggaagctgataatcctcgcaaacaactgccctccccttaggaagtcagagattgagtactacgctatgttggcgaaaatcagtgtgcaccatttccacggaaacaatgttgatcttggaactgcctgcggcaagtactaccgggtgtgctgcctcagcatccttgaccctggtgactcggacatcatcagcaccaccaccaccacccagtgaagaggagagagctctccacctattttatttagtcgagttgtagggtcctgttgtgctctcggaatcactcttgttatctttggtttatgtacctttttgcgacgctgagttggagctgtcatacagataatacttaatatggttgttctgctggacattcatgtggttttgttttcat

SEQ ID NO: 1059 - DNA, 545 bp, Secale cereale
ccatccgcatccccacgctcgttcgctcgccgcggccgcccgacgcgatggctcccaccaagaaggcgaagaagagcggggagaacatcaacaacaagctgcagctggtgatgaagagcggcaagtacacgctcggctacaagaccgtcctcaagacgctgcgcagctccaaggggaagctgataatcctcgcaaacaactgccctccccttaggaagtcagagattgagtactacgctatgttggcgaaaatcagtgtgcaccatttccacggaaacaatgttgatcttggaactgcctgcggcaagtactaccgggtgtgctgcctcagcatccttgaccctggtgactcggacatcatcagcaccaccaccaccacccagtgaagagaagagagctctccacctattttatttagtcgagttgtagggtcctgttgtgctctcagaactactcttgttatcttcagtttatgtacctttttgcgacgctgagttggagctgtcatacagataatacttcatatggttgttctgctggacatt

SEQ ID NO: 1060 - DNA, 656 bp, Secale cereale
ctccatttgcgccgccgcctcccccgaagccatccgcacccccttgctcgctcgccgcggccgcccgacgcgatggctcccaccaagaaggcgaagaagagcggggagaacatcaacaacaagctgcagctggtgatgaagagcggcaagtacacgctcggctacaagaccgtcctcaagacgctgcgcagctccaaggggaagctgataatcctcgcaaacaactgccctccccttaggaagtcagagattgagtactacgctatgttggcgaaaatcagcgtgcaccatttccacggaaacaatgttgatctgggaactgcctgcggcaagtactaccgggtgtgctgcctcagcatccttgaccctggtgactcggacatcatcagcaccaccaccaccacccagtgaagagaagagagctctccacctattttatttagtcgagttgtagggtcctgttgtgctctcagaactactcttgttatctttggtttatgtacctttttgcgacgctgagttggagctgtcatacagataatacttaatatggttgttctgctggacattcatgttgttttgttttcatgatgtcgttgtttctgtcttacttactgttgttagttaagtgctttttgattcacacaaatataaga

SEQ ID NO: 1061 - DNA, 542 bp, Secale cereale
ccccgaagccatccgcacccccttgctcgctcgccgcggccgcccgacgcgatggctcccaccaagaaggcgaagaagagcggggagaacatcaacaacaagctgcagctggtgatgaagagcggcaagtacacgctcggctacaagaccgtcctcaagacgctgcgcagctccaaggggaagctgataatcctcgcaaacaactgccctccccttaggaagtcagagattgagtactacgctatgttggcgaaaatcagcgtgcaccatttccacggaaacaatgttgatctgggaactgcctgcggcaagtactaccgggtgtgctgcctcagcatccttgaccctggtgactcggacatcatcagcaccaccaccaccacccagtgaagagaagagagctctccacctattttatttagtcgagttgtagggtcctgttgtgctctcggaaccactcttgttatctttggtttatgacctttttgcgacgctgagttggagctgtcatacagataatacttaatatggttgttctgctg

SEQ ID NO: 1062 - DNA, 537 bp, Hordeum vulgare
cccgaagccatccgcatccccacgctcgctcgccgcggccgcccgacgcgatggctcccaccaagaaggcgaagaagagcggggagaacatcaacaacaagctgcagctggtgatgaagagcggcaagtacacgctcggctacaagaccgtcctcaagacgctccgcagctccaaggggaagctgatcatcctcgcgaacaactgccctccccttaggaagtcagagattgagtactacgctatgttggcgaaaattagcgtgcaccatttccacggaaacaatgttgatcttggaactgcctgcggcaagtactaccgggtgtgctgcctcagcatccttgaccctggtgactcggacatcatcaacaccaccaccaccacccagtgaagagaagagagctctctacctattttatttagtcgagttgtaggttccagttgtgctcttgaaaccaccattgttatctttggtttatgtactcttttgcgacgctgagttggagctgtcatacagataatccttcatatggttgttc

SEQ ID NO: 1063 - DNA, 610 bp, Triticum aestivum
atttgcgccgccgcctcccccgaagccatccgcatccccacgctcgctcgccgcggccgcccgacgcgatggctcccaccaagaaggcgaagaagagcggggagaacatcaacaacaagctgcagctggtgatgaagagcggcaagtatacgctcggctacaagaccgtcctcaagacgctgcgcagctccaaggggaagctgataatcctcgcaaacaactgcccgcccctgaggaagtcagagattgagtactacgctatgttggcgaaaattagcgtgcaccatttccatggaaacaatgttgatcttggaacagcctgcggcaagtactaccgggtgtgctgcctcagcatccttgaccctggtgactcggacatcatcagcaccaccaccaccacccagtgaagagaagagaagagagctctccacctattttatttagtcgagttgtagggtcctgttgtgctctcgaaaccactcttgttatcttcggtttatgtacctttttgcgacgctgagttggagctgtcatacagataatacttcatatggttgttccgctggacattcatgtggttttgttttcatgatatcgttgtttccatctt

SEQ ID NO: 1064 - DNA, 591 bp, Triticum aestivum
tcccccgaagccatccgcatccccacgctcgctcgctcgcccgacgcgatggctcccaccaagaaggcgaagaagagcggggagaacatcaacaacaagctgcagctggtgatgaagagcggcaagtacacgctcggctacaagaccgtcctcaagacgctccgcagctccaaggggaagctgataatcctcgcaaacaactgccctccccttaggaagtcagagattgagtactacgctatgttggcgaaaattagcgtgcaccatttccatggaaacaatgttgatcttggaactgcctgcggcaagtactaccgggtgtgctgcctcagcatcctcgaccctggtgactcggacatcatcagcaccaccaccaccacccagtgaagagaagagaagagagctctccacctattttatttagtcgagttgtagggtcctgttgtgctctcgaaaccactcttgttatcttcggtttgtgtacctttttgcgacgctgagttggagctgtcatacagataatacttcatatggttgttccgctggacattcatgtggttttgttttcatgatatcgttgtttcaatcttg

SEQ ID NO: 1065 - DNA, 675 bp, Triticum aestivum
cccccgaagccatccgcatccccacgctcgctcgctcgcccgacgcgatggctcccaccaagaaggcgaagaagagcggggagaacatcaacaacaagctgcagctggtgatgaagagcggcaagtacacgctcggctacaagaccgtcctcaagacgctgcgcagctccaaggggaagctgataatcctcgcaaacaactgccctccccttaggaagtcagagattgagtactacgctatgttggcgaaaattagcgtgcaccatttccatggaaacaatgttgatcttggaactgcctgcggcaagtactaccgggtgtgctgcctcagcatccttgaccctggtgactcggacatcatcagcaccaccaccaccacccagtgaagagaagagaagagagctctccacctattttatttagtcgagttgtagggtcctgttgtgctctcgaaaccactcttgttatcttcggtttgtgtacctttttgcgacgctgagttggagctgtcatacagataatacttcatatggttgttccgctggacattcatgtggttttgttttcatgatatcgttgtttcaatcttggttatactgttgctcgttaagccttgtgtgattaacacaaatctaagattcttttcagctgaatcatttctaaatttcccccaaa

SEQ ID NO: 1066 - DNA, 709 bp, Brachypodium distachyon
gtctcgctaaaccctagccagttctccatttgcgccgccgcctacacgcatcaccttgctcgtcgtctcccgccgcggccgctcgaaacgatggctcccacgaagaaggcgaagaagagcacggagaacatcaacaacaagctgcagctggtgatgaagagcggcaagtacacgctcggttacaagactgtactcaagacgctgcgcagctccaaggggaagctgattatccttgcaaacaactgccctcctcttaggaagtctgagatcgagtactatgctatgttggcaaaaattagtgtccaccatttccatggaaataatgttgatcttggaactgcctgcggcaagtactaccgggtgtgctgtctcagcatcattgatcctggtgactcggacatcatcagcaccacgcctggaacccagtgattaaatcaagagagagctctgcgtttttagtggagttgtaggggttgaatcgtgtgtccttgttatctttccatcatgtacttttttcctatgttgagttgcagctgtcatagagataatactacttcatatggttctttgcgaagatattcttgtcctatcattttatgataatccttatttccatggagctgggtaagttatgattcttacggtattatttgcgtgcatcttgtttgactttgcttcgtccgttaaccatagtgtgattcgtttattg

SEQ ID NO: 1067 - DNA, 766 bp, Brachypodium distachyon
cggcaggcccaggggtaaccaggtaatgttgttcaaacagccgcacctatatactccgtctcgctaaaccctagccagttctccatttgcgccgccgcctacacgcatcaccttgctcgtcgtctcccgccgcggccgctcgaaacgatggctcccacgaagaaggcgaagaagagcacggagaacatcaacaacaagctgcagctggtgatgaagagcggcaagtacacgctcggttacaagactgtactcaagacgctgcgcagctccaaggggaagctgattatccttgcaaacaactgccctcctcttaggaagtctgagatcgagtactatgctatgttggcaaaaattagtgtccaccatttccatggaaataatgttgatcttggaactgcctgcggcaagtactaccgggtgtgctgtctcagcatcattgatcctggtgactcggacatcatcagcaccacgcctggaacccagtgattaaatcaagagagagctctgcgtttttagtggagttgtaggggttgaatcgtgtgtccttgttatctttccatcatgtacttttttcctatgttgagttgcagctgtcatagagataatactacttcatatggttctttgcgaagatattcttgtcctatcattttatgataatccttatttccatggagctgggtaagttatgattcttacggtattatttgcgtgcatcttgtttgactttgcttcgtccgttaaccatagtgtgattcgtttattg

SEQ ID NO: 1068 - DNA, 706 bp, Avena sativa
gccccgaagccacccgcctcctcctgccgccccgctcgtcgcctgccgaggttggtcgccggacgcgatggctcccaccaagaagacgaagaagaacacggagaacatcaacaacaaattgcagctggtgatgaagagcggcaagtacacgctcggctacaagaccgtcctcaagaccctccggagctccaaggggaagttgattatcctcgccaacaactgccctccgctcaggaagtctgagatcgagtactacgccatgttggcaaagatcagcgtgcaccatttccatggaaacaatgttgatcttggaactgcctgcggcaagtactaccgggtgtgctgtctgagcatcctagatccaggtgactcggacatcatcaccaccgctcctggcgccgcccagtgaagaggagggccttgcctatttagtctgagattatgtagcgtggagctggcaaatgcagttcgaacttcctgtgactgttttgtaacgcattcctatggttttgttttatgagatgttttttcttcctctatggagcagtgaaatcttgtcttttaactgtgcgcggctggtggatgtttagcttctttaacctgtttggcagttaagaaaatcaaatccgcttagtgtttgcttccaatgtcatcagaatgtactttgatgtattttagttttgaccatgtagatctaatattatca

SEQ ID NO: 1069 - DNA, 702 bp, Avena sativa
ccgaagccacccgcctcctcctgccgccccgctcgtcgcctgccgaggttggtcgccggacgcgatggctcccaccaagaagacgaagaagaacacggagaacatcaacaacaaattgcagctggtgatgaagagcggcaagtacacgctcggctacaagaccgtcctcaagaccctccggagctccaaggggaagttgattatccttgccaacaactgccctccgctcaggaagtctgagattgagtactacgccatgttggccaagatcagcgtgcaccatttccatggaaacaatgttgatcttggaactgcctgcggcaagtactaccgggtgtgctgtctgagcatcctagatccaggtgactcggacatcatcaccaccgctcctggcgccgcccagtgaagaggagggccttacctatttagtctgagattatgtagcgtggagctggcaaatgcagttcaaacttcctgtgactgttttgtaacgcattcctatggttttgttttatgagatgtttttcttcttctatggagcagtgaaatcttgtcttttaactgtgcgtggctggtggatcgttagcttctttaacctgttggcagttaagaaggtcaaatcgtctgagtgtttgcttcaaaaggtcatcagaagatactctgatttattgtagttttgcccatctagatctaatattatca

SEQ ID NO: 1070 - DNA, 562 bp, Triticum aestivum
ccgccgcctcccccgaagccatccgcatccccacgctcgctcgccgcggccgcccgacgcgatggctcccaccaagaaggcgaagaagagcggggagaacatcaacaacaagctgcagctggtgatgaagagcggcaagtatacgctcggctacaagaccgtcctcaagacgctgcgcagctccaaggggaagctgataatcctcgcaaacaactgcccgcccctgaggaagtcagagattgagtactacgctatgttggcgaaaattagcgtgcaccatttccatgggaaacaatgttgatcttggaacagcctgcggcaagtactaccgggtgtgctgcctcagcatccttgacctgggtgactccggacatcatcagcaccaccaccaccaccaagtgaagagaagagaagagactctccacctattttatttagtcgattgtaagggtcctgttgtgctcttgaaacactcctgtatcctcggtttagtactttttgcgacctgattgggagctgtcatacagataatactcatatgggtgttccgctggacattcat

SEQ ID NO: 1071 - DNA, 529 bp, Triticum aestivum
tcccccgaagccatccgcatccccacgctcgctcgctcgcccgacgcgatggctcccaccaagaaggcgaagaagagcggggagaacatcaacaacaagctgcagctggtgatgaagagcggcaagtacacgctcggctacaagaccgtcctcaagacgctccgcagctccaaggggaagctgataatcctcgcaaacaactgccctccccttaggaagtcagagattgagtactacgctatgttggcgaaaattagcgtgcaccatttccatggaaacaatgttgatcttggaactgcctgcggcaagtactaccgggtgtgctgcctcagcatcctcgacctggtgactcggacatcatcagcaccaccaccaccaccagtgaagagaagagaagagagtctccactatttatttagtcgagttgtagggcctgttgtgctctcgaaacaccctggtatcctcggtttgtgtaccttttgcgacgctgactggagctgtcatacagataatactcatatgggtgttc

SEQ ID NO: 1072 - DNA, 765 bp, Brachypodium distachyon
gcgccgccgccgcctccttctcctcttcccttgctccgttgctcgctcgccgcctccttctcctcttcccttgctccgttgctcgctcgccgccgccgccgctgcccgaaacgcgatggctcccaccaagaagacgaagaagagcacggagaacatcaacaacaagctgcagctggtgatgaagagcggcaagtacaccctcggctacaagaccgtcctcaagacgctgcgtagctccaaggggaagttgatcatccttgcaaacaactgccctccacttaggaagtctgagattgagtactacgctatgttggcaaagatcagcgtgcatcacttccatggaaacaatgttgatcttggaactgcctgcggcaagtactacagggtgtgctgtctcagcatcattgatcctggtgactcggacatcatcagcaccgcccctggcaccacccagtgaattggaagaagctcacctatttagtccagatgatgttagggtggagtcattggttacaaggccaattgtcacttgctatcattgagttggagctgacaaatacagtttcaaatttcatatggctgttttgcaagacattcctatagttttgttttatgagatgtttattttcatggagcaggctacttttttgttctattggctaccctggcgattagtatgttgttgtgtttggcttttcatcttgtgttgagaaagtgatgttgtggcgtattcacccgattaatggcactgtgatttattgtgtg

SEQ ID NO: 1073 - DNA, 1370 bp, Brachypodium distachyon
cgcgccgccgccgcctccttctcctcttcccttgctccgttgctcgctcgccgcctccttctcctcttcccttgctccgttgctcgctcgccgccgccgccgctgcccgaaacgcgatggctcccaccaagaagacgaagaagagcacggagaacatcaacaacaagctgcagctggtgatgaagagcggcaagtacaccctcggctacaagaccgtcctcaagacgctgcgtagctccaaggggaagttgatcatccttgcaaacaactgccctccacttaggaagtctgagattgagtactacgctatgttggcaaagatcagcgtgcatcacttccatggaaacaatgttgatcttggaactgcctgcggcaagtactacagggtgtgctgtctcagcatcattgatcctggtgactcggacatcatcagcaccgcccctggcaccacccagtgaattggaagaagctcacctatttagtccagatgatgttagggtggagtcattggttacaaggccaattgtcacttgctatcattgagttggagctgacaaatacagtttcaaatttcatatggctgttttgcaagacattcctatagttttgttttatgagatgtttattttcatggagcaggctacttttttgttctattggctaccctggcgattagtatgttgttgtgtttggcttttcatcttgtgttgagaaagtgatgttgtggcgtattcacccgattaatggcactgtgatttattgtgtgatgctgggttgacgctcatgtccttttaatagcagctaataacaatacgaataatacatagttggtaataataaatgataatataattaatacattgacgccttctgaatctgttgaattcattatttatgcggttccatctccgttccaaaatattgtactgtagctgtgatcgcttgtaggaactgcgcggttgttcttcagcataaatacgagtacattacgaaatcatggatcaaaggacctacttgatggtacagaatgcaaaatcccagaaactcaattgccgacgaccagcggctatccgtgaaaaagagcatgacggatccactagtcactagatcttcgttatcggagccacaaaattatacaaatgaaacctacaaagcccgattttgccgaagttccttgtgggcaacctcatgacctccgtgcaagtcccatcgcgaggatcataggctcgcaccacccgcaccttgtcttccctaagatagtcatagaacagcagcttcacgccgtcaggcatcaccatcagaggctccatgatctccgaggccacggccgccgggaccgcgtacgccttgacccacacgccgccgctgcc

SEQ ID NO: 1074 - DNA, 562 bp, Avena sativa
cctccatttgcgccgccacctccccccgaagccaccccgctcccctcgctcgccgcggccgctcggaacgatggctcccaccaagaaggcgaagaagagcacagagaacatcaacaacaaattgcagctcgtgatgaagagcggcaagtacacgctcggatacaagaccgtcctcaagacgctgcgcaactccaaggggaagctgattatccttgcaaacaactgccctccgcttaggaagtcagagatcgagtactacgccatgttggcgaaaattagcgtgcaccatttccatggaaacaatgttgatcttggaactgcctgcggaaagtactaccgggtgtgctgtctcagcatccttgatcctggtgactcggacatcatcaacaccaccagcaccacccagtgaagaagagagagttctccccctgtttagttgatctagggtctggttgtgctctctggtccgacctcttgttatctttggtaatgtactcttttgcgatgttgaattggagctgtcatacagataatacttcatatggttgttcttcaagacatt

SEQ ID NO: 1075 - DNA, 392 bp, Festuca arundinacea
ggcacgaggcctccccgccgaagccaccccgcatcccctagctcgccgcggccgctcggaacgatggctcccaccaagaaggcgaagaagagcacggagaacatcaacaacaagctgcagctcgtgatgaagagcggcaagtacacgctcggatacaggaccgtgctcaagacgcttcgcagctccaagggtaagctgattatcctcgcaaataactgtcctccgcttagaaagtcagagatcgagtactacgccatgttggcaaaaataagcgtgcaccatttccatggaaacaatgttgatcttggaactgcctgcggaaagtactaccgggtgggctgtctcagcatcattgatcctggggactctgacatcatcaacaccaccaccac

SEQ ID NO: 1076 - DNA, 790 bp, Setaria italica
gagccgcccattcgcgccgcctctgctgctcgccgctgcccttcgcgccgccgcccttgctcatcgccgcctgcggccgctcgatccgatggctcccacgaagaagtcgaagaagagcacggagagcatcaacaacaagctgcagctggtgatgaagagcggcaagtacacgctcggctacaagaccgtcctcaagacgctgcgcaactccaaggggaagctgatcatcctcgcaaacaactgccctccgcttaggaagtctgagattgagtactatgccatgcttgccaaagtcagcgtgcatcatttccatggaaacaatgttgatcttggcactgcctgtggcaagtactacagagtgtgctgcctcagtatcattgacccaggtgactcggacatcatcagcaccacccctggcacccagtgaacgaagaagaggagcgagctttgcctatccctagatgagatatagggctcagacctttgttgcaaggccaatggccgtttcttgtttgtctttagtctttgatgagttgttcttgcatacagattatacctcatatggttgctatgtaaggcatatctatggttttgtttgatgagatcgtcataattatttctgtggtctcgttggtgtgggtcacatcacatcaaatcaggtcagtatatgtgatgatctgctgggcaatgctggttggctggggttgcgttgctcgttaagcttggtatgattcgttgatcgcctggtttggttttgcatcttcagaaggtaacgtggcatttgtagtat

SEQ ID NO: 1077 - DNA, 860 bp, Pennisetum glaucum
cgctgctgctagccgccacccttcgcgccgccgccgcccttgctcatcgccgcccgcggccgctcgatccgatggctcccacgaagaagtcgaagaagagcacggagagcatcaacaacaagctgcagctggtgatgaagagcggaaagtacacgctcggctacaagaccgtcctcaagacgctgcgcaactccaaggggaagctgatcatcctggcaaacaactgccctccacttaggaagtctgagatcgagtactatgccatgcttgccaaagtcagcgtgcaccatttccatggaaacaatgttgatcttggtactgcctgcggcaagtattacagagtgtgctgcctcagtatcattgacccaggtgactctgacatcatcagcaccacccctggcgcccagtgagcgaagaggagcgagctttgcctatccctagatgagatgctatatggccgtttcttgtttgtcttcagtctatgagttgttcttgcatacagattgtacctcatatggttgctatgtaaggcatatctgtggttttgtttgatgagattgtcataattatttccgttgtctcatctttgttggtgtgggtcacattagatccggtcagcatatgtgatctgctgggtaatttttgcctggttggctggggggattgcgttgctcgtcaagcttggtatgattcgttgatcgcctggtttggtttcgcatcctctggggcaacgtgtcatgtggagtcttgccacgacatcaccagcttctggaagtacgaggggtagaggatctgatgctgtacccatcattggaaaagtggattacttaacttccaacttatgaaatggtatttatcag

SEQ ID NO: 1078 - DNA, 607 bp, Pennisetum glaucum
cccacttagagttgcgcagcgtcttgaggacggtcttgtagccgcccattcgcgccgccgctgctgctagccgccacccttcgcgccgccgccgcccttgctcatcaccgcccgcggccgctcgatccgatggctcccacgaagaagtcgaagaagagcacggagagcatcaacaacaagctgcagctggtgatgaagagcggaaagtacacgctcggctacaagaccgtcctcaagacgctgcgcaactccaaggggaagctgatcatcctggcaaacaactgccctccacttaggaagtctgagatcgagtactatgccatgcttgccaaagtcagcgtgcaccatttccatggaaacaatgttgatcttggtactgcctgcggcaagtattacagagtgtgctgcctcagtatcattgacccaggtgactctgacatcatcagcaccacccctggcgcccagtgagcgcagaggagcgagctttgcctatccctagatgagatgctatatggccgtttcttgtttgtcttcagtctatgagttgttcttgcatacagattgtacctcatatggtagctatgtaaggcatatctgtggttttgtt

SEQ ID NO: 1079 - DNA, 543 bp, Avena sativa
cgaagccacccgcatcccgtcgctagccgcggccgctcggaacgatggctcccaccaagaaggcgaagaagagcacggagaatatcaacaacaaactgcagctcgtgatgaagagcggcaagtacacgctcggatacaagaccgtcctcaagacgctgcgcaactccaaggggaagctgattatcctcgcaaacaactgccctccgcttaggaagtcagagattgagtactacgccatgttggcaaaaattagtgtgcaccatttccatggaaacaatgttgatctcggaactgcctgtggaaagtactaccgggtgtgctgtctcagcatcattgatcctggtgactcggacatcatcaacactaccagcaccacccagtgaagaggcgagagctctcttatctgtttagttgatctagggtctggttctgctctctaggccgacctcttgatatctttggtcatgtacttttttgtgatgatgaattggagctgtcatacagataatttgttcttcaagacatttgctgatgatctcttcc

SEQ ID NO: 1080 - DNA, 535 bp, Avena sativa
ggccgcccccgaagccacccgcctcctcctgccgccccgctcgtcgcctgccgaggttggttcgccggacgcgatggctcccactaagaagacgaagaagaacacggagaacatcaacaacaaactgcagctggtgatgaagagcggcaagtacacgctcggctacaagaccgtcctcaagacgctccgaagctccaaggggaagttgattatccttgccaacaactgccctccgctcaggaagtctgagattgagtactacgccatgttggcaaagatcagcgtgcaccatttccatggaaacaatgttgatcttggaactgcctgcggcaagtactaccgggtgtgctgtctcagcatcatcgatcctggtgactcggacatcatcaccgctgctcctggtgccgcccagtgaagaggagggcccttacctatttagtctgagattatgtagtgtggagctggcaaatgcagttgaaacttcctatggctgttctgtaacacattcgtatggttttgttttatgagatgtttt

SEQ ID NO: 1081 - DNA, 757 bp, Panicum virgatum
ggagccgcccattcgcgccgccgccctcggttgtcgccgcccgcggccgctcgatccgatggctcccacgaagaagtcgaagaagagcacggagagcatcaacaacaagctgcagctggtgatgaagagcggcaagtacacgctcggctacaagaccgtcctcaagacgctgcgcaactccaaggggaagctgatcatccttgcgaacaactgccctccgcttaggaagtctgagatcgagtactatgccatgctcgccaaagttagcgtgcatcatttccatggaaacaatgttgatctcggcactgcctgcggcaagtactacagagtgtgctgcctcagtatcattgacccaggtgactcggacatcatcagcaccacacctggcgcccagtgagcaaagaagaggagcgagctttgcctatccctagttgagatgagatatagggctcagaccttgccaggccaatggccgtttcttgtttgtctttagtctatgatgagttgatcttgcatacatacctcatatggttgttatgtatggcatatctatggttttgtttgatgagatcgtcataattattccgttgtctcatcgaagcgggtaacgtatatgtgatattgctgggtaacgctggttggctgtggttgcgttgcccagtaaacttggtatgattccttgatcgtctggtttggttttgcatcttgtaaaggcgacgtgtcatagttatctccgcgcatccttttcttttgtgcc

SEQ ID NO: 1082 - DNA, 710 bp, Panicum virgatum
ggagccgcccattcgcgccgccgcccttgcttgtcgccgcccgcggccgctcgatccgatggctcccacgaagaagtcgaagaagagcacagagagcatcaacaacaagctgcagctggtgatgaagagcggcaagtacacgctcggctacaagaccgtcctcaagacgctgcgcaactccaaggggaagctgatcatccttgcgaacaactgccctccgcttaggaagtctgagattgagtactatgccatgcttgccaaagttagcgtgcatcatttccatggaaacaatgttgatctcggcactgcctgcggcaagtactacagagtgtgctgcctcagtatcattgacccaggtgactcggacattatcagcaccacccctggcgcccagtgagcaaagaagaggagcgagctttgcctatccctagttgagatgagatatagggctcagacctttgttgcagggccaatggccatttcttgtttgtctttagtctatgatgagttgatcttgcatacagattatacctcatatggttgttatgtaaggcatatctatggttttgtttgatgagatcgtcataattattccgttgtctcatagatgtgggtcacatcatatgagatcagtatgtcatgatcttgcttggtgacgctggtttgctgtggttgcgttggccagtaagcttggcatgattcattgatcg

SEQ ID NO: 1083 - DNA, 1045 bp, Zea mays
cgtccgctgctaaaccctagtgagccgcccatttgcgccgccgcagcccgcagtcgcttgcgcgcagcagcacttcgcaccgccgccccatcccatcgccgccagtgtctgctcgatccgatggctcccacgaagaagtcgaagaagagcacagagagcatcaacaacaagctgcagctggtgatgaagagcggcaagtacaccctgggctacaagaccgtcctcaagacgctgcgcaactccaagggaaagctgatcatcatcgcaaacaactgccctccacttaggaagtctgagattgagtactacgccatgctggccaaagttagcgtgcaccatttccacggaaacaatgttgatcttggcactgcctgcggcaagtactacagggtgtgctgcctcagtatcatcgacccaggtgactcggacatcatcagtaccacccctggcacccagtgagccagccccggcacccattgcagctgcttcgcctttctcaagatgagatgagatgtagcgctccggccctatgtccgtttcctttttttatcttttagctatgtaattttgctaccatgtgtccatctaccatactgatagtacctcttattatggctgctatgcaaggcatatccatggttttgtttgatgagatggttgtacttgttctcttgttgatgttgatcggatcaggtcaatcgatgcgctgatgggctgcttggttatgctgtttgtctttgttacgaatcacaaaccacaaacccgtgcctcgtttctcagtttcttgttcatatttaagacattatactctaaaacattatcatcgtgtcgccaagaacagaagccttctacatcatgatttcgacagaagcagtagaaaaaaggattgtaggatggagcatctgctccggtatcgatcatattcttgactcgcccaaacaccacaacgaaccacctctaaagctgccgcagctatctctcctctggtaaaccagcttcccaaccgaaataaatatatgaccatagatcaataaattagccactg

SEQ ID NO: 1084 - DNA, 823 bp, Sorghum bicolor
agccgcccatttgcgccgccgcttgctcgccgcagctcttcgcaccgccgccccttccccgtcgccgccagcggctgctcgatccgatggctcccacgaagaagtcgaagaagagcacagagagcatcaacaacaagctgcagctggtgatgaagagcggcaagtacaccctggggtacaagaccgtcctcaagacgctgcgcaactccaagggaaagctcatcatcatcgcgaacaactgccctccacttaggaagtctgagattgagtactatgctatgctggccaaagttagcgtgcaccatttccatggaaacaatgttgatcttggcactgcctgcggcaagtactatagggtgtgctgcctcagtatcattgacccaggtgactcggacatcatcagcaccacccctggcacccagtgagtgaagaagagccaggagcttcgcctgtcactagtttgagatgagatgtagggctcagacttcccgctgcaagctctatgaccatctcttttttatcttttagttatatgtaatttggctatcatgtctgcatctaccatactgataatacctcgtatggctgctatgtgaggagtatccatggttttgtttgatgagatcgttatatttattcctctggctcatgttgatgtcgatgagatattcagatcagatcagtagtatatgcgttgatgagctgcttggtgatgatggttgtctggatgcgttgcttgctgaggttggaatgattcgttggtcgcctcgactggttttgcatctggaggtgtttcgttatgacctgttctccgttggattgc

SEQ ID NO: 1085 - DNA, 935 bp, Sorghum bicolor
tgtctatatacagcctctggtgctaaaccctaacgagccgcccatttgcgccgccgcttgctcgccgcagctcttcgcaccgccgccccttccccgtcgccgccagcggctgctcgatccgatggctcccacgaagaagtcgaagaagagcacagagagcatcaacaacaagctgcagctggtgatgaagagcggcaagtacaccctggggtacaagaccgtcctcaagacgctgcgcaactccaagggaaagctcatcatcatcgcgaacaactgccctccacttaggaagtctgagattgagtactatgctatgctggccaaagttagcgtgcaccatttccatggaaacaatgttgatcttggcactgcctgcggcaagtactatagggtgtgctgcctcagtatcattgacccaggtgactcggacatcatcagcaccacccctggcacccagtgagtgaagaagagccaggagcttcgcctgtcactagtttgagatgagatgtagggctcagacttcccgctgcaagctctatgaccatctcttttttatcttttagttatatgtaatttggctatcatgtctgcatctaccatactgataatacctcgtatggctgctatgtgaggagtatccatggttttgtttgatgagatcgttatatttattcctctggctcatgttgatgtcgatgagatattcagatcagatcagtagtatatgcgttgatgagctgcttggtgatgatggttgtctggatgcgttgcttgctgaggttggaatgattcgttggtcgcctcgactggttttgcatctggaggtgtttcgttatgacctgttctccgttggattgctgtaactgcctcatgattcgttgcttcctagctatgtcttattaatacgattttaccattctctactacgttgtgcg

SEQ ID NO: 1086 - DNA, 1083 bp, Saccharum officinarum
agccgcccatttgcgccgccgcttgctcgccgcagcccttcgcaccgccgccccttcccgtcgtcgccagcggctgctcgatccgatggctcccacgaagaagtcgaagaagagcacagagagcatcaacaacaagctgcagctggtgatgaagagcggcaagtacaccctcgggtacaagaccgtcctcaagacgctgcgcaactccaagggaaagctgatcatcatcgcgaacaactgccctccacttaggaagtctgagattgagtactatgctatgctggccaaagttagcgtgcaccatttccatggaaacaacgttgatcttggcactgcctgcggcaagtactatagggtgtgctgcctcagtatcattgacccaggtgactcggacatcatcagcaccaccccaggcacccagtgagtgaagaagagccaggagcttcgcatgtcactagttgagatgagatatagggctcagacttccgctgcaagccctatagccatttcttttttatcttttagttatgtaattttgctatcatgtgtccatctaccatactgtgatactgataatacctcgtatggctgctatgtaatgtaaggcatatccatcttgtttgatgagatcgttaaaaaaaaagaatgttatttcacatttgacaaactttataacgggctcggcgaaaggggggcctccctgctaaaaaaaaccatcttctccccccgcatagctgccttgttttggggcttttttatgataatctccttcggttgttcttttcgccgcctgtagttaaagaaataaccgtgggcggaacacctcggtgtgttctcattgttaattcctccctttatcaaaacacggtggggttcacgggggtgaccaccccatcacgcgcgtttaataatatgttgtttcttaccataattttggacttaggcggaaggtcctattgatgctcccttctttagccctttataatgatggcgggtgtctgtttgagattaccatcatcatatgtgaccgtccctctataaccctcgcgtgatcaccgccctctatcatactttactgaccgt

SEQ ID NO: 1087 - DNA, 543 bp, Secale cereale
  misc_feature (253)..(253): n is a, c, g, or t
  misc_feature (312)..(312): n is a, c, g, or t
  misc_feature (314)..(314): n is a, c, g, or t
  misc_feature (350)..(350): n is a, c, g, or t
gcgccgcctcccccgaagccatccgcatccccacgctcgttcgctcgccgcggccgcccgacgcgatggctcccaccaagaaggcgaagaagagcggggagaacatcaacaacaagctgcagctggtgatgaagagcggcaagtacacgctcggctacaagaccgtcctcaagacgtgcgcagctccaaggggaagctgataatcctcgcaaacaactgccctccccttaggaagtcagagattgagtactangctatgttggcgaaaatcagcgtgcaccatttccacggaaacaatgttgatctgggaancnctgcggcaagtactaccgggtgtgctgcctcagcanccttgaccctggtgactcggacatcatcagcaccaccaccaccacccagtgaagaggagagagctctccacctattttatttagtcgagttgtagggtcctgttgtgctctcggaatcactcttgttatctttggtttatgtacctttttgcgacgctgagttggagctgtcatacagataatacttaatatg

SEQ ID NO: 1088 - DNA, 528 bp, Festuca arundinacea
ggcacgaggccccgccgaagccgccccgcatcccctcgctcgctcgccgcggccgctcggaacgatggctcccaccaagaaggcgaagaagagcacggagaacatcaacaacaagctgcagctcgtgatgaagagcggcaagtacacgctcggatacaggaccgtcctcaagacgctgcgcagctccaaggggaagctgattatcctcgcaaacaactgccctccacttaggaagtctgagatagagtactacgccatgttggcaaaaattagcgtgcaccatttccacggaaacaatgttgatcttggaactgcctgcggaaagtactaccgggtgggctgtctcagcatcattgatcctggtgactctgacatcatcaacaccaccaccaccaccgcccagtgaagaagagagagctctccacctgtttagttgatctagggtccggttgtgctctctaggccgacttcttgttatctctgcttatgtacttttttgtgatgctgaatttgagctgtcctacagat

SEQ ID NO: 1089 - DNA, 798 bp, Oryza sativa
cgaggcggcacctatatacaccgcgtcgagctaaaccctaaccagccgcccattcgcgccgccgccgcagaagccaccgcgccccgcagctctcgtcgtcgtcgccgcggccgctcgatcacgatggctcccaccaagaaggcgaagaagagcacggacaacatcaacaacaagctgcagctggtgatgaagagcggcaagtacacgctcggctacaagaccgtcctcaagacgctgcgcaactccaaggggaagctgattatccttgcaaacaactgccctccactcaggaagtctgagattgagtattacgccatgttgggaaaagttagcgttcaccatttccatggaaacaatgttgatcttggaactgcctgcggcaagtactaccgggtgtgctgcctcagcatcatcgaccctggtgactcggacatcatcaacacaacccctgcctcccagtgaagaagtttttacctatttagttgagatgtagggttcagacgtgcttacatggccaatggctgtttcttggttatctttagttgtgtaattttgctatgctgagttgggatctgccatacagataatactccatattgttgttaaggcatttctatggttttgtttgatgagatctctatttatatattgagcaagtttattctcctgctgttctgtgagcatcagcaaagagagcatcatccaagatgtttgcttccttgcttatgtggttcaaaagctagactatggttgttaactatctcgaagcttcgaatcacttgctttgttttttatcca

SEQ ID NO: 1090 - DNA, 734 bp, Oryza sativa
agccgcccattcgcgccgccgccgcagaagccaccgcgccccgcagctctcgtcgtcgtcgccgcggccgctcgatcacgatggctcccaccaagaaggcgaagaagagcacggacaacatcaacaacaagctgcagctggtgatgaagagcggcaagtacacgctcggctacaagaccgtcctcaagacgctgcgcaactccaaggggaagctgattatccttgcaaacaactgccctccactcaggaagtctgagattgagtattacgccatgttgggaaaagttagcgttcaccatttccatggaaacaatgttgatcttggaactgcctgcggcaagtactaccgggtgtgctgcctcagcatcatcgaccctggtgactcggacatcatcaacacaacccctgcctcccagtgaagaagtttttacctatttagttgagatgtagggttcagacgtgcttacatggccaatggctgtttcttggttatctttagttgtgtaattttgctatgctgagttgggatctgccatacagataatactccatattgttgttaaggcatttctatggttttgtttgatgagatctctatttatatattgagcaagtttattctcctgctgttctgtgagcatcagcaaagagagcatcatccaagatgtttgcttccttgcttatgtggttcaaaagctagactatggttgttaactatctcgaagcttcgaatc

SEQ ID NO: 1091 - DNA, 606 bp, Triticum aestivum
  misc_feature (416)..(416): n is a, c, g, or t
  misc_feature (443)..(443): n is a, c, g, or t
  misc_feature (457)..(457): n is a, c, g, or t
  misc_feature (504)..(504): n is a, c, g, or t
  misc_feature (517)..(517): n is a, c, g, or t
  misc_feature (535)..(535): n is a, c, g, or t
  misc_feature (566)..(566): n is a, c, g, or t
  misc_feature (582)..(582): n is a, c, g, or t
  misc_feature (606)..(606): n is a, c, g, or t
ccgccgcagcccgcagtcgcttgcgcgcagcagcacttcgcaccgccgccccatcccattgccgccagtgtctgctcgatccgatggctcccacgaagaagtcgaagaagagcacagagagcatcaacaacaagctgcagctggtgatgaagagcggcaagtacaccctgggctacaagaccgtcctcaagacgctgcgcaactccaagggaaagctgatcatcatcgcaaacaactgccctccacttaggaagtctgagattgagtactacgccatgctggccaaagttagtgtgcaccatttccacggaaacaatttgatcttggcactgcctgcggcaagtactacaaggtgtgctgcctcagtatcatcgaccaagtgactcggacatcatcatacaaccctgggcaccaantgagccagcccgggaaccaatgcagcncttcgccttccaanatagataaatgtacgctccggcctaagtcttcctttttacctttacnagtatttgcacangttcaccacatacgaatntctataggtgcatcaggaacaggttttatanagtgtcttcctgtgantatgtagcaaaaaaggggccgtcn

SEQ ID NO: 1092 - DNA, 781 bp, Zea mays
gttgattggtctccccgttggtttcgatctatgcagaagaagagcacagagagcatcaacaacaagctgcagctggtgatgaagagcggcaagtacaccctgggctacaagaccgtcctcaagacgctgcgcaactccaagggaaagctgatcatcatcgcaaacaactgccctccacttaggaagtctgagattgagtactacgcccatgctggccaaagttagtgtgcaccatttccacggaaacaatgttgatcttggcactgcctgcggcaagtactacagggtgtgctgcctcagtatcatcgacccaggtgactcggacatcatcagtaccacccctggcacccagtgagccagccccggcacccattgcagctgcttcgcctttctcaagatgagatgagatgtagcgctccggccctatgtccgtttcctttttttatcttttagctatgtaattttgctaccatgtgtccatctaccatactgatagtacctcttattatggctgctatgcaaggcatatccatggttttgtttgatgagatggttgtacttgttctcttgttgatgttgatcggatcaggtcaatcgatgcgctgatgggctgcttggttatgctgtttgtctttgttacgaatcacaaaccacaaacccgtgcctcgtttctcagtttcttgttcatatttaagacattatactctaaaacattatcatcgtgtcgccaagaacagaagccttctacatcatgatttcaacagaagcagtaaaaaaaaga

SEQ ID NO: 1093 - DNA, 644 bp, Cenchrus ciliaris
ccgagaaggagccgccgccgccgccgcgcaaaccctagcaggcttcgccgccgtcactcctcctcggggcgcaaccatggtggccacaaagaagtcgaagaagtccacggacaacatcaacaacaagctgcagcttgttatgaagagcggcaagtacacgctcggctacaagaccgtcctcaggactcttaggaactccaagtcgaagcttgtgatcattgctaacaactgccctcccctaaggaagtctgaaattgagtactatgctatgctggctaaggtcactgttcaccacttccatggaaacaatgttgacctgggtacggcatgtggtaaatacttccgtgtgtgctgtctcagcattattgatccaggtgattctgatatcatcaagactacacctggtgaccagtaaggaagcggcttcacatcgtgttcttcactgttctagtgtagtagtggatcttgctggacttgttctttcatcttatattgtgtcgaacagcatttacctaccagtaaactgagttcttgggaacattgtcttggattgaaaattttgttcctggaatcaacactttcaacagaagtttgcctatggttgtgcacttgtgctcagtgctgaggtcagtttttgtcgttcc

SEQ ID NO: 1094 - DNA, 731 bp, Setaria italica
tctatataaggaccaaaccctagcttccccacccttctacctcgcagtcatccccgagaaggagccgccgccgccgcgcaaaccctagcaggcttcgccgccgtcactcctcctcggggcgcaaccatggtggccacaaagaagtcgaagaagtccacggacaacatcaacaacaagctgcagcttgttatgaagagcggcaagtacacgctcggctacaagaccgtcctcaggactctcaggaactccaagtcgaagctggtgatcattgctaacaactgccctcccttaaggaagtctgaaattgagtactatgctatgctggctaaggtcactgttcaccacttccatggaaacaatgttgacctgggtacggcctgtggtaaatacttccgtgtgtgctgtctcagcattattgatccaggtgattctgatatcatcaagactacacctggtgaccagtaaggaagcggcatctgtaccccttctctgcatccgtctgttctagtgtagtagtggatcttgctggacttgttctttcatcttaaattgtgttaaacggcatttacctgccagtaaactgagttcttgggaacattgtcttggattgaaaattttgttcctggaaccgacactttcaacggaagtttgacctatggtcggcacagatctgagttcagtttttgttgctccgatatgatcaatttcgtgatgattatgcgtcaccttcc

SEQ ID NO: 1095 - DNA, 628 bp, Pennisetum glaucum
gtgccgccgccgcgcaaaccctagcgggcttcgccgccgtcacttctcggggcgcaaccatggtggccacaaagaagtcgaagaagtctacagacaacatcaacaacaagctgcagcttgttatgaagagcggcaagtacacgctcggctacaagaccgtcctcaggactctcaggaactccaagtcgaagcttgtgatcattgctaacaactgccctcccctaaggaagtctgaaattgagtactatgctatgttggccaaggtcactgttcaccacttccatggaaacaatgttgacctgggtactgcatgcggtaaatacttccgtgtgtgctgtctcagcattattgatccgggtgattctgatatcatcaagactacacctggtgaccagtaaggaagtggcatctgtgttctgagctgttctagtgtagtagtggatcttgctggactttgttctttcatcttacattgtgttaaacagcatttacctaccagtaaactgagttcttgggaacattgtcttggattgaaaattttgttcctggaatcggcactttcaacaatgggagtttggcctattggttgtgctaggattgacttgattgaacataatgattatgccac

SEQ ID NO: 1096 - DNA, 603 bp, Avena sativa
cccgagtagaagccgccgccgtcgccgcagcctccaaccctagcgacgccgcctcttctcctcgggtagcaaccatggtggcctccacgaagaaggcgaagaagtccggggacaacatcaataacaagctgcagcttgtcatgaagagcgggaagtacacgctcggctacaagaccgtcctcaggaccctcaggaactccaagtcgaagctagtgatcattgctaacaactgccctccacttcggaagtctgagatcgagtactatgctatgttggcgaagatcactgtccaccactaccatggaaacaatgttgatctgggaacggcctgtggtaaatacttccgtgtctgctgtttgagtatcttagacccgggcgattctgacatcatcaccaccacaccagctggccagtaaccaacctttttcactgtctgtcttatgcgttgtgagggctgttctagactgtaattcttgctggacttgatctggtctcgtgtacatcatttatcagtcaatcaagtttcgtgggaatatcgttttggatcgaagttctgttcctggttgagtttacttgcactttgtacttccatcaagtatggtt

SEQ ID NO: 1097 - DNA, 730 bp, Zea mays
aatctctatataaccggcaaatcctaacgctcccaacccttccaccacgcagtcactcccgggccgccgccgccgccgcctccgcgaaaaaccctagcaggcttcgccgctatcactccaaggggcgcgaccatggtggccacaaagaagacgaagaaatccacggacaacatcaataacaagctgcagcttgttatgaagagtggcaagtacactctcggctacaagaccgtcctcaggactctcaggaactctaagtcgaagctagtgatcatcgctaacaactgcccgccccttcgtaagtctgaaattgagtactatgctatgctggccaaggtcactgtccaccacttccatggaaacaatgtcgaccttggaactgcctgtggtaaatactttcgggtctgctgcctcagcattattgatcctggtgattctgatatcatcaagactacaccgggtgagcagtaaagaagcccctgcagtagggggatcttactgcatttgttcttctgtcttgttaaacagcatttacctgctagtaaactgagttattcggaacattgtcttgaattgaatttttgctccggtgttttgacacttaaatagagctttagcttataccgttgttcaggtcgcagctgtatgttgtcactatcaaaccgtcaaacgaatgctccaccagtggaggtatctcctataataaggattcattgtttgtagtaattgt

SEQ ID NO: 1098 - DNA, 621 bp, Panicum virgatum
cgagaaggagccgccgccgccgccgcgcaaaccctagcaggcttcgccgccgtcactcctcctcggggcgcaaccatggtggccacaaagaagacgaagaagtccacggacaacatcaacaacaagcttcagcttgttatgaagagcggcaagtacacgctcggctacaagaccgtcctcaggactcttaggaactccaagtcgaagcttgtgatcattgctaacaactgccctccccttcggaagtctgaaattgagtactatgctatgctggctaaggtcactgttcaccatttccatggaaacaatgttgacctgggtacagcctgtgggaaatacttccgtgtctgctgtcttagcattattgatccaggtgattcggatatcatcaagactacaccaggtgaccagtaaggaagagatgtcagtacccttcgcatcggtgttctgagctgttttagtgtagtagtggatctttctggacttgttctttcacctcatattgtgttaaacagcatttacctgcctgtaatctgagatcttgggaacatagtcttgcattgaaaattttgttcctggaattgacactatcaatggagctgtgtcctatggttgtcctca

SEQ ID NO: 1099 - DNA, 540 bp, Persea americana
tcttcttcgcagagagagcagcgcggcggcagcagcagcaatcatggtggccgtgaagaagagcaaaaagactcatgagagcatcaacaatcggctcgctctcgtgatgaagagtggcaagtatacccttggttacaagaccgtcctcaaatctctgaggagctccaaagggaagttgattatcattgcaaacaactgtcctcctcttaggaagtctgaaattgaatattatgctatgttggctaaggttggagtccaccatttcaatgggaataacgtggatttgggcactgcttgcggcaagtattaccgggtttgttgcttaagcattattgatccaggtgattcggacattatcaagagcgtccctggtgatcagtgagagacttatttggagttgattaccgttcaatgtagtttttaatgttggttttatagtgtctttgtgtctgttaagaggctctgacttttctcccattcatgcaagaacagtcaccagagaggaatttcgttaaatgatgaccccatttggtttatatt

SEQ ID NO: 1100 - DNA, 934 bp, Zea mays
tttttttttctggccacaaaaatcaaagttcatactccgcgtctgggcgtctgccgtctgggctcaaagaactcgtaagccccattctatcctatacaaagcccacatcagtaacccctagggttccttgtactctataaataaccaaaccctagctctccagccttccgccccgcagtcatccccgagaagagccgccgccgcgcaaagccgcttcgacgccgtcactcatcggggcgcaaccatggtggccgcaaagaagacgaagaagtccacggacaacatcaacaacaagcttcagcttgtgatgaagagcggcaagtacacgctcggctacaagactgtcctcaggaccctcaggaattctaagtcaaagctagtgatcattgctaacaactgtcctccgcttcggaagtctgaaattgagtactatgctatgctggctaaggtgacagtccaccacttccatggaaacaatgttgaccttggaacagcctgtggaaaatacttccgtgtctgctgcctcagcattatcgatcctggtgattctgatatcatcaagactacaccgggcgagcagtaaggatgccacaacagctgtactcggcatctgaattcttagtagctgatgattttgatgtacttgtcttttatcgtgttccgtcagaatttatagagttcttggcaacattgtgtggattgaacatttcgttccagacatttgctaattgttgaatggatctcttgccggatgtgctcggattacagcatttagtcccccactgctcaaaattgcactattctctgttgtgtcaaatttgtatcttgtttactgttggtacacgatgctgctttaaacatggtacctcgggcaggacagtcttgtcttaagtcatcggtattgtgatagtaaattttacatattcaagtcgta

SEQ ID NO: 1101 - DNA, 785 bp, Sorghum bicolor
tagcatcctcccttccgcctcgcagtcatcccccgagaaggagccgccgccgccgccgccgcgcaaagccgcttcgacgccgttagtcctcctcggggcgcagccatggtggccgcaaagaagacgaagaagtctacggacaacatcaacaacaagctgcagcttgtgatgaagagcggcaagtacacgctcggctacaagactgtcctcaggaccctcaggaactccaagtcaaaactagtgatcattgctaacaactgccctccgctccggaagtctgaaattgagtactatgctatgctggctaaggtcacagtccaccacttccatggaaataatgttgacctgggaacagcctgtggaaaatacttccgtgtctgctgcctcagtattattgatcctggtgattctgatatcatcaagactacgccaggtgagcagtaacgaagccacaccagttcctcttctcggcaccgggcttatgaactgttttagtgttgtagtggatcttgctggactcgttctttattgtgttccacagcatttatatgccagtaaaacagagtcctcgggaaacattgtcttcgattgaaaattttgttaatggcatttggcactgttgaatggaacatttggctgaatgtgcctggatcagagctgttatacttttctttttcctttactgtcattccttattatctttatatattgtggtaaatctgtatcttctcttcggtaaatctgtatcatatcttctgtcgttcctatcattgctgctgcaaaca

SEQ ID NO: 1102 - DNA, 863 bp, Sorghum bicolor
tctataaagaaccaaaccctagcatcctcccttccgcctcgcagtcatcccccgagaaggagccgccgccgccgccgccgcgcaaagccgcttcgacgccgttagtcctcctcggggcgcagccatggtggccgcaaagaagacgaagaagtctacggacaacatcaacaacaagctgcagcttgtgatgaagagcggcaagtacacgctcggctacaagactgtcctcaggaccctcaggaactccaagtcaaaactagtgatcattgctaacaactgccctccgctccggaagtctgaaattgagtactatgctatgctggctaaggtcacagtccaccacttccatggaaataatgttgacctgggaacagcctgtggaaaatacttccgtgtctgctgcctcagtattattgatcctggtgattctgatatcatcaagactacgccaggtgagcagtaacgaagccacaccagttcctcttctcggcaccgggcttatgaactgttttagtgttgtagtggatcttgctggactcgttctttattgtgttccacagcatttatatgccagtaaaacagagtcctcgggaaacattgtcttcgattgaaaattttgttaatggcatttggcactgttgaatggaacatttggctgaatgtgcctggatcagagctgttatacttttctttttcctttactgtcattccttattatctttatatattgtggtaaatctgtatcttctcttcggtaaatctgtatcatatcttctgtcgttcctatcattgctgctgcaaacaagctacctagtcgatgttttctgcctttgctatcctcgtttatattgcgatggtttcag

SEQ ID NO: 1103 - DNA, 674 bp, Saccharum officinarum
tagcaccctccctcacgcctcgcagtcatccccgagaaggagccgccgccgccgccgccgcgcaaagccgctgcgacgccgtcagttctcctcggggcgcaaccatggtggccgcaaagaagacgaagaagtccacggacaacatcaacaacaagctgcagcttgtgatgaagagcggcaagtacacgctcggctacaagactgtcctcaggacactcaggaactccaagtcaaagctagtgatcattgctaacaactgccctccgctccggaagtctgaaattgagtactatgctatgctggctaaggtcacagtccaccacttccatggaaacaatgttgacctgggaacagcctgtggaaaatacttccgtgtctgctgcctcagcattattgatcctggtgattctgatatcatcaagactacgccaggtgagcagtaaggaagccacaccagttcctcttctcggcacctggcttccgaactgctctagtgttgtagtcgatcttgctggacttgttcttttattgtgttcgacagcaatatgccagtaaacagagttcgtgggaaacattgtcttggattggaaattttgttcctggcatttggcactgttgaatggatctttcggctgaatgtgctcggatcagagctgttattatagttttctttt

SEQ ID NO: 1104 - DNA, 1391 bp, Panicum virgatum
caatgtagcgtttccaccaagggtttatggttatggttcggatggtccaggagtagttaatcctgctgtgcctggcctaagtggactacatgctgtagctagggcacacggacttagtcctttggaagacccatctttggctgggctgagtggactagctccagccagggcactgggacctagtattttggaagaaccgtctgtaatggggagaagttcatctctaggcaaaggtgttggtattccagatgtggagcgccacagtccacttccaaactttgacgggccatcagaaaatgaatccaacattctttttgttgattgtctccctactgattgcacaaggagagaagtagcccatttgtttcggcccttcgatggtttcaaggacatcagagtagtgcacaaggagcccaggcgtagtggtgacaaggcttatgtcctgtgctttgtggagtttgagaatgtaaaatgtgcacgcgctgctatgcataaactccgagcataccgctttgatgacaggaagcctaactccccgttccttaagatccaattcgcaaggttccctttccgtctgcctgctgcccaggacgatcgctgattgctgccttccgtcatcctctagctagaaatatagtccgtgcggtggggatctttagatgacctgtgatcagcctgtatgtaacagtaatgggcagttgactgatgatgcctttcagaagtcttgtgtgacaccaacacaaaaaaaaaaaatccccgagaaggagccgccgccgccgcgcagcgcaaaccctagcagtcttcgccgccgtcactcctcctcggggcgcaaccatggtggccacaaagaagacgaagaagtccacggacaatatcaacaacaagcttcagcttgtgatgaagagcggcaagtacacgctcggctacaagaccgtcctcaggactcttaggaactccaagtcgaagcttgtgatcattgctaacaactgccctccccttcggaagtctgaaattgagtactatgcaatgctggctaaggtcactgttcaccatttccatggaaacaatgttgacctgggtacagcctgtggaaaatacttccgtgtctgctgtcttagcattattgatccaggtgattcggatatcatcaagactacatcgggtgaccagtaaggaagagatgccagtaccccttggcattggtgttctgagcttttctagtgtagtagtggatctttcaggacttgtcctttcaccttatattgtgttaaacactatttgcctgcccgtaatctgagtttttgggaacagtcttgcattgaaaattttgttcctggaattgacactatcaatggagctgtggcctatggttgtcctcacttcagagttca

SEQ ID NO: 1105 - DNA, 456 bp, Triticum aestivum
cgccgccgccgccgcctccgcgaaaaaccctagcaggcttcgccgctatcactccaaggggcgcgaccatggtggccacaaagaagacgaagaaatccacggacaacatcaataacaagctgcagcttgttatgaagagtggcaagtacactctcggctacaagaccgtcctcaggactctcaggaactctaagtcgaagctagtgatcatcgctaacaactgcccgccccttcgtaagtctgaaattgagtactatgctatgctggccaagtcactgtccaccacttccatggaaacaatgtcgaccttggaactgcctgtggtaaatacttcgggctgctgcctcagcattatgatcctgggtgatctgatatcatcaagactacaccgggtgagcagtaaagaaccctgcagtaggggatcttacgcatttgtcctcgtctgttaaacacatt

SEQ ID NO: 1106 - DNA, 685 bp, Sequoia sempervirens
gtttgggtaggggtttaaagagacctgactttgatacttgaataaaaaattataattctaagtccttccatgcttcggagcatcccactcatacatctccagctctccataacccaacaatggcgataaccaagaagacgaagaagactcatgagaacatcaacagcaggcttgccctggtgatgaagagtggcaagtacactctgggctacaagtccgtcctgcattctctcaggtcttcaaaaggaaacttattatcattgctaacaattgccctccattacaaaagtcagaaattgagtattatgccatgcttgcgaaaattggagtgcatcatttccatggaaacaatgttgatttgggaactgcatgtggcaaatattatcgtgtgagctgtctaagcgtaacagatccaggtgactctgacattattaagacagtgcctgctggtctgtgaaaatctcattaatgttgaaaagcagggatggccacggtcttttctggtaatttaattttaaaattaaaatgtaagaagactgttgcagaaatcaccagtcaatttcttgatcagaagcaattccagttcattgacaatgttggattttcttctttttagagtgtgtttaggtgagggattaatcgtaaagtttgtatagttcatttgttaatgcatatttgtattacc

SEQ ID NO: 1107 - DNA, 673 bp, Ananas comosus
cagcaaccggggaagggcctagggtttctgcctcctcgccgcacacgtctctcgcaccgttccggagctgctccaatggcccccgcgaagaaaacgaagaagagcacggagagcataaacaacaagctcgccttggtgatgaagagcgggaaatacacgctcgggtacaagacggttctcagaacccttcgcagctccaaaggtaagttgatcatcatcgcaaacaactgccctccgctccgcaaatccgagatcgagtattatgcaatgttggcgaaagttggggtacatcacttcaatggaaacaacgttgatcttggaactgcttgcggcaagtacttccgggtgtgctgcctcagcattgttgatgctggtgactcagagatactcaagagcatccctggtgatcagtgagagagaagaagagtttttgtcttgcgggagaaattaacgtgtattttgtggttgatcagcaaatggttttttttttccttagtatatttagacgtggaattttaacgcaaaattctttcagataacaacttattcagagatttttgtttattgtttagtgagtatttattttttctgttttatgctcttaagtttaaacttctgggggcatatcttgttcttttgctgctgattattatgctgattctgagttatctgt

SEQ ID NO: 1108 - DNA, 773 bp, Sorghum bicolor
tctgcggctgggcccaaagaactcctgcccattctacaaagcccacagcgggcaaaccctcaggctctctactctattaaaggagcataccctagcgtctccacccttcatcctcgcagtcatccccgagaaggagccgccgccgccgccgcgcaaacccgcttcgacgccgtcactcctcctcggggcgcaaccatggtggccgcaaagaagacgaagaagtctacggacaacatcaacaacaagctgcagcttgtgatgaagagcggcaagtacacgctcggctacaagactgtcctcaggaccatcaggaactccaagtcaaagctagtgatcattgctaacaactgtcctccgctccggaagtctgaaattgagtactatgctatgcttgctaaagtcacagtccaccacttccatggaaacaatgttgacctgggaacagcctgtggaaaatacttccgtgtctgctgcctcagtattattgatcctggtgattctgatatcattaagactacaccgggtgagcagtaaggaagccacaccagtagagcgctcttgtgcaatagtgctgtagcggatcttcttgctggacttgtcttttgttttgttcctatagaatttacctgacagtaaacagagttcgtgggaacattattctctttgattgaaaattttgtacctggcaattgagtaattgacattgttgaatgttgaatggatcttatgctgaatgtgctcggattagaatagaactttcttgacgactcttt

SEQ ID NO: 1109 - DNA, 1223 bp, Sorghum bicolor
tctgcggctgggcccaaagaactcctgcccattctacaaagcccacagcgggcaaaccctcaggctctctactctattaaaggagcataccctagcgtctccacccttcatcctcgcagtcatccccgagaaggagccgccgccgccgccgcgcaaacccgcttcgacgccgtcactcctcctcggggcgcaaccatggtggccgcaaagaagacgaagaagtctacggacaacatcaacaacaagctgcagcttgtgatgaagagcggcaagtacacgctcggctacaagactgtcctcaggaccatcaggaactccaagtcaaagctagtgatcattgctaacaactgtcctccgctccggaagtctgaaattgagtactatgctatgcttgctaaagtcacagtccaccacttccatggaaacaatgttgacctgggaacagcctgtggaaaatacttccgtgtctgctgcctcagtattattgatcctggtgattctgatatcattaagactacaccgggtgagcagtaaggaagccacaccagtagagcgctcttgtgcaatagtgctgtagcggatcttcttgctggacttgtcttttgttttgttcctatagaatttacctgacagtaaacagagttcgtgggaacattattctctttgattgaaaattttgtacctggcaattgagtaattgacattgttgaatgttgaatggatcttatgctgaatgtgctcggattagaatagaactttcttgacgactctttcttgacgactctgaacattgagttgggtcgccagtattcttctaggccttttgcgcctctctcatctctcaccaccacaattttcctctagctccgtgcttcattttgaaacattcagttggggcgtcgtagtattcttctgcgccttttgtgcccttctcatctcaccaccacaattttcccctagcttgctgcatcattttgaaagctgctggacaacacctctttccaactgcatgacaacccctctttccaactgcatttcacacattcgatcaatgtggccgataagaccgtaaacttcgtgtgtctttggccctcctcgcctagatccatcaattgcttgcgaatgtccagcctcaccttgatcctcatatactgactgatagcaatatcatcgtcatccgcatcacctcctcaaatcatctcaccatcagcccaagggcattt

SEQ ID NO: 1110 - DNA, 722 bp, Saccharum officinarum
cagtcatccccgagaaggagccgccgccgccgccgccgcgcaaagccgcttcgacgctgtcactcctcctcggggcgcaaccatggtggccgcaaagaagacgaagaagtcgacggacaacatcaacaacaagctgcagcttgtgatgaagagcggcaagtacacgctcggctacaagactgtcctcaggaccatcaggaactccaagtcaaagctagtgatcattgctaacaactgtcctccgctccggaagtctgaaattgagtactatgctatgctggctaaggtcacagtccaccacttccatggaaacaatgttgacctgggaacagcctgtggaaaatacttccgtgtctgctgcctcagtattattgatcctggtgattctgatatcatcaagactacgccgggtgagcagtaaggaagccaccccagtagtactccgcacctggcttccgaactcttagtgttgtagtggatcttgctggacttgccctttattgtgttacgacagaatttacctgacagtaaacagatcgtgggaatattttcttggattgaaaattttgttcctggcaattgacattgttgaatggattgaaaattttgttcctggcagttgacattgttgaatggatcttatgcggaaatgtgctcctcggttagagctggtaggtttcattttggtcctaacaaatgacattggtgaattacaaaaaaaa

SEQ ID NO: 1111 - DNA, 917 bp, Oryza sativa
caagcccaacaaacccatttacccccagcgtgggcaggcgaaccctttccctcccgtgcctatataaggccacaaaccctaacgcccccactcttccacctcgcagtcgccaccccgagcagaagccgccgccgccgcccgaaaccctcgccgccgtcgcttctcctcggggcgcagccatggtggccgcaaagaagacgaagaagtccacggacaacatcaacaacaagctgcagctcgtgatgaagagcggcaagtacacgctcggctacaagaccgtcctcaggaccctcaggaactccaaggcgaagctagtgatcatttctaacaactgcccacctcttcggaagtcagaaattgagtactacgctatgttggccaaggtcaccgtccaccatttccacggaaataatgtcgatctggggacagcctgtggtaaatacttccgtgtttgctgcctcagcattattgatcctggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgttcttggattggaaaattttgttcctggcccgaatcatgttttcaattagaacgcttggctgtttgttcactgaacttcgcatcattacacgtggttgttaaagagctctttagatgcagaccagcttgcgctgctgcatttgcacgagggttgacgataccgccggtaaccgcgtggcttaccgggggtacggaaatataaataccgtggtaacttccttaaattcatataaatgttaaaaataatttgaatttttgataaa

SEQ ID NO: 1112 - DNA, 828 bp, Oryza sativa
actcttccacctcgcagtcgccaccccgagcagaagccgccgccgccgcccgaaaccctcgccgccgtcgcttctcctcggggcgcagccatggtggccgcaaagaagacgaagaagtccacggacaacatcaacaacaagctgcagctcgtgatgaagagcggcaagtacacgctcggctacaagaccgtcctcaggaccctcaggaactccaaggcgaagctagtgatcatttctaacaactgcccacctcttcggaagtcagaaattgagtactacgctatgttggccaaggtcaccgtccaccatttccacggaaataatgtcgatctggggacagcctgtggtaaatacttccgtgtttgctgcctcagcattattgatcctggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgttcttggattggaaaattttgttcctggcccgaatcatgttttcaattagaacgcttggctgtttgttcactgaacttcgcatcattacacgtggttgttaaagagctctttagatgcagaccagcttgcgctgctgcatttgcacgagggttgacgataccgccggtaaccgcgtggcttaccgggggtacggaaatataaataccgtggtaacttccttaaattcatataaatgttaaaaataatttgaatttttgataaa

SEQ ID NO: 1113 - DNA, 563 bp, Cajanus cajan
ggggggggatgcatcatctttttcttctctctgattgtgccgctacttgcatttcattgcgtaacaatggttgcagctaaaaaaactaagaagacccatgagagcatcaacaacaggctcgctcttgtcatgaagagcggcaaatacacccttggatacaagaccgttctcaaatctcttaggagctccaaagggaactcattatcattgccaacaactgtccccctttgaggaagtcagagatagagtattatgctatgttggctaaggttggagttcatcattataatgggaacaatgtggatttgggcactgcatgcggcaaatattacagagtgtgctgcctcagcattattgatccgggtgattcagatatcattaagacactgcctggggagcagtaaagtagtgttggaagttccttgcttgatatttattgtttttagtttattcagacattgtggaaagaaaaatctgattgagttgtaaactttggtgtaaggcttttgatttttgggtattctagttgagtatcagtaattttgacgttgcaagtttttcat

SEQ ID NO: 1114 - DNA, 690 bp, Sequoia sempervirens
gagaattttaaggcgtctgtggctgggctttttcttccatcggcaaaatggtggccactaagaaaacaaaaaggctcatgagagcatcaacaacaggttggctcttgtgatgaaaagtggaaaatacacgctaggttacaaaactaccctcaagtctatcaggaccaacaaaggaaagcttattataattgcaaacaactgtcctcctcttcgtaggtcagaaatagagtactatgccatgcttgcaaagattggggtacatcatttcaatggaaacaatgttgatctagggacagcttgtgggaagtattatcgggtgtgctgtcttagcattacagatccaggtgattctgatatcattaagacagtaccatcagatcagtgagtgcataattgggatggttttgtcaggaaattgttaattttcgtacctgcccaagatgttggggagggagtagggaattagtggtaaaaactttcagacgagattcatttcagtttttcttttagacggcaagaaacatcaacctttctttttaggtttgagttgtcttctgattaagagggctatttattttgaatgaccaaaatctgtaatcacggaaacttgtaaggttgtcaatcaaatctatattccatagtagttttcttttggatggggtgatgcaattttttcataaagctcttgta

SEQ ID NO: 1115 - DNA, 920 bp, Hordeum vulgare
aaaaccctccccttcccgggcctttataatccaaaccctagagcgcaactggctcctccacctcgcagacatccccgagcagaagccgccgccgacgacgccgctcctcgcgacgccgctacttctcctcggggtgcaaccatggtggcctccacgaagaagacgaagaagtccggggacaacatcaacaacaagctgcagcttgtcatgaagagtggcaagtacacgctcggctacaagaccgtcctcaggaccctcaggaactccaaggcaaagctagtgatccttgctaataactgccctccacttcgcaagtccgagattgagtactatgctatgttggcgaaggtcactgtccaccactaccatggaaacaatgttgatttgggaactgcctgtggtaaatacttccgagtctgctgcttgagcatcattgaccctggtgactccgacatcatcaacgcaacaccagctggccagtaaacctgtgtgccattttcagtatcttgtctgatgtgtcatctggggtgttctagagtgtagttcttgctggacttgatttggtcttgtgtacatcatttatcagtcaatcaagtttcatgggactatcggtttggatcaaaagttcttgttcctggcttaattactctttgttgcactgctgtaagcaagcatggtgttgctgtgatcagtagatttggcttgaaatgctctgattcttatgaaaagagtaaccttggcccgagactcgtaatgacatcatgaaattagttgtcgatgcaaggttgggcctttagcttagatgcgatctgtagtttactttttcattggacggttgggcctttgtcttagcacgtgttctctttaacgtccattgttggtttagtttgcgttaatgccttttgcgtgttttttgtttg

SEQ ID NO: 1116 - DNA, 813 bp, Hordeum vulgare
gaagccgccgccgacgacgccgctcctcgcgacgccgctacttctcctcggggtgcaaccatggtggcctccacgaagaagacgaagaagtccggggacaacatcaacaacaagctgcagcttgtcatgaagagtggcaagtacacgctcggctacaagaccgtcctcaggaccctcaggaactccaaggcaaagctagtgatccttgctaataactgccctccacttcgcaagtccgagattgagtactatgctatgttggcgaaggtcactgtccaccactaccatggaaacaatgttgatttgggaactgcctgtggtaaatacttccgagtctgctgcttgagcatcattgaccctggtgactccgacatcatcaacgcaacaccagctggccagtaaacctgtgtgccattttcagtatcttgtctgatgtgtcatctggggtgttctagagtgtagttcttgctggacttgatttggtcttgtgtacatcatttatcagtcaatcaagtttcatgggactatcggtttggatcaaaagttcttgttcctggcttaattactctttgttgcactgctgtaagcaagcatggtgttgctgtgatcagtagatttggcttgaaatgctctgattcttatgaaaagagtaaccttggcccgagactcgtaatgacatcatgaaattagttgtcgatgcaaggttgggcctttagcttagatgcgatctgtagtttactttttcattggacggttgggcctttgtcttagcacgtgttctctttaacgtccattgttggtttagtttgcgtt

SEQ ID NO: 1117 - DNA, 802 bp, Brachypodium distachyon
acgttgggcaaaaacccttgcctcccagagtctatataatcccaaaccctagcgccgccgactcctccatctcgcagacatccccgagcagaaaccgccgccgccgtcgaccgctcttgaaggcctcgtcgccgctacttctcctcggggcgcaaccatggtggcctccacgaagaaggcgaagaagtccggggacaacatcaacaacaagctgcagcttgttatgaagagcggcaagtacacgctcggctacaagaccgtcctcaggaccctcaggaactccaagtcaaagctagtgatcattgctaacaactgtcctccccttcggaaatctgagatcgagtattatgctatgttggcgaaggtcactgtccaccactaccacggaaataatgtcgatttggggactgcctgtggtaaatacttccgtgtctgctgtctgagtatcattgaccctggcgattccgacatcatcaacaccacaccaggtggccagtaaggaacaatctcagtggcttgtctgatgtgttctgaactattctaaactgtagctcttgctggacttgattcggtctcgtgtacatcatttaccagtcaatcaagtttcgtggggatatcatgttggattgaaaaattgttcctgcattatcatacatatccccttgtgctgcagttatcgttacccaatgtctgttattgtagaacatagttctgctatgataagtagtttggccttatagcattgacttatgccgcagtatgatatttttcgcttaggtagcaggggccctaaaacaatgtg

SEQ ID NO: 1118 - DNA, 941 bp, Brachypodium distachyon
acgttgggcaaaaacccttgcctcccagagtctatataatcccaaaccctagcgccgccgactcctccatctcgcagacatccccgagcagaaaccgccgccgccgtcgaccgctcttgaaggcctcgtcgccgctacttctcctcggggcgcaaccatggtggcctccacgaagaaggcgaagaagtccggggacaacatcaacaacaagctgcagcttgttatgaagagcggcaagtacacgctcggctacaagaccgtcctcaggaccctcaggaactccaagtcaaagctagtgatcattgctaacaactgtcctccccttcggaaatctgagatcgagtattatgctatgttggcgaaggtcactgtccaccactaccacggaaataatgtcgatttggggactgcctgtggtaaatacttccgtgtctgctgtctgagtatcattgaccctggcgattccgacatcatcaacaccacaccaggtggccagtaaggaacaatctcagtggcttgtctgatgtgttctgaactattctaaactgtagctcttgctggacttgattcggtctcgtgtacatcatttaccagtcaatcaagtttcgtggggatatcatgttggattgaaaaattgttcctgcattatcatacatatccccttgtgctgcagttatcgttacccaatgtctgttattgtagaacatagttctgctatgataagtagtttggccttatagcattgacttatgccgcagtatgatatttttcgcttaggtagcaggggccctaaaacaatgtgaagctgaggcatgccattacgcagcttgcaccaattggaagaaatctacgcttgtaaagttgaaagttttcgaagaaacaaaaggatgaaactacaagtagttacacaaagtaacccaaaaaacagccgctacttgtac

SEQ ID NO: 1119 - DNA, 724 bp, Festuca arundinacea
  misc_feature (192)..(192): n is a, c, g, or t
  misc_feature (309)..(309): n is a, c, g, or t
ggccgagggcgagcagaagccgccgtcgtcgccgccgactccaacacttgcgtcgcagccgcttctcctcgggtcgtaaccatggtggcctccacgaagaaggcgaagaagtccggggacaacatcaacaacaagctgcagcttgtcatgaagagcggcaagtacacgctcggctacaagaccgtcctcaanaccctcaggaactccaagtcaaagctagtgatcattgctaacaactgccctccacttcgtaagtctgagatcgagtactatgctatgttggccaaggtcactgtccaccacttccanggaaacaatgttgatttgggaacgtcctgtggtaaatacttcagcgtctgctgtctgagtatcattgaccctggcgattctgacatcatcacctccactccagctggccagtaaccaaccttttcactgtcttgtctgatgcgtcgtctgagccgttctagactgtagttcttgctggacttgatttggtctcgtgtacatcatttatcagtcaatcaagttttgtggggatatcgttttggatcggaagttttgtctcttcctgagtttaattgcactttgttgcactgctgtcatcaaagtatggttattctgtgatagtttgtccgtgttgattttctacggcagttcagaatggtgtttctcatgctctcaatctgattgagattctctgagcaacggtgttgcaataaac

SEQ ID NO: 1120 - DNA, 603 bp, Triticum aestivum
gccgccacttctcctcggggcgcaaccatggtgacctccacgaagaagacgaagaagtccggggacaacatcaacaacaagctgcagcttgtcatgaagagcggcaagtacacgctcggctacaagaccgtcctcaggaccctcaggaactccaaggcaaagcttgtgatccttgctaacaactgccctccgctccgcaagtctgagattgagtactatgctatgttggcgaagatcactgtccaccactaccatggaaacaatgttgatttgggaactgcgtgtggtaaatacttccgagtctgctgcctgagtatcatcgaccctggcgattccgacatcatcaacgcaacaccagctggccagtaaacctgtgtatgccattttcagtgtctcgtctgatgtgtcatctgaggtgttctagagtgtagttcttgctggacttgatttggtcttgtgtacatcatttatcagtcaatcaagtttgatgggactatggttttggatcaaaaggttttgtttcctggcttgattgattgctcttcgtggtgctgctgtcagcaagcatggttttgctgtgatcagagttttctgtgtgttgct

SEQ ID NO: 1121 - DNA, 698 bp, Triticum aestivum
cgggcctttataatccaaaccctagcgcaaccgactcctccacctcgcagacatccccgagcagaagcgcagccgacgccgctgaccctcgcgacgccgccacttctcctcggggcgcaaccatggtgacctccacgaagaagacgaagaagtccggggacaacatcaacaacaagctgcagcttgtcatgaagagcggcaagtacacgctcggctacaagaccgtcctcaggaccctcaggaactccaaggcaaagcttgtgatccttgctaacaactgccctccgctccgcaagtctgagattgagtactatgctatgttggcgaagatcactgtccaccactaccatggaaacaatgttgatttgggaactgcgtgtggtaaatacttccgagtctgctgcctgagtatcatcgaccctggcgattccgacatcatcaacgcaacaccagctggccagtaaacctgtgtatgccattttcagtgtctcgtctgatgcgtcatctaaggtggttctagagtgtagttcttgctggacttgatttggtcttgtgtacatcatttatcagtcaatcaagtttgatgggactatggttttggatcaaaaggttctgttcctggcttgattgattgctcttcgtggtgctgctgtcagcaagcatggttttgctgtgatcagagttttctgtgtgttgct

SEQ ID NO: 1122 - DNA, 652 bp, Triticum aestivum
cggccgccacttctccacggggcgcaaccatggtgacctccacgaagaagacgaagaagtccggggacaacatcaacaacaagctgcagcttgtcatgaagagcggcaagtacacgctcggctacaagaccgtcctcaggaccctcaggaactccaaggcaaagcttgtgatccttgctaacaactgccctccactccgcaagtctgagattgagtactatgctatgttggcgaagatcactgtccaccactaccatggaaacaatgttgatttgggaactgcgtgtggtaaatacttccgagtctgctgcctgagtatcatcgaccctggcgattccgacatcatcaacgcaacaccagctggccagtaaacctgtgcatgccattttcagtgtctcgtctgatgccattttcttgctggacttgatttggtcttgtgtacatcatttatcagtcaatcaagtttgatgggactatggtttttcactgtcttagcacgccttctcttccccacgtttgatattttgcgtcatagctatgagtaatcagtggaaatacacggagacgagcctattgattcccaagtactgaacctaatctgatcgtaaatgggctctgtacaacggtccccctttgacacgtaaaaaaaaaa

SEQ ID NO: 1123 - DNA, 917 bp, Musa acuminata
aaacaaaagaaaaagaaaaccctagggttttccgccgcggccacggagaccgtctcctccgcctttgacaccttcaatcctcggccatggcgcccgtcaagaaggcgaagaagagcactgagagcataaacaacaggctcgctctcgtgatgaagagcgggaagtacaccctcgggtacaagacagtccttagatccctccgcaactccaaagggaagttaattataattgctaataactgccctccacttcgcaagtctgaaatcgagtattatgcaatgttggcaaaggttggagtacatcatttcagtggcagtaacgttgatcttggaacagcctgcggcaaatacttccgtgtatgctgcctcagcattattgatcctggtgactccgacattatcaagagcattcctggagagcaataagagaagcacaaaacatatgctggctcatatgtttgacccgggcttatcattattccgaatctggtttgtctttaaaatgttgctaaatgatatcgctgtcgagaatatatatatgacatgtttgtttaatcatgccttgttgtcatatatatatgactttaaaatgttgtttccttatctttttgtacttttactaatgagatctctagaggtagtttagcaatatgttacctgaagcttctgtgcttctgcctcgcattccacccaatctcaaggaataggaagtcggactgtgtgcttgaagatataagttgcacaagattaagggtccctatctacttacctctacaagtggatcaaactgaaccttttagtgccaatgagtttttggatggttaataactcgagcataagattatttttactcaaacttgttcaaataatcgtgtccaagtactcaataatattgtgagcaatgaaatctcaactgac

SEQ ID NO: 1124 - DNA, 718 bp, Cicer arietinum
ttttgtttattcgcacaaatctttctcgtaaccctaatattatactccaccatggttgccgcaaagaaaaccaagaagacccatgaaagtattaacaaccgacttgctcttgtaatgaagagtgggaagtatactttgggttataaaactgttctcaaatctcttagaagctccaaaggaaaattgatcattattgccaacaactgtccaccattgaggaaatctgaaattgagtactatgctatgttggcgaaggttggagttcatcactacaatgggaacaatgtggatcttggtactgcttgtggaaaatactacagagtgtgctgtctcagcatcgttgatcctggtgattctgatattatcaagacaatgcctactgatcaatagagtgcctacaatagagttgttgtattaagtcctcaatttttgtcctttttaagaacaaaactgtggttgtttaatgttttgcttgtttttgttgatttagaagaaaatttaatgttgaattaatgaattgtttggttattgaagtatcaagattaattgactattcaatttttgctcaaaactgattttaatgaaccatataattgtgcaaggccaattgagttagcaacatctgtacgttggcattagaggtaaacttttgagcttggtatattttttttgtcataagtaatagaaacaagtcttaccattatgaatcataaaaaaa

SEQ ID NO: 1125 - DNA, 614 bp, Vigna unguiculata
acggcgactgagaagctgtttcctccgtttagggattctgcttcctttctccatactgcaacaatggttgccgccaagaagaccaagaagacccatgagagcatcaacaacaggctcgctcttgtgatgaagagtggcaagtacacccttggttacaagaccgttctcaagtcgctcaggagctccaaaggaaaactgattatcattgccaacaattgccctcctttgaggaagtcagagatagaatactatgctatgttagcaaaggttggagttcatcactacaatggcaacaatgttgatttgggaactgcatgcggcaaatattacagagtgtgctgtctcagcattattgatcctggtgattctgatatcatcaagacactccctggggaacaataaagtagtattggagttgcatgcttttattttctgttgttagttgattaagacattgctgaaagagtatctgattcagttgtagacttttgatgtaaggtgcatggtttttgggtattctagctgagcatcaagtaattttgagttttcatcatgtttcattgtgttaatttttataaagataatataattttattttcgtcatggttgcttcc

SEQ ID NO: 1126 - DNA, 744 bp, Epimedium sagittatum
gagggtaaaaggaaaaccctagtgtgtgttggccgcagagcatagctgcaagttagggtttgtagaggttcttcatcgccgttcaggaacagaagcacaaatcaaccatggtggccgccaagaaaaccaagaagtcttatgacaacatcaacaccaagctcgctttggtgatgaagagcggcaagtataccttgggttataagaccgttctcaaatcgctcaggagctccaaagggaagcttattatcatcgcgaacaactgtcctcctctaagaaagtctgaaatcgagtactatgctatgcttgccaaagtgggagttcaccactttaacggcaacaatgttgaccttggtactgcttgtggaaagtactaccgagtctgctgtctgagtatcatcgacgcaggggattctgacatcattaagagtatccccggtgatcagtgagttctggcttcattaaattgctgaacatctgttattttttaggccttgtttctttaatcatagattgtctgttacccagtcctaagagtttttgtaagttttgtgcgaattttggtaaggtttttaagaacaatgcccttggtaagtggaagtctactctctaaactgttacctttaaaatattcttggtgttggaaaccgtttatttgtagtttttaagattagtattggaagtggtataaacacttctaattaaatgtatgtgatatttctctaggagaacaactcttcgagccct

SEQ ID NO: 1127 - DNA, 895 bp, Elaeis guineensis
caaattgtagcaagtcattgtgcaaacctgcaattggtcagagcctgcacttcacgcgtagacaactgcagaaccaacaagcaatgatccaagttggtatagagagggcaaacagtggacagcaaccaataattctcaagccgcgcgggtcagtcatctcccagcccagatgatagtttgccacacctgcttttcaatcagacgttgcaaacacatgcgtgtcgggatccaacggtcacgatctcccgattgcgagcgcaaggtgcccacagggatccagggttttccctctctccgcctccatcctttcatcctcgaagcatcacccatggcgcccacaaagaaggcgaagaagagtaccgagagcataaacaacaggctcgctctcgtgatgaagagcgggaagtatacccttgggtacaagacggtcctcagatcccttcggaactccaaaggaaagttaatacttattgcaaacaattgccctcctcttcgcaagtctgaaatcgagtattacgcgatgttggctaaggttggcgtacatcatttcaatgggaataatgtggaccttggaacagcttgcggcaaatacttccgtgtaagctgccttagcattattgatccaggtgactctgacatcatcaagagtatcccaggtgaccaatgagatgaagggaataccgaggttgtacttgtgtcttaggaattatgtttaggttcttgcttggcatggtatttcctattatagttaactgtccaaatttttgactggaaactgttgcaagataaatgttgcattgtcctgtttttgtttctgttgctttgtcatattttatggtgaatggagacttattcttgagtaccaggtgaaacgttttgaatggattgtgagacc

SEQ ID NO: 1128 - DNA, 658 bp, Cajanus cajan
caaagcaaaccctagtggcagtgacaaagtgtgtagtctcttccgttagggtttccatctctgtgttcctgcggctgtcattcacttcacagaacaaacaacaatggttgccgccaagaaaaccaagaagacccatgagagcatcaacaacaggctcgctcttgtcatgaagagtggcaaatatacacttggctataagactgttctcaaatctcttaggagctccaaagggaaactcattatcattgctaacaactgtccccctttgaggaagtcagaaatagaatattatgctatgttggctaaggttggagttcatcattataatgggaacaatgtggatttgggcactgcatgcggtaaatattacagagtatgctgcctcagcattatcgatcctggtgattcagatatcataaagacactgcctggggaacagtaaaatggtgtttgaagttccttgcttgatattttctgtttgtagttgattcagaccgtggagagaaaaattgattcaattgtaaacttggtgtaaggtgcatgatttttgggtattctagttgagcatcaagtaattttgactttgcaaatttttcattgttccaatttctacagatataatatataattatctcccttgctgttaatgcccatgtta

SEQ ID NO: 1129 - DNA, 771 bp, Aristolochia fimbriata
tagggttttgcagagagggagagagtgtgagagattcgagtcacagccatggtggccactaagaagacgaagaagactcatgagagtattaacaacagactcgctcttgtgatgaagagcgggaaatataccctaggttacaagaccgtcctcaagtccctgaggagctccaaaggaaagttggtaatcattgccaacaactgccctccccttaggaagtcagagatcgaatactatgctatgttggctaagtgtggagtacatcatttcaatggaaacaatgttgatctggggactgcttgtggtaaatattaccgggtctgctgcctcagcatcattgatccaggtgattctgatattattaagagtctcccaggcgaccagtgatcatagcgacgcatttagtgtcttgtgtttttaagtttttgcgcggttgttgtattaggactagtgttttgttaagtggtggctgagaattaaattttgattttttttatccatattgttaatcagagctagtagtcctgccttttgaattttacctactactgtcttttgaactattcctactactcctatctttatacggacttgttagttatgctctcgatccttccctgtgtccattaagcatcttttcgattaaaagcattatttaggaaatcagattactgtgacctttaggcatcttttcgattaaaagcattatttagggaatcaaaatgtgtaaatgaaattaataaaagacttggatgttagcgccgttgctcg

SEQ ID NO: 1130 - DNA, 672 bp, Aristolochia fimbriata
tcgaacctagggttttgcagagagggagagagtgtgagagattcgagtcacagccatggtggccactaagaagacgaagaagactcatgagagtattaacaacagactcgctcttgtgatgaagagcgggaaatataccctaggttacaagaccgtcctcaagtccctgaggagctccaaaggaaagttggtaatcattgccaacaactgccctccccttaggaagtcagagatcgaatactatgctatgttggctaagtgtggagtacatcatttcaatggaaacaatgttgatctggggactgcttgtggtaaatattaccgggtctgctgcctcagcatcattgatccaggtgattctgatattattaagagtctcccaggcgaccagtgatcatagcgacgcatttagtgtcttgtgtttttaagtttttgcgcggttgttgtattaggactagtgttttgttaagtggtggctgagaattaaattttgtattttttttattccatattgttaatcagagctagtagtcctgccttttgtaatttacctactactgtcttttgtaactattcctactactcctatctttatacggacttgttagttatgctctcgatccttccctgtgtccattaagcatcttttcgtattaaaagacattatttagg

SEQ ID NO: 1131 - DNA, 611 bp, Musa acuminata
gggcggccacggagaccgtctcctccccctttgacaccttcaatcctcggccatggcgcccgtcaagaaggcgaagaagagcactgagagcataaacaacaggctcgctctcgtgatgaagagcgggaagtacaccctcgggtacaagacagtccttagatccctccgcaactccaaagggaagttaattataattgctaataactgccctccacttcgcaagtctgaaatcgagtattatgcaatgttggcaaaggttggagtacatcatttcagtggcagtaacgttgatcttggaacagcctgcggcaaatacttccgtgtatgctgcctcagcattattgatcctggtgactccgacattatcaagagcattcctagagaacaataagagaagcacaaaacatatgctggctcatatgtttgacccgggcttatcagtattccgaatctggtttgtctttaaaatgttgctaaatgatatcgctgtcgagaatatatatatatatatgacatgtttgtttaatcatgccttgttgtcatatatatatgactttaaaatgttgtttccttatcttttgtactttactaatgagatctctagagttagt

SEQ ID NO: 1132 - DNA, 665 bp, Phaseolus coccineus
aataagtacactatatcaaaccctagtgaccaaacatcacagcttctcagtcgccgtttcctccgtttagggtttcttcttcctttctccgaactgcaacaatggttgccgccaagaagaccaagaagacccatgagagcatcaacaacaggctcgctcttgtcatgaagagtggaaagtacacccttggatacaagaccgttctcaaatcccttaggagctccaaaggaaaactgattatcattgccaacaactgccctcctttgaggaagtcagagatagaatactatgctatgttggcaaaggttggagttcatcactacaacggaaacaatgttgatttgggcactgcatgcgggaaatattacagagtgtgctgcctcagcattattgatcctggcgattctgatatcatcaagacactgcctggggaacaataaagtagtatcggagttgcatgcttttatattttctgttagttgattcagacattgctgaaagagtatctgattcagttgtagacttttgatgtaaggtgcatggttttgggtattattctagctgagcatcaagtaattttgagttttcatcatgcttcattgtggcaatttttatggagataatataattttattttcatcacgcttgcttcaaacgtcaaaaaa

SEQ ID NO: 1133 - DNA, 657 bp, Phaseolus coccineus
agagtggtcattatggccggggaaacataacagcttctgagtcgccgtttcctccgtttagggtttcttcttcctttctccgaactgcaacaatggttgccgccaagaagaccaagaagacccatgagagcatcaacaacaggctcgctcttgtcatgaagagtggaaagtacacccttggatacaagaccgttctcaaatcccttaggagctccaaaggaaaactgattatcattgccaacaactgccctcctttgaggaagtcagagatagaatactatgctatgttggcaaaggttggagttcatcactacaatggaaacaatgttgatttgggcactgcatgcgggaaatattacagagtgtgctgcctcagcattattgatcctggcgattctgatatcatcaagacactgcctggagaacaataaagtagtatcggagttgcatgcttttatattttctgttgttagttgattcagacattgctgaaagagtatctgattcagttgtagacttttgatgtaaggtgcatggttttgggtattattctagctgagcatcaagtaattttgagttttcatcatgtttcattgtggcaatttttatggagataatataattttatttttctattcatgcttgcttcaaaagacc

SEQ ID NO: 1134 - DNA, 634 bp, Phaseolus coccineus
agggtttcttccttagggcaaattcagaccactattaggctcttccgagaattccaacgccaccatggttgctgccaagaagactaagaagactcatgagagtatcaacaacaggctcgctcttgtgatgaagagtgggaaatatactttgggttataagacggttctcaaatccctcaggagctccaaagggaaattgattattattgccaacaattgcccaccattgaggaagtctgaaattgagtactatgctatgttggccaaggttggagttcatcattacaacgggaacaacgtggatttgggcaccgcatgtgggaaatattacagagtttgctgccttagcattgttgatcctggtgattccgatattatcaagacaatgcccaccgagcagtagagttgtatcaactcctctttttttgtccttaaaacttttgattgtttgatatttgttcctgttttttcagacatgtcttgaagaaagtttaatataggcagaactatttaggtatttgagctttttagaaattgcctacgtaattttttcttctcgtgtttgtttcacaatccattttggttcagcattttcctttaaatacctaaacaattcctagaccagaccagcaaa

SEQ ID NO: 1135 - DNA, 630 bp, Phaseolus coccineus
tggccgggggagggtttcttccttagggcaaattcagaccactattaggctcttccgagaattccaacgccaccatggttgctgccaagaagactaagaagactcatgagagtatcaacaacaggctcgctcttgtgatgaagagtgggaaatatactttgggttataagacggttctcaaatccctcaggagctccaaagggaaattgattattattgccaacaattgcccaccattgaggaagtctgaaatagagtactatgctatgttggccaaggttggagttcaccattacaacgggaacaacgtggatttgggcaccgcatgtgggaaatattacagagtttgctgccttagcattgttgatcctggtgattccgatattatcaagacaatgcccaccgagcagtagagttgtatcaactcctctttttttgtccttaaaacttttgattgtttgatatttgttcctgttttttcagacatgtcttgaagaaagtttaatataggcagaactatttaggtatttgagctttttagaaattgcctacgtaattttttcttctcgtgtttgtttcacaatccattttggttcagcattttcctttaaatacctaaacaattcctag

SEQ ID NO: 1136 - DNA, 554 bp, Chelidonium majus
agttttaggtttaggattctgctgttgttgtcctctcgctctgtatagccatggtggccgccaagaagaccaagaagactcatgagagcatcaacaataggttggctctcgtaatgaagagtggcaagtacactcttgggtacaagacagttctcagatctcttaggagctctaaaggaaagctgataatcatagccaacaactgcccacctcttagaaagtctgagattgagtattatgctatgttggccaaggttggggttcatcatttcaatggaaacaatgtggatttgggtacagcttgcggtaaatactaccgggtatgctgcctcagtatcattgatccaggtgattctgatatcattaagaccatcccgggcgatcagtgagaggacaaggatggtttatccatggactcttttttggctttggttttgttttgtttcaattatcatcatattggatatgtagttttactgttagagtactataactgataacattcatcatgtttgactcgtgcaagaattttatctttagaaaaagatttgctt

SEQ ID NO: 1137 - DNA, 720 bp, Cicer arietinum
ttttttgtttattcgcacaaatctttctcgtaaccctaatattatactccaccatggttgccgcaaagaaaaccaagaagacccatgaaagtattaacaaccgacttgctcttgtaatgaagagtgggaagtatactttgggttataaaactgttctcaaatctcttagaagctccaaaggaaaattgatcattattgccaacaactgtccaccattgaggaaatctgaaattgagtactatgctatgttggcgaaggttggagttcatcactacaatgggaacaatgtggatcttggtactgcttgtggaaaatactacagagtgtgctgtctcagcatcgttgatcctggtgattctgatattatcaagacaatgcctactgatcaatagagtgcctacaatagagttgttgtattaagtcctcaatttttgtcctttttaagaacaaaaccgtggttgtttaatgttttgcttgtttttgttgatttagaagaaaatttaatgttgaattaatgaattgtttggttattgaagtatcaagattaattgactattcaatttttgctcaaaactgattttaatgaaccatataattgtgcaaggccaattgagttagcaacatctgtacgttggcattagaggtaaacttttgagcttggtatattttttttgtcataagtaatagaaacaagtcttaccattatgaatcataaaaaaa

SEQ ID NO: 1138 - DNA, 607 bp, Vigna unguiculata
gtcgccgtttcctccgtttagggattctgcttcctttctccatactgcaacaatggttgccgccaagaagaccaagaagacccatgagagcatcaacaacaggctcgctcttgtgatgaagagtggcaagtacaccctcggttacaagaccgttctcaagtcgctcaggagctccaaaggaaaactgattatcattgccaacaactgccctcctttgaggaagtcagagatagaatactatgctatgttagcaaaggttggagttcatcactacaatgggaacaatgttgatttgggaactgcatgcggcaaatattacagagtgtgctgtctcagcattattgatcctggtgattctgatatcatcaagacactccctggggaacaataaagtagtattggagttgcatgcttttattttctgttgttagttgattaagacattgctgaaagagtatctgattcagttgtagacttttgatgtaaggtgcatggtttttgggtattctagctgagcatcaagtaattttgagttttcatcatgtttcatcgtgtcaatttttataaagataatataattttattttcgtcaaaaaaaaaaaaaaaa

SEQ ID NO: 1139 - DNA, 621 bp, Vigna unguiculata
cacagcttctcagtcgccgtttcctccgtttagggattctgcttcctttctccatactgcaacaatggttgccgccaagaagaccaagaagacccatgagagcatcaacaacaggctcgctcttgtgatgaagagtggcaagtacaccctcggttacaagaccgttctcaagtcgctcaggagctccaaaggaaaactgattatcattgccaacaactgccctcctttgaggaagtcagagatagaatactatgctatgttagcaaaggttggagttcatcactacaatgggaacaatgttgatttgggaactgcatgcggcaaatattacagagtgtgctgtctcagcattattgatcctggtgattctgatatcatcaagacactccctggggaacaataaagtagtattggagttgcatgcttttattttctgttgttagttgattaagacattgctgaaagagtatctgattcagttgtagacttttgatgtaaggtgcatggtttttgggtattctagctgagcatcaagtaattttgagttttcatcatgtttcatcgtgtcaatttttataaagataatataattttattttcgtcatgattgcttcaaaagtc

SEQ ID NO: 1140 - DNA, 572 bp, Zingiber officinale
gccattctatctcccgtctggtcttcgacgctgcacgcggatctccttctgcaatggcgcccgtcaagaaatcgaagaagaatgccgagaacatcaacagtaggctcgctcttgtgatgaagagcgggaagtacaccctcggctacaaaacggtcctccgaacacttcggatctctaaagcaaagttgattatcattgcaaacaactgcccaccactccgtaagtctgaaatcgagtactatgcaatgttggcgaaggttggagttcatcatttcagtggaaataatgttgaccttggaacagcatgtggaaaatatttccgagtttgctgcctcagcatcatcgatcctggcgactctgatatcatcaagagcatccctggggatcagtgagacatgcaaacggacagttttcctagttcaaggtccataggatttgggacaaaattacatcttttttcttagtggacaatttcctgttggtttttcatcttgagttatctagtttgtggccatcaactcaaatctcttgacgtaaaatgcgttgaatatcttgcatttcttacgattttc

SEQ ID NO: 1141 - DNA, 892 bp, Vitis vinifera
ctcctgtattgtataataacccgcaaatctataaatattgatgtgggcaaaaaccttgaaataggctccattaaaaccctagtacgagaggatattttcctccccattttctcggcatccaaccgccggaaaccctagcagcagcagcgtcgagcgaagatggcggcccccaagaaaaccaagaagactcaagaaaacatcaacaacaagctcgctctcgtgatgaagagcggcaagtacacgctcggctacaagaccgtgctcaagagcctcagaagctccaagggaaaattgattctgatttcgaacaattgtccgccgctccgaaaatcggagatcgagtactatgcgatgctttccaaagtcagcgtgcaccattttcatgggaataatgttgatctgggaacagcatgtggcaagtatttccgggtctcttgcctgagcattgtcgatccaggtgattctgatatcatcaagcaaatgcctagtgaccactgagctgactgttagatgggtgctgaggttttctcacaaactataggacaattttgttttttggtactaccatagacaggagcctcttttattgttgaaatttttcgtcccatcaaaagggcaaattttattttggttaaatgacagcagaccttcaaatcccatatggtttttagaatcaaaagaaagattgtttgggatatctgtgattgagctgatgcccatttcatcccttgataatctgattttgattccttagaattgtgggttttcttttgatatttgcaagctgacttatcccttccagagttctcggttttagattcttgttgaattgaatgtgctgtgcttagtggaataaagataggtttttgatggaaatcatcacaattactaa

SEQ ID NO: 1142 - DNA, 654 bp, Lotus japonicus
ggagtttactcgccgctttcatttccaccatctcctagggtttgcatcttctctgctctccgctgaaaccagcaacaatggttgccgccaagaaaaccaagaagacccatgagagcatcaacaacaggctcgctcttgtgatgaagagcggcaaatataccctcgggtataagaccgttctcaaatccctcaggagctccaaagggaaactgattatcattgctaacaactgtcctcctttgaggaagtctgagatagagtactatgccatgttggcgaaggttggagttcatcattacaatgggaacaatgttgatcttggcactgcctgcggaaaatactacagagtgtgctgcctcagcattattgatcctggtgactcagatatcatcaagacattgcctggtgaccagtaaagctgtcttgaagacttttgctggatatttttgttttctgagtttattttagacatttgtgaaagaaattccaatttagttgtagactggtgtctggggcatggttcttgggtatttcaacttgttgagcatcgtagttgactctgcaaaattttctgtttcattgtgccaatttttatatggataatattccagtgttatcatacatgctgttaatgtgttgtgttatttgcctgta

SEQ ID NO: 1143 - DNA, 667 bp, Lotus japonicus
ggaccgtgaactagggggttcatcttctctgcactcaacccagcaacaatggttgccgccaagaaaaccaagaagacccatgagagcattaacaacaggctcgctctggtgatgaagagtggcaaatatactctaggttacaaaactgttctcaaatcactgagaagttccaaagggaaactgattatcattgccaacaattgcccacctttgaggaagtcagagattgagtattatgctatgttggcaaaggttggagttcatcactacaatgggaacaatgttgatctgggcactgcatgcggcaaatactacagagtgtgctgcctcagcattatcgatcctggtgattctgatatcataaagacattgcccagtgaccagtaaagctgtctcgaagaattttgcttgatgtttttcttttctgagttatttagatatttgtgaaagaaaaactggtttagttgtttgtagactctgatgtagggcatggttcttggttattccagcctgttgagcatcgagtagttttgacaattcaaaattttctggttcattgtgccaatttctatatggataatatcataatattctagtttgatcgtacatgctgctaatgctagaaagtttatgcttctgttctcgacagagaaaggagaggaaaaaa

SEQ ID NO: 1144 - DNA, 608 bp, Medicago truncatula
ctagaggcagtgttacacattcatttccctcgccgcattttcttctctgcgaatctcacaccaaaccttcaacaatggtggccgcaaagaagaccaagaagactcatgagagcatcaacaacaggctcgctcttgtcatgaagagtggaaaatatacccttgggtataaaactgttctcaaatcccttaggagttctaaagggaaattgattatcattgctaacaactgtcctcctttgaggaagtctgaaattgagtactatgctatgttagcaaaggttggagttcaccattacaatggaaacaatgttgacttgggcactgcttgcggaaagtattacagagtgtgctgcctcagcattgttgatcctggtgattccgacatcattaagacaattcctggagatcagtaaacgaagtaaagatttttccatgatgttttcaattctatgttgtttagacgttgtcgaaagaaattctagttgtagactatggtgtacgatgcttgttattttggatatcccagctgattgagcattgagtaattttgacttcaatttttgtttcattgtgctcatttctatatagattatatttctagtttgatc

SEQ ID NO: 1145 - DNA, 811 bp, Medicago truncatula
ctagaggcagtgttacacattcatttccctcgccgcattttcttctctgcgaatctcacaccaaaccttcaacaatggtggccgcaaagaagaccaagaagactcatgagagcatcaacaacaggctcgctcttgtcatgaagagtggaaaatatacccttgggtataaaactgttctcaaatcccttaggagttctaaagggaaattgattatcattgctaacaactgtcctcctttgaggaagtctgaaattgagtactatgctatgttagcaaaggttggagttcaccattacaatggaaacaatgttgacttgggcactgcttgcggaaagtattacagagtgtgctgcctcagcattgttgatcctggtgattccgacatcattaagacaattcctggagatcagtaaacgaagtaaagatttttccatgatgttttcaattctatgttgtttagacgttgtcgaaagaaattctagttgtagactatggtgtacgatgcttgttattttggatatcccagctgattgagcattgagtaattttgacttcaatttttgtttcattgtgctcatttctatatagattatatttctagtttgatctataatgtctattatctgtgttgacattgaatttgtattggaaccccgaaagtatcaatctagttcattggaggaagaatactagtgaaatgttgaccttttatgtcaatgtaggtggatttaggatgggtgaaaaatgagaattaatgtgtttcatagaattaatgagtatggaggatgagtgattgggagaaaaacaatca

SEQ ID NO: 1146 - DNA, 660 bp, Elaeis guineensis
gcggccagtgcccacagggatccagggttttccctctctccgcctccatcctttcatcctcgaagcatcacccatggcgcccacaaagaaggcgaagaagagtaccgagagcataaacaacaggctcgctctcgtgatgaagagcgggaagtatacccttgggtacaagacggtcctcagatcccttcggaactccaaaggaaagttaatacttattgcaaacaattgccctcctcttcgcaagtctgaaatcgagtattacgcgatgttggctaaggttggcgtacatcatttcaatgggaataatgtggaccttggaacagcttgcggcaaatacttccgtgtaagctgccttagcattattgatccaggtgactctgacatcatcaagagtatcccaggtgaccaatgagatgaagggaataccgaggttgtacttgtgtcttaggaattatgtttaggttcttgcttggcatggtatttcctattatagttaactgtccaaatttttgactggaaactgttgcaagataaatgttgcattgtcctgtttttgtttctgttgctttgtcatattttatggtgaatggagacttattcttgagtaccaggtgaaacgttttgaatggattgtgagaccaagttttaattacatttctt

SEQ ID NO: 1147 - DNA, 692 bp, Carica papaya
ttcatctgtcaaaaaccctaacttctgtgatcctcttgtctactttttggccgcgcctcggctcatctggaaaaccctaagcgcccggcatttgctctatttcttcgcagcagcaatggtgtccgccaagaagacgaaaaagacacatgagagcataaacaataggctagctttggttatgaagagtggcaagtacactctcggctacaagaccgttctcaaatccctacgcagctctaagggtaagctgattatcatctcaaacaattgtccgcctctgcgcaagtccgagattgaatactatgccatgcttgcgaaaattggagttcatcacttcaatggaaataatgttgatctgggtaccgcatgcgggaagtactaccgggtatcttgtctgagtattgttgacccaggtgattcggatatcatcaagacacttcctggtgaccagtgattacccattcagttttgctattgtaaccttgtggtttagttggttggtttatgtactagaatttagatattcagtggtgtttgacgtacgaataccaccatattttagttgatgttggtcctgatctcttgaaattttgcaacgtggtttggtaattttcaagcaagatgaagattttatggtctgtctccctgagcagaaagtaaattaaaagttgaagaacaagtttttaagccta

SEQ ID NO: 1148 - DNA, 620 bp, Arachis hypogaea
gggggggagggtttcttcctctctgcatcaccatctacacacagtttgctctcttgcctgtctcttccagagtccagcaacaatggtggccgccaagaagaccaagaagactcatgagagcatcaacaacagactcgcacttgtcatgaagagtggcaagtacactctcggttacaagaccgttctcaaatctctcagaagctccaaagggaaattgattatcatcgctaacaactgcccaccattgaggaagtcagaaatagagtactatgccatgttggcaaaggttggagtccatcattacaatgggaacaatgtcgacttgggaactgcatgtggaaaatattacagagtgtgctgcctcagcattattgatcctggtgattctgatatcattaagacactgcctggcgaacagtaaaagtagagtcgaagttttttttgctcgcgatgttctgttttcagttggttcagacaatgttatatgaaaagttttatttagttttaagctattctgtatgagttgcattgcttttgggattctacattctagcagatacgcattgagtaattttaccatcaaattttttagatatatatttctgagtaacatagataac

SEQ ID NO: 1149 - DNA, 1095 bp, Cajanus cajan
aaagtgtgtagtctcttccgttagggtttccatctctgtgttcctgcggctgtcattcacttcacagaacaaacaacaatggttgccgccaagaaaaccaagaagacccatgagagcatcaacaacaggctcgctcttgtcatgaagagtggcaaatatacacttggctataagactgttctcaaatctcttaggagctccaaagggaaactcattatcattgctaacaactgtccccctttgaggaagtcagaaatagaatattatgctatgttggctaaggttggagttcatcattataatgggaacaatgtggatttgggcactgcatgcggtaaatattacagagtatgctgcctcagcattatcgatcctggtgattcagatatcataaagacactgcctggggaacagtaaaatggtgtttgaagttccttgcttgatattttctgtttgtagttgattcagaccgtggagagaaaaattgattcaattgtaaacttggtgtaaggtgcatgatttttgggtattctagttgagcatcaagtaattttgactttgcaaatttttcattgttccaatttctacagatataatatataattatctcccttgctgtcaaaaaaaaaaaaaaaacaaaaacaaaaaaatgaacaatccaaaatacaaaaccacaaaaacgtacaacacacataggcaacaacaacccccccaaaacagggctcccccggacggtggaatacccaccggcctaaaaccacttagcgggaccctccgacagagcccgcccgtcacaaggttcccacccaataggcgggcacaagacgccacaaacagcgccggtgcgagccccgcatatacgcctcgagacaatatttcccttagccaagatagccaaccactccccacaatcccagcgtcgcggcgaggcataccactcccctcagagcaccacctacaaaccggagaggtcacaccaccacgggtgcacctcaaacaatattcgaggtacaactccccgacgccagtcaccccacaatgctgaacgccaaaaaccaagaagccgctatgtacacagaaacaaccacgcccgca

SEQ ID NO: 1150 - DNA, 609 bp, Cajanus cajan
cacttcagagaaccaacaacaatggttgccgccaagaaaaccaagaagacccatgagagcattaacaacaggctcgctcttgtcatgaagagcggcaaatacacccttggctataagaccgttctcaaatcccttaggagctccaaagggaaactcatcatcattgctaacaactgtccccctttgaggaagtcagagatagaatattatgccatgttggctaaggttggagttcatcattataatgggaacaatgtggatttgggcactgcatgcggcaaatattacagagtgtgctgtctcagtattattgatcctggtgattcagatatcattaagacactgcctggggaacagtaaagtagcgttggaagttccttgatatatttttattttagttgatttagacatttggaagaaaatctgattcagttgtaatctttggagtaaggttgcctgttttctgggaactctagctgagcatcaagtaattttgacttggaaaattcttcatgatgttttattgtgctaatttctacagagataatatatttatattttgatagctccttctgttaatgcccgtgtgttagcaatgttgctcttaat

SEQ ID NO: 1151 - DNA, 648 bp, Cajanus cajan
cttcgtttagggtttgcatctctgtgttcctgtgccccccacttcagagaaccaacaacaatggttgccgccaagaaaaccaagaagacccatgagagcattaacaacaggctcgctcttgtcatgaagagcggcaaatacacccttggctataagaccgttctcaaatcccttaggagctccaaagggaaactcatcatcattgctaacaactgtccccctttgaggaagtcagagatagaatattatgccatgttggctaaggttggagttcatcattataatgggaacaatgtggatttgggcactgcatgcggcaaatattacagagtgtgctgtctcagtattattgatcctggtgattcagatatcattaagacactgcctggggaacagtaaagtagcgttggaagttccttgatatatttttattttagttgatttagacatttggaagaaaatctgattcagttgtaatctttggagtaaggttgcctgttttctgggaactctagctgagcatcaagtaattttgacttggaaaattcttcatgatgttttattgtgctaatttctacagagataatatatttatattttgatagctccttctgttaatgcccgtgtgttagcaatgttgctcttaat

SEQ ID NO: 1152 - DNA, 504 bp, Cajanus cajan
gtggtatcaacgcaggatacgggggggggatgcatcatctttttcttctctctgattgtgccgctacttgcatttcattgcgtaacaatggttgcagctaaaaaaactaagaagacccatgagagcatcaacaacaggctcgctcttgtcatgaagagcggcaaatacacccttggatacaagaccgttctcaaatctcttaggagctccaaagggaaactcattatcattgccaacaactgtccccctttgaggaagtcagagatagagtattatgctatgttggctaaggttggagttcatcattataatgggaacaatgtggatttgggcactgcatgcggcaaatattacagagtgtgctgcctcagcattattgatccgggtgattcagatatcattaagacactgcctggggagcagtaaagtagtgttggaagttccttgcttgatatttattgttttagttattcagacattgtggaaagaaaatctgattgagtt

SEQ ID NO: 1153 - DNA, 930 bp, Oryza sativa
aaaaagaagcactccttgcgttcactgttcagtgatttttaaacagtccaaaaatccgggaagtttggactgcgggatttgcagaagaaattaccaactgggctggcttgatacgcaaagttggcccagtaagaatctgggcttgaggccgtcgatacgcaataatgtagcccaataacgcaaggcccatctctcacgttatatactcccccctctgttcgaacccttgttgacgctgtaggtttcccattcccgccgccgccgccaccgacgccgtcgccgacgatcccatggctcccgttaagaagacgaagaagaacgcggaggggatcaacaacaagctgcagctggtgatgaagagcggcaagtacaccctcggctacaagaccgtcctcaagaccctccgcaactccaaagggaagctagttatcgttgcaaacaactgccctccacttaggaagtctgaaattgagtactatgctatgctgggaaaagttagtgtgtatcacttcaatggaaacaatgttgatcttggcactgcctgcggcaagtactaccgagtgtgctgtctcagtgtcgtcgatcctggtgactcggatattaccaagcaattacctgagagtcattgatgtgcatgcattggccttgtgaccgatcttatcttcactttttgctcacatgaaaaagatatatatcttcatacggtgttcttgtgaagttgcgatacattgatgaaccaaacctggcacacttcaatagcatcgcctagttttgctctgctaagcatctgtcaacggtaaaggtaggagtgaaatgtatgtaggatttggaggtaatgggaaataaatggtgcaatctgttttactttccgagtattctcaggctgtcatgcatcaagtaaatttaattagatgacaagcagtttcaaaa

SEQ ID NO: 1154 - DNA, 641 bp, Oryza sativa
gttgacgctgtaggtttcccattcccgccgccgccgccaccgacgccgtcgccgacgatcccatggctcccgttaagaagacgaagaagaacgcggaggggatcaacaacaagctgcagctggtgatgaagagcggcaagtacaccctcggctacaagaccgtcctcaagaccctccgcaactccaaagggaagctagttatcgttgcaaacaactgccctccacttaggaagtctgaaattgagtactatgctatgctgggaaaagttagtgtgtatcacttcaatggaaacaatgttgatcttggcactgcctgcggcaagtactaccgagtgtgctgtctcagtgtcgtcgatcctggtgactcggatattaccaagcaattacctgagagtcattgatgtgcatgcattggccttgtgaccgatcttatcttcactttttgctcacatgaaaaagatatatatcttcatacggtgttcttgtgaagttgcgatacattgatgaaccaaacctggcacacttcaatagcatcgcctagttttgctctgctaagcatctgtcaacggtaaaggtaggagtgaaatgtatgtaggatttggaggtaatgggaaataaatggtgcaatctgttttactttc

SEQ ID NO: 1155 - DNA, 636 bp, Glycine max
gcagtcttgtcgtcgtctcttcctcttcgcaacaatggttgccgccaagaaaaccaagaagacccatgagagcatcaacaacaggcttgctcttgtcatgaagagcggcaaatacacccttggttataagaccgttctcaaatctcttaggagctccaaagggaaattgattatcattgctaacaactgcccccctttgagaaagtcagagattgaatactatgccatgttggcaaaggttggagttcatcattacaatgggaacaatgtggatttgggcactgcctgcggcaaatattacagagtgtgctgccttagcattattgatcctggtgattcggatatcattaagacactgcctggtgaacagtaaagtagtgttgaagttacttgcttgttattttctggttttagttgattcggactttgaaagaatatcttgttgagttgtagactttggtgtaaggtgcaaggtttttgtgtgttctagctagctgagcatcaagtaattttgacttttcaaagttttcatgttttattgtgccaatttctagagatgatataattatattatgatcgcgcgtgctggtaatgcctgggttatcgacgttcgcttgcaaatggatcttgacattg

SEQ ID NO: 1156 - DNA, 695 bp, Trigonella foenum-graecum
ctagagccagtgttacactttcatttcaatcgccgcaccattttcttctctgcgcatctcacccatcccttcaacaatggtggccgcaaagaagaccaagaagactcatgagagcatcaacaacaggcttgctcttgtcatgaagagtggaaaatataccctcgggtataaaaccgttctcaaatccctaaggagttccaaagggaaattgattatcattgctaacaactgtccacctttgaggaagtctgaaattgaatactatgctatgttggctaaggttggggttcaccattacaatggaaacaatgttgacttgggaactgcttgcggaaagtactacagagtgtgctgcctcagcattgttgatcctggtgattctgacatcattaagacaattcctggggaacagtaaacgtagtaaagattttcccatgatgttttcaattctctgtgttgtttagacattgttgaaagaaattctagttgtagactatggtgtacgatgcttgttattttgggtatcgcattgagtaattttgactgcaatttttgtttcattgtgctgatttctatctatatagataatatttctagtttgatctttactgtctgtgtttgcttgcaaatgattgttgaccttgaatttgtattagaacctagaaatttcaatttaattgagtagggattacgat

SEQ ID NO: 1157 - DNA, 594 bp, Trigonella foenum-graecum
ccaacaaaattagggcttcttgttgaatttcacaaatcttctctgcctaatcgcaaaccgtaatttcaaccatggttgccgcaaagaaaaccaagaagacccatgagtctattaacaacagactcgctcttgtgatgaagagtgggaagtatactttagggtataagactgttctcaaatctctcaggagctccaaagggaaattgattatcattgctaacaattgcccaccattgaggaagtctgagattgagtactatgctatgttggcgaaggttggagttcatcactataacggcaacaatgtggatctcggcactgcctgcggaaaatactacagagtgtgctgtctcagcattgttgatcctggtgattctgacatcatcaagaccatacccggagatcaatagagttgttgtatcgggtcctcgattttggtccttttctaaacaaaactgtggctgtttcatgtttgtttgtttttgcttatcaaaatttatgtggacctccggaagtatttcgatatttgagtaatatgataagtcgacttcaattttttcttcaaaatagtttaatgatttatataattttgca

SEQ ID NO: 1158 - DNA, 613 bp, Cajanus cajan
gggatgcatcatctttttcttctctctgattgtgccgctacttgcatttcattgcgtaacaatggttgcagctaaaaaaactaagaagacccatgagagcatcaacaacaggctcgctcttgtcatgaagagcggcaaatacacccttggatacaagaccgttctcaaatctcttaggagctccaaagggaaactcattatcattgccaacaactgtccccctttgaggaagtcagagatagagtattatgctatgttggctaaggttggagttcatcattataatgggaacaatgtggatttgggcactgcatgcggcaaatattacagagtgtgctgcctcagcattattgatcctggtgattcagatatcattaagacactgcccggggaacagtgaagtagcgtcggaagttctttgcttaatattttttgtttttagttgactcagacatttgaaagaaaatctgattgagttgtaaactttggagtaaggtggcatgtttttttgtgtactctagctaagcatcaagtaattttgactttgcaaattcttcatgatgttttattgtgccaatttctatagagaatatatttttattattgattgttc

SEQ ID NO: 1159 - DNA, 694 bp, Cajanus cajan
gcagagtacggggatgcatcatctttttcttctctctgattgtgccgctacttgcatttcattgcgtaacaatggttgcagctaaaaaaactaagaagacccatgagagcatcaacaacaggctcgctcttgtcatgaagagcggcaaatacacccttggatacaagaccgttctcaaatctcttaggagctccaaagggaaactcattatcattgccaacaactgtccccctttgaggaagtcagagatagagtattatgctatgttggctaaggttggagttcatcattataatgggaacaatgtggatttgggcactgcatgcggcaaatattacagagtgtgctgcctcagcattattgatccgggtgattcagatatcattaagacactgcctggggagcagtaaagtagtgttggaagttccttgcttgatatttattgtttttagtttattcagacattgtggaaagaaaaatctgattgagttgtaaactttggtgtaaggcttttgatttttgggtattctagttgagtatcagtaattttgacgttgcaagtttttcatgatgttccattgtgccaatttctatagcgatgatataattatattgatctccagaatgtatttcagcgcagacaaaaaaaataaatcatatctggaagtagattctattttgtatggagtaaaga

SEQ ID NO: 1160 - DNA, 515 bp, Cucumis sativus
ggccgttcagttggcgagtacagcttcgaatcttcaatcatggtggccgcaaagaagacgaagaagacccatgagagcatcaacaacagactcgctctcgtcatgaagagtgggaaatacaccttgggatacaaaaccgtcctcaagaccttgaggagctctaaaggtaagctgatcatcattgccaacaactgccctccactccgaaagtccgagattgagtactatgcaatgttggccaaggttggagttcaccattacaacggaagcaatgttgaccttggaaccgcatgtggcaaatactacagagtatgctgcctcagcattatcgatcccggtgattcggatattatcaagagcatgcccgaaagttaggttgcaacttctttttaagatcatagaattttgtttcagagtttcttcttggttttgggttgaacgtagtgatgtgtttttgcttgtgaggcatgatattattgaacaaatggtttcattataaacccttttttatgttc

SEQ ID NO: 1161 - DNA, 848 bp, Amborella trichopoda
ttagggtttaaagtgaggaagggctattttgcaggctcgtcatctcttcctccgggggcagaaaaccctagtttcagaaaaccctaatttcagaagaaactcaggaactcaaacatttcagcagccatggttactgccaagaagacaaaaaagacacaagaaagtatcaacaacagactggctctcgtgatgaagagtgggaagtacacattgggttacaaaaccgtcctcagatctctgaggagctctaaagggaaattgataattattgcaaacaactgcccaccacttcggaagtctgagatcgagtactatgctatgcttgcaaaagttggagttcaccatttcaatgggaacaatgtagatcttggaactgcttgtggcaagtatttccgagtgtgctgtctcagtattacagatccaggtgattctgacattattaaaagcatacctggggatcagtgatattaagggagagggtccaatgttattttaggaaggttttgttagaaattttctctgaaattctgtcttccttttccatgtagaccttctgatcggttaaaactgatgattctcacccttgtctttgttttatcattgattctgattacgatttgcttgtatttgaattgtgaaatcatgaggtaagtagaaatcgtggcattttggacactttaaaaatggaatcttattcattcacttgtagctagtggtataagaaaattgtgccttcctaggaaacctgttttaaggctcttgatcaatggctccataaataaccctgcctgcaatccaattgtgggaaggctgcatgtatatccgactttttggataagaaagatttt

SEQ ID NO: 1162 - DNA, 884 bp, Musa acuminata
ggcttcttcgcggccgccagttcgtgagaggagatcgttccttcgcctccgcatcaccagcggcgcacgcctgcgcacgtctgcgcacggatctccttcagcaatggcgcctgtcaagaaggcgaagaagagcactgagagcatcaacaacaggctcgcgctcgtgatgaagagcgggaagtacacactcggctacaagactgtcctcaggtcccttcggagctctaaagcaaagttggttatgattgcaaataactgccctccacttcgcaagtctgaaattgagtattatgcaatgttggcgaaggttggagtacatcattttagtggaagtaatgttgatcttggaactgcatgtggcaaatatttccgtgtttgctgtctcagcattatcgatcctggtgactcggacatcatcaagagcatgcccggggaacagtgatagaagtgagtggatattggtatacatatgtccgtcagggttcaatatggttaatcatgcacttatcttggcaggcaattccgactgttttgattgttctaacgctggtttcaaattgttgctagattcgaccattagttgagatttcttgtcatctttctcaaacagtattagttagttgccaacttgaatgtggtatcaaaactgaggtcctggtgagatctttctagttctgatggctttttcgactgtttcaagtcatctgattcaatatacttaagctactgttgtggtttattactccatgcatctgctctcttctaacttaatttgacaattgcagctaaattagtcatgtatacagcttttagattctcaccctctttctatattttatcattagttttatagttttcatgatatgtttcttcaccaaacaaag

SEQ ID NO: 1163 - DNA, 786 bp, Fagus grandifolia
gtgggggggcgtatagtagagctgaagccaaacagatcctaaataaagcccttgaaaccctagcctgtataaacgaggtcattggctttacttcgccgtcttggaacgcttgggctctctctctgtgtttgtgctgtgcattactgcatcgacaatctcattcgcaaagcacccaaacgcaatctcaaccatggtggccgcaaagaagactaagaagactcatgagagcatcaacaacaggcttgccctcgtcatgaagagtggcaagtacaccttgggatacaaaaccgtcctcaaaaccctcaggaactccaaagggaagctggtgatcattgccaacaattgcccaccgctgcgtaagtctgagattgagtactatgctatgttggcgaaggttggagttcaccactacaacgggaacaatgttgatttggggactgcctgtggaaaatattacagagtgtgctgtctcagtattattgatcctggtgattctgatatcatcaagagcattcctggtgaacattaagctatgaattgtaggcctagattttggtggtttttatcctggttctttgaattgagaggctgaatattttgcttcaatgcaagcttttatgttgttaactgtgataatttctttagaaactaagctgctttgatggtatttttggtagtgttgtgttgggacctaatattttatattctaggatgtattcgaatcaaatatatgaaagacttggattctttaatttatctactcattctttatttctcatagaagct

SEQ ID NO: 1164 - DNA, 920 bp, Cannabis sativa
cttaaactggtttgttgttatccacgactggggatagttatatcctagaagccaaacacacaataatagcctcaaaaccctaatcttcttctctttataaagattcatcgactcatcttctgtggtttcttcgctgtgtatttttcgccgctgcacacattttcctcaacgaagcacccaaccatggtggccgccaagaagaccaagaagactcatgagagcatcaacaacaggcttgctctcgtcatgaagagtggcaagtacaccttgggctacaaaacagtcctcaaatctctcaggaactccaaagggaagctaattatcattgctaacaattgccctcctctaaggaagtctgagattgaatattatgctatgttggctaaggttggagttcatcactacaacgggaacaacgtagacttgggaactgcatgtggaaaatactacagagtatgctgccttagcattattgacccaggtgattcggatatcattaaaaacatgcctggtgaacattaagtagcccgtatgatctgtaacaggtcttagattttggtcggtctttttttgtttattttacattttgtttttgggtttggaggtgaggaatagcactagaggtggtggcgaactttcaatgttctaagttttaactaggaaaacaatactaaagatgttgaaggctgcctgcatttatggttcttcttgattgctttattgtgacttatattttgtcttgaaggatgtcctgtaaccaaatttccttttatcactttggattttaaatttatgggaatgcctatttgcaaactgtttaatttattatagttccccttgtatgataataccacgagtagaagtactatgatgtttacatcaaaatactatacttgagaaattaagatgatttttttaaa

SEQ ID NO: 1165 - DNA, 825 bp, Cannabis sativa
taatcttcttctctttataaagattcatcgactcatcttctgtggtttcttcgctgtgtatttttcgccgctgcacacattttcctcaacgaagcacccaaacatggtggccgccaagaagaccaagaagactcatgagagcatcaacaacaggcttgctctcgtcatgaagagtggcaagtacacattgggctacaaaacagtcctcaaatctctcaggaactccaaagggaagctaattatcattgctaacaactgccctcctctaaggaagtctgagattgaatattatgccatgttggctaaggttggagttcatcactacaacgggaacaacgtagacttgggaactgcatgtggaaaatactacagagtatgctgccttagcattattgatccaggtgattcggatatcattaaaaacatgcctggtgaacattaagtagcccgtatgatctgtaacaggtcttagattttggtcggtctttttttgtttattttacattttgtttttgggtttggaggtgaggaatagcactagaggtggtggcgaactttcaatgttctaagttttaactaggaaaacaatactaaagatgttgaaggctgcctgcatttatggttcttcttgattgctttattgtgacttatattttgtcttgaaggatgtcttgtaaccaaatttccttttatcactttggattttaaatttatgggaatgcctatttgcaaactgtttaatttattatagttccccttgtatgataataccacgagtagaagtactatgatgtttacatcaaaatactatacttgagaaattaa

SEQ ID NO: 1166 - DNA, 632 bp, Cicer arietinum
gagggcttgcgcactcaactcatcaacaatggttgccgctaagaagaccaagaagactcatgagagcattaacaacaggctcgctcttgttatgaagagtggcaaatttaccctcggttataaaaccgttctcaaatccttgaggagctccaaagggaaattgattatcattgccaacaactgtcctcctttgaggaagtctgaaatcgaatactatgctatgttggcaaaggttggagttcatcattacaatgggaacaatgttgacttgggcactgcctgtggaaaatattacagagtgtgctgcctcagcattattgatcctggtgattcggacatcattaagtcaattcctggagaccagtaaaagtaggaaagattttctgtttgatgttttctattctcagttgtttagacattgatgaaagaaattctactggtgtactatgctttgtatttgggtatcccagctgatccagcattgagtaattttgattgcaatttttgtttaatttcgatgattgctataaagttaatacttctagtttgttatttaatgccattgtgttacctgtttatgcttgtgttaacatgcaaatgattggtgatattgaatgtctggcaaccccgac

SEQ ID NO: 1167 - DNA, 624 bp, Medicago truncatula
acgcggggagggcttcttgttcaatttcacaaatcttcgcataccctaacttcaaccatggttgctgcaaagaaaaccaagaagacccatgagtctattaacaacagactcgctcttgtgatgaagagtgggaagtatactttggggtacaaaactgttctcaaatctctcaggaacaacaaagggaaattgattatcattgctaacaattgcccaccattgaggaagtccgagattgagtactatgctatgttggcgaaggttggagttcatcactacaacgggaacaatgtggatcttggtactgcttgcggaaaatactacagagtgtgctgtctcagcattgttgatcctggtgattctgatatcatcaagaccatacctggagaccaatagagttgttgtatcgaatcctcgattttggtcctttttgaaacaaaactggctgttttctgtttgtttttctttgcttatcaaaatttatgtgtacttctggaagtatttggatattcgagtattatgataagtcgactgcgattttttcttcaaaatagtttaatgatctacataattttgcaagtttatgttattttattttacaagaatcaatgccattgtgttagc

SEQ ID NO: 1168 - DNA, 724 bp, Elaeis guineensis
gtgccgacgaaggtcaagggttttgcatcgccttgctttcatcctcggagcatcaacaatggcgcccccgaagaaggcgaagaagagtgctgagagcataaacaaccggcttgctctcgttatgaagagcgggaagtataccctcgggtataagacggttctaagatcccttcggaattctaaagggaagctgatacttattgcaaacaattgccctcctctccgcaagtctgaaattgagtattatgcaatgttggctaaggttggcgtacatcattttaatgggaataatgtggacctcggaacagcttgcggcaagtatttccgtgtaagctgccttagcatcattgatcctggtgactccgacatcatcaagagtatcccaggtgaccagtgagagaatggagagaaatgtaggttgtacttgtgatttagggattaaatgtggtcaatcagtcaagtgcttgcttggcctagggttgttaccaactataattagctgtgtggattttgatttcaaattggtgcgagataactgagctagattcatcattttgtttggacattttgtcacattttattgtgaagggagactgattcttttgccccaggtgagatgttttatattttttatggattgtgaagccatattctaattacattttgggtaaattatgtttataatcccggactaatgcattctttcttaaatggtcattgaact

SEQ ID NO: 1169 - DNA, 790 bp, Allium cepa
ccgggtacttcgtttcaatggcgcccatcaagaaaacaaagaagacgacagagagtattaacaataggttggctctcgttatgaagagtggaaaatacaccctaggattcaagactgtgctcaggtcgcttagaaattctaaaggtaaattgattatcatagcgaacaactgccctcctcttcgaaggtccttgatagagtattatgctatgttggccaaggttggagttcaccatttcaatggaaataatgttgatctaggaactgcctgcggaaagtactttcgagtctgttgccttagcattatcgatccaggcgattctgacattatcaagacactacctggtgatcagtgaaaagcgagatgcatccatggttttttgtttggaaattttccgtgctgtttgattcgtacactgttttgtttattatctatgtaaccgaactttaaatttaccagaggaatatattgcttggcgttttgaaaaaatatactgcttggcattttgagaaatgagcatcttgtttgtttaaatctatccgaacaagctgttggcgttggacgtgcgagtgcccaacgcaatggtgcaatgagcatttggatcaatcgctatagattaatcaatggctttctgcggtggtgtgtccttgaaccttccactgttgttgttttggtcctttccaatttacatagaatcttagaactccattttgtaattggaggaattcttcagcaaccatgcttttagaccctgtaattagatgtatgctttcaacaattacttattta

SEQ ID NO: 1170 - DNA, 627 bp, Acacia harpophylla
gagcgtcactctgcgcctctagccgctagttttccgcatcagctctctctgctctccccggtagaattccaccatggttgctgccaagaagacgaagaagacccatgagagcattaacaacaggctcgctcttgtcatgaagagcgggaagtataccctgggttacaagacggtcctcaaatccctcaggaattctaaaggaaaacttattatcattgccaacaattgtccacctctgagaaagtcagaaattgagtactatgccatgttggcaaaagttggagttcaccattacaatggaaacaacgtggatttgggaactgcatgcggcaaatacttcagagtgtgctgcctcagcattattgatcccggtgattcggacattattaagacgatgcccagtgagcagtaagtgatggctgtttttgttgggtgcgggtactaaagttgagtgctagtcaagagtagaattttccgagtttttatgtattaattttgtttacatattgaattctcgttggtccgatacactgctatatatggcatcgaagtgactctttttagcaggttgaatttgtggtttcagctccttttttcttctggctaaatgatattgcgtaatttgaa

SEQ ID NO: 1171 - DNA, 1045 bp, Amborella trichopoda
atgcctcaagattgaatagaggctgttaaattttggaagagctatatccaagtgttacaaaattcacaattcaaaattttctttttaaaataatcatcttataattctgttcccacaattttagaccagaaacaattcctaaataggtgtttcgagtgacagagtagatgcactgtctgcacccccgggagtacagtataagcgctcatctacttcatttatgaccgcgttatcgatgtataagatacctaggtttttaaaacttgggttggataatttatccatcttgccctaattttctcttcttgcctagaagttgcagagagggatcagtgaaaatggtgaacaccaagaaaacgaagaagacccatgagtccattaataataggttggctctggttatgaagagtgggaagtacactcttggttacaagactgtacttaaatctatgaggaactccaaagggaagctgataattattgcaaataattgtcctcccctgaggaagtccgagattgagtactatgccatgctttgcaaggttggggtgcatcattttaatggaaacaacgtggatttggggacggcatgtggaaagtattaccgcgtttcgtgtcttagcatcacagatccaggggattctgatatcatcaaaactctgcctggggatctgtaagttgggctcgatgctggagaaattttggagaaggattgtatattttatttagtgatgttgatgaagaacatataaaagttagtttgagatggcttaggtgctgggcatatcttggatttcaccaaaaaatttggatggtggttatggaaaattatgttagtttgtttgcatcaatgtggaagatatatattttgtaaactatgttatgacctttgtttcttttatgggttgaattggttttagtgagaaatgcagagctggtcttggatctttagcagtggttaccacataaaaggatagtggtaattccttggaattcttatagtatatgactgcttatctttcagataaggtgaaaattaccccaa

SEQ ID NO: 1172 - DNA, 618 bp, Amborella trichopoda
  misc_feature (88)..(88): n is a, c, g, or t
  misc_feature (93)..(93): n is a, c, g, or t
  misc_feature (99)..(99): n is a, c, g, or t
ggaagttaatgtatagggttttgtttgtaattttcgtagtttggttggataatttatccatcctgccctaagattcttttcaagcctngaagntgcagngagggatcagtgaaaatggtgaacaccaagaaaacgaagaagacccatgagtccattaataataggttggctctggttatgaagagtgggaagtacactcttggttacaagactgtacttaaatctatgagaaactccaaagggaagctgataattattgcaaataattgtcctcccctgaggaagtccgagattgagtactatgccatgctttgcaaggttggggtgcatcattttaatggaaacaacgtggatttggggacagcatgtggaaagtattaccgcgtttcgtgtcttagcatcacagatccaggggattctgatatcatcaaaactctgcctggggatctgtaagttgggctcgatgctggagaaattttggagaaggattgtatattttatttagtgatgttgatgaagaacatataaaagttagtttgagatggcttaggtgctgggcatatcttggatttcaccaaaaaatttggatggtggttatggaaaattatgttagtttgt

SEQ ID NO: 1173 - DNA, 1035 bp, Amorphophallus konjac
gggtttcggtgtgtgcccacgccgccgccacgatggtttcgacgaagaagacgaagaagacccatgagagcatcaacaaccggctcgcgctggtgatgaagagcggcaagtacaccctcgggtacaagaccgtcctcaggacactgaggagctccaaagcgaaactgataatcatttcaaacaattgccctcctctccgtaagtcagagatcgagtactatgcaatgttggcaaaagttggagtccatcactttaatgggaacaatgtagatttgggaacagcatgtggaaaatacttccgagtctgttgtcttagcattattgatccaggtgactctgacatcattaagagccttccaggggatcagtgatgagtgtttttgttgctgaggtgtcaagagtaaatgacttcattttccccaatcttagctgatacctctaagagttaaggatgagttcatttagcaggattagtgaacttatatcaattttcaatttatagatatgtagctgtttctttgatgctcctttgcgtatcttctccctccactatcgagaagaaaatctggtgtattgctaaagaaattttctcatgcttagaacattggcaaggggtagtgtgtgtggattactggacctgtagacgtttcagttgatgttccgtggcttgtgcaagttgagtcaggcctatgctttggccctctggttggatccgtatccatggcaagcttactgcactacttccggcgatttatacttttgtgcaatcagtaattcagtttctgaagaccctgtgtcattcctatggttttccccttgttctctctgttggatttttttttgctgttacgaatatccggtgacttgttggccggtcttcatctttcatcgatgcagtttcttccatcgcagacatccctgttggcctacttagctaagcacatggaagtgaacatctggccaccatctttaggtgctgtccccgatcaattccctttctcgttgatttctaccgtgttttgcaagtagcaacct

SEQ ID NO: 1174 - DNA, 345 bp, Aquilegia formosa
atggtggccgccaagaaaaccaagaagactcatgagagcattaacaacagactcgctcttgtgatgaagagtgggaagtacactcttgggtacaaaactgttcttgattcactcagaagctcgaaaggaaaattgatcattattgctaacaattgccctcctttgaggaaatctgagatcgagtactatgctatgcttgcaaaggttggagtccaccatttcaatggaaacaacgttgatttggggacagcttgtggtaaatatttccgagtgtcatgcctcagcattattgatcctggtgattctgatatcatcaaaacactgcctggtgaccattaagaggag

SEQ ID NO: 1175 - DNA, 1013 bp, Aristolochia fimbriata
tgttcttcgcagttaataaggcagtcgtcgtgaaggattgacagctctgttagtcagctagggttttggagagggagagcggaactacaagttggaggaatagcagccatggtgaccgcgaagaagacgaagaagactcatgagagtatcaacaacagactcgctctcgtgatcaagagcgggaagtatacactgggttataagaccgtcctcaagtccctgaggagctctaaaggaaagttgataattattgccaacaactgtcctccccttaggaagtcagagattgaataccatgctatgttggcaaagtgtggagtacatcatttcaatggaaacaatgtggatctgggaactgcttgtggtaaatattaccgggtctgctgccttagcattattgatccaggtgattcggatattatcaagagtctccctggcgaccagtgactgaagcaatagacctcatctgttgtcttttgaagttttatgtgcgctgcaataggattagtcttctgatgaaagttaatgtaaagccacagggactgatgcccttttccaatcagttttacaaagtcaccctaaagcccccaagaaacatgttctagagaatcgtggttatggttgttgctgaatatgaattaaaaagaggcgatcccctttagcaccaagaatctagacatagtcccatggtgacgcaaataagaaattttgagtttgacggaaccagcagaattacagctgcgagatttttcttcaatatgtgtaatttaatgtcctcttgtccctgaatatctggcctgtgagtcttgctcgcttcgtcctaccttatgctgataggtatttccagatttgattggttttcattttgggattgaatgataggtatttccagatttggatcaagtgaatgtagccatcggctaccattttccagattgaatccttggaatagaagatattaggacatcagaaaagacgaaacagtgaagtagtttataaaagctaaaattaag

SEQ ID NO: 1176 - DNA, 743 bp, Musa acuminata
gcggccgccagttcgtgagaggagatcgttccttcgcctccgcatcaccagcggcgcacgcctgcgcacggatctccttcagcaatggcgcctgtcaagaaggcgaagaagagcactgagagcatcaacaacaggctcgcgctcgtgatgaagagcgggaagtacacactcggctacaagactgtcctcaggtcccttcggagctctaaagcaaagttggttatgattgcaaataactgccctccacttcgcaagtctgaaattgagtattatgcaatgttggcgaaggttggagtacatcattttagtggaagtaatgttgatcttggaactgcatgtggcaaatatttccgtgtttgctgtctcagcattatcgatcctggtgactcggacatcatcaagagcatgcccggggaacagtgatagaagtgagtggatattggtttacatatgtccatcagggttcaatatggttaatcatgcacttatcttggcaggcaattcctactgttttgattgttctaacgctggtttcaaattgttgctagattcgaccattagttgagatttcttgtcatctttctcaaacagtattagttagttgccaacttgaatgtggtatcaaaactgaggtcctggtgagatctttctagttctgatggctttttcgactgtttcaagtcatctgattcaatatacttaagctactattgtggtttattatttcaccatgcatctgctct

SEQ ID NO: 1177 - DNA, 670 bp, Manihot esculenta
agggtttcttcgctgtggtgagggtaacgtattagcttttgcggattatctcgtcgaaaggacacgaccggtaaccatggtggccgccaagaagaccaagaagactcatgagagtatcaacaacaggctggctctggttatgaagagtgggaagtacaccttgggttacaagactgtactcaaatctctcaggaattccaaagggaagctgatcatcattgctaacaactgtcctccccttaggaagtctgagatagagtactatgcaatgttggcaaaagttggagttcaccactacaatggcaacaacgtagacttgggtactgcctgtggaaaatattacagagtatgctgcctcagcattgttgatccaggtgattccgatatcattaagagcatgcctggtgaccattagtccaggaggaaattccctctagtattttatcaattttctccttgctgggttggttgggctgtgggttttcagttgcaaactatgatacttgttgacaagaacaattttgtgtggaacttgtgaagctcctattggtagcccttttagtagttttcatttaatctgaaattattacctagatgaaatttcttgctggatgttgaccttatacgagttctttcctgaaatggcgcaattttatattaccattttaca

SEQ ID NO: 1178 - DNA, 914 bp, Ricinus communis
cctaacaaaaccctaaattgggtggcctttataaatgcgcatcatttggcagttttagggtttctttcgcagtagtgagtgaacattttgagcttctctggtttccctcgagtcggcagcaaccatggtggtcgccaagaagacaaagaagactcatgagagtatcaacaacaggctggctttggttatgaagagtgggaaatacacattgggttacaagactgttctcaaatctcttaggagttctaaagggaagctcgttatcattgctaacaactgccctcctcttagaaagtctgagatagagtactatgcaatgttggcaaaggttggagttcaccactacaacggcaacaatgtggacttgggtactgcctgtggaaaatattacagagtgtgctgcctcagcattattgatccaggtgattctgatatcattaagagcatgcctggtgaacattgattaggctatgaggaatagcatgtctctgtagctcttgatcattgttatcgtggatttcatgatatttgtcaaacaggaacaaatttttgtgtgcaacttttgatcttctatggtagccttttagtgattttgaaaatggcttaaatgaattgtgtgtactagaatgttcaatcaaatttcgtttgagcaatttttgtttaacagagctgttctatttaattgctatcctatttgcatctgctgttgtgagagtacgatttggatcgcagcaaaatgggcttttttttggatatttttgagtcttgtaagattatttaaaatttctgggatttgacgagaacccaagagaaattgaattgtaagattttttttttttttttttttaactcgataaaaaaattgagattattaatcttgcatgaaagccaaataggacagagtgtattaatct

SEQ ID NO: 1179 - DNA, 706 bp, Castanea mollissima
cttcattctgccctagagttccttcgccgtattggaagcaaacctctctctctcgctctctgtgctctgcagctgcaacactctcatcctcacaccaaccaaaacccaaaccccaaccatggtggccgccaagaagaccaagaagacccatgagagtatcaacaacaggcttgccctcgtcatgaagagtggcaagtacaccttgggttacaagaccgtcctcaaatccctcaggaattccaaaggtaagctgatcatcattgccaacaactgcccacccctgcgtaagtctgagattgagtactatgctatgttggcgaaggttggagttcaccactacaacggaaacaatgttgacttggggactgcctgtggaaaatattacagagtgtgctgcctcagtataattgatcctggtgattctgatatcatcaagagcatgcccggtgaccattaagctgcgcattgtagaagttctagattttggtggcatttatcttgttctttggattgagaggctgaatgttttgcttcaaggcaggcttttatgttgtttaactggaatgatttcgatagaactaagctgctttgatggtatttttggtagtattgtgttgagacctaatattttatattctaggctgtattcgaaccaaattatatcacaaagacgtgggtctttaatttatttcctgttgcttatttt

SEQ ID NO: 1180 - DNA, 612 bp, Cicer arietinum
gatcgttcttcatttcacatcactcgccgccgagggcttgcgcactcaactcatcaacaatggttgccgctaagaagaccaagaagactcatgagagcattaacaacaggctcgctcttgttatgaagagtggcaaatttaccctcggttataaaaccgttctcaaatccttgaggagctccaaagggaaattgattatcattgccaacaactgtcctcctttgaggaagtctgaaatcgaatactatgctatgttggcaaaggttggagttcatcattacaatgggaacaatgttgacttgggcactgcctgtggaaaatattacagagtgtgctgcctcagcattattgatcctggtgattcggacatcattaagtcaattcctggagaccagtaaaagtaggaaagattttctgtttgatgttttctattctcagttgtttagacattgatgaaagaaattctactggtgtactatgctttgtatttgggtatcccagctgatccagcattgagtaattttgattgcaatttttgtttaatttcgatgattgctataaagttaatacttctagtttgttatttaatgccattgtgttacctgttaaaaa

SEQ ID NO: 1181 - DNA, 712 bp, Cryptomeria japonica
gatcccactcatacggctcctgttctccataacccaacaatggcgataaccaagaagacgaagaagactcatgagaacatcaacagcaggcttgccctggtgatgaagagtggcaagtacactctgggctgcaagaccgtcctgcattctctcaggtcttcaaaaggaaaacttattatcatttctaacaattgccctcctttacaaaagtcagaaattgagtattatgccatgcttgcgaaaattggagtgcatcatttccacggaaacaatgttgatttgggaactgcatgtggcaaatattttcgtgtgagctgtcttagcataacagatccaggcgactcagacattattaaggcagccccttctgctccgtgagaatctcattaatgttgaaaagtaggaatggctatgattgtttgtttttggtaatttaatcttaaaattaaaatgcaaaaagactgttgcagaagtcaccggtctgaccagaagcaattccagtttgttgacgatgttggattttttttttgtcaggttgtgtttaggtgagaattaattttaaaatttgtacagttcaattgttagtacatatttctagtacttggcagaggcattgaatttacacctcgaggtttgattttttatgattcaattgagctttgtatgcagtaatttacatcatgtgtgttaagcaggcttaaaattttggtct

SEQ ID NO: 1182 - DNA, 689 bp, Cucumis sativus
gccaccccttgtcgtgaaaaaagctagaaggtattcctacaccttttgagtagcaacgatggcgccggcgaagaagaccaagaagactcacgagagcattaacaacaggctggcccttgtcatgaagagcggcaagtacacactcggttacaaaaccgttcttcgtactatcagaggttccaaagggaagcttattattctatcgaacaactgcccacctctgcgtaaatccgagattgagtactacgcaatgcttgccaaaataggagttcaccactacaacggaagtaatgttgatcttggaactgcttgtggcaagtattaccgtgtctcctgccttagcattatcgatccaggtgattctgatattatcaaatcgcttcccggtgatcagtgatttttgtgtcattgagaacgttagtttatttattttcttttgcaccttttcttttcagcaaaggtaaaagttgcactgattttaaagtccccagagtagctaccaactttaagcattaaaattgtattgttgataaccagattttgtcaatgtctttgaggttttatgtagaatgctcaagtagttttatacctatttatgcataaacaattgagaatccaaaatctccttttgccttccaattacaagattgttttagttcgaaaatgagtaggaattcatcatttgatcc

SEQ ID NO: 1183 - DNA, 513 bp, Cucurbita pepo
cgtgttgagcagcagcagctctaatcttccatcatggtggccgcaaagaagacgaagaagacccatgagagcatcaacaacagactcgctctcgtcatgaagagtgggaaatataccttgggatacaaaactgtcctcaagaccttgaggaactctaaaggtaagcttatcatcattgccaacaactgccctccactccgaaagtctgagatcgaatattatgcaatgttggcaaaggttggagttcaccattacaatggaagcaacgtagaccttggaaccgcttgtggcaaatactacagagtatgctgcctaagcattatcgatcctggcgattcggatatcatcaagagcctgcccggagaaagttaggtttcagatcatagatttttgtttcagagtttcattttaatccacttgattttgggttgggcgtagcaatattttgaacgaatggtttcattataaaactcttttatgtatgagaatgcattaatgttcttggtttgtatt

SEQ ID NO: 1184 - DNA, 552 bp, Distylium racemosum
cgcgtagcataatagaataggttagaaatctccaggcggctgtggacggtgatttctgcgtccaggcaacatggtggccaccaagaagaccaagaaggctcatgagagcatcaacaacagattggcccttgtcatgaagagtggcaagtataccctaggttacaagactaccctcaagtctatcaggaccaacaaaggaaagcttgttataattgcaaataactgtcctcctcttcgcaggtcagaaatagaatattatgccatgcttgcaaagatcggggtacatcacttcaatggaaacaatgttgacctagggacagcatgtggcaagtattatcgggtgtgctgtctcagcattacagatccaggtgattctgatatcattaagacagtgccatcagatcagtgagtgcatgcttaggtttagtttgaccaggaacttgttaattttcgaatgtgtcccgatttggggcaagcactcgggaattacttcctaaatttttaagagaagagttatgttcagttttaattttagactcataaatggtaacc

SEQ ID NO: 1185 - DNA, 830 bp, Eucalyptus grandis
caccattcaaaaccctaattccttcgccttataagcaccctcttctcttcctcgttcgaagcttttgcctgcggtggactggactcggtgcttcagcctcaacctccgatcgaagccctaagcgttcaaccatggtggccgcgaagaagaccaagaagactcatgagagcatcaacaacaggctcgctctcgtcatgaagagcgggaagtacacgttggggtacaagaccgtcctcaagaccctgaggaactccaaaggtaagctggtcatcattgctaacaattgccctcctctccgaaagtccgagatagagtactatgctatgttggcaaaggttggagtgcatcactacaacggaaacaacgtagacctaggcactgcctgcggaaaatactatagggtatgctgccttagcattattgacccaggtgactctgacatcatcaagagcatgcccggcggcgatcattaagattttggaacgcttagatgtcactttagatttttcatttctttactggctcagctgggcatcgtgtttcatttattcagatgagcttttatgttgattcgagaagtttgattgcgaaaccaaagaagctttttgtagcccttttatgtgttggatgttggattacgtctaaacaagtttttgcggacgaacagattgagcttttatcattatcatccaagagttccgtatcggccatgtcctttttattgatccaaggaagctgctgtcatcgagtaattgtcccatgctgggcctggtcaagttaaggtgtattcttgtatcgataatcttaattcggtaagggcatttaatgcc

SEQ ID NO: 1186 - DNA, 609 bp, Zingiber officinale
  misc_feature (5)..(5): n is a, c, g, or t
  misc_feature (8)..(9): n is a, c, g, or t
  misc_feature (554)..(554): n is a, c, g, or t
  misc_feature (556)..(559): n is a, c, g, or t
gcacnagnngcgcctcgcttgctttcgtcgcatccccttcgtttctcatggcgcccgtcaagaagacgaagaagaatgcggagagcattaacagtcgattggctctcgtgatgaagagcggcaagtacactctcggctacaagacggttctcaaatctctccgcggctctaaagggaaattgatcataatttctaataactgccccccacttcgcaagtcagaaattgagtactatgcaatgttggcaaaggttggggttcaccattttaatgggaataacgttgatctcggaacagcatgcggcaaatacttccgggtgtgctgcctcagcattattgatcctggtgattccgacatcatcaagagcatccctggcgagcaatgagagaaatgaaatgatgccattcctcacgaggattttatacctttgcccatctgtatcccatccccttgcccttcttttcatttatgatctagttttaactctgaagcattacaagatattgcagctgtttccttatgatttgcttttgttaaacatttgccctgctanannnnagcatcagaacccaactcatgttagttatttctctgctttcaatccaaaa

SEQ ID NO: 1187 - DNA, 431 bp, Humulus lupulus
gtttcttcgctgtgtattcatcgccgctgcagagattttcctcaacgaagcacccaaccatggttgccgccaagaagaccaagaagactcatgagagcatcaacaacaggcttgctctcgtcatgaagagtggcaagtacaccttgggctacaaaacagtcctcaaatctctcaggaactccaaagggaagctaattattattgccaacaactgccctcctctaaggaaatctgagattgaatattatgccatgttggctaaggttggagttcatcactacaatgggaacaacgtagacttggggactgcatgtggaaaatactacagagtatgctgccttagcattattgatccaggtgattcggatatcattaagaacatgcctggtgaacattaagtagcccatatgatctgtaacaggtcttagatt

SEQ ID NO: 1188 - DNA, 621 bp, Humulus lupulus
ttaccagttcctcctggcttattccctcatattctctctctctccctcttaaccaacacatttttctctcattttttcttttcgaagctttcgtttagcaagaactggctaactctcaggaaattctggaggagagtggttctaggcggccgaaaggtttcttcgctgtgtattcatcgccgctgcagagattttcctcaacgaagcacccaaccatggttgccgccaagaagaccaagaagactcatgagagcatcaacaacaggcttgctctcgtcatgaagagtggcaagtacaccttgggctacaaaacagtcctcaaatctctcaggaactccaaagggaagctaattattattgccaacaactgccctcctctaaggaaatctgagattgaatattatgccatgttggctaaggttggagttcatcactacaatgggaacaacgtagacttggggactgcatgtggaaaatactacagagtatgctgccttagcattattgatccaggtgattcggatatcattaagaacatgcctggtgaacattaagtagcccatatgatctgtaacaggtcttagattttggtcgatctttttttgttgtttatttttccat

SEQ ID NO: 1189 - DNA, 659 bp, Momordica charantia
ggccgtttctctctctatatattctttgaaattagggtttctagtgttctttaaccattctcgtcggcgagctgcagctttctcatctcctcaacaatggtggccgccaagaagaccaagaagacccatgagagcatcaacaacaggctcgctctcgtcatgaagagtgggaaatatacattgggatacaaaaccgtcctgaagaccttgaggaactctaaaggtaagctgattatcattgccaacaactgccctccactccgaaagtccgagatcgagtattatgcgatgttggcaaaggttggagttcaccattacaatggaagcaatgtagaccttgggactgcttgtggcaaatactacagagtatgctgcctcagcattatcgatccaggtgattcggatatcatcaagagcattcctggagaaagttaggttgcaacttcctctcagatcatagatttttgttttgagtttctttttaatccacttgattttgggttggatgttagtgacgtttttgcttgtgaggcatgttattattgatcaaatggtttcattataaacttttttatgtatgagatcttattccagagaactttgatatcattattttgatgttccaattacctatgtcaattagaagcatgttgtcaacc

SEQ ID NO: 1190 - DNA, 1238 bp, Quercus alba
ccttcactctatcccagagttccctcgccgtattggaagcaaagctctctctctctgcgctctgcagcagcaactctctcatcctcaaaccaacccaaaccccaaccatggtggccgccaagaagaccaagaagacccatgagagtattaacaacaggcttgccctcgtgatgaagagtggcaagtacaccttgggttacaagaccgtcctcaaatccctcaggaattccaaagggaagctgatcatcattgccaacaactgccctcctctgcgtaagtctgagattgagtactatgctatgttggcgaaggttggagttcaccactacaacggaaacaatgttgatttggggactgcctgtggaaaatattacagagtgtgctgcctcagtataattgatcctggtgattctgatatcatcaagagcatgcccggcgaccattaagcaatgcattttagaagttttagattttggtggcatttatcttgttctttggattgagaggctgaatgttttgcttcaaggcaagcttttatgttgtttaactggaatgatttcgttagaactaagctgctttgatggtatttttggtagtattgtgttgagacctaatattttatattctaggctgtattggaaccaaattatatcacaaagacgtgggtctttaatttatttcctggcgtatatttttctcatgcatttctcattaaagcttccaaataaaggttaacaacttgttgcaagtcctcaatttgttgcgacgatgtggttgtttggattacctgtgtctgtagattcaatagatatgagcaactttgacgttgcacaaaaaaattgaatggtattggtctagatccgccaagtagatttatattcagtctgcatcttgagctctaatttcatatgccaggaaaagatccttaaagggaacataattttactgttctccatgctgggggcatcaactatcagtagaattatggaatgcagttactggacgatatgcaatttctaacgaaatggatcggcaaactgaaaaaggatgcacctcaaaaacgtgtttacaaaacaaaaacactaaaacatgttcgataatgaacaactaaaaacagtatttaaatcaagaaaactctcacaagtttttgaaagagtgcctttcgtattcaaaacgtttctcttacttcatttaccttcttggccactttcatattcttttggaagaaaactgtaccc

SEQ ID NO: 1191 - DNA, 1091 bp, Phalaenopsis aphrodite
ggagtcgatacgatacgatgtggattaaggcgtataaatcgtcgagtcgggtagttgaatgggcgattaaaagtgtccgaataaacggggcaggatagaaatgtgaggctcgggatagaaaagttgcgagctggccggatctgacgggttcaccgttcaaggctgcgaatcaaagctagaaagagccgagggactatcgtcggtcgtcaaggcaagaaagcgagcaacccgagggcgtttgtcgtggagatgtggcggcgagaaggttgttggtgatggcgagggagggaggtctcgcgatcaaaggaaggtcgaaagtcaacaacagcgcacgcccatggtccttggtcgacagaaaagagattcgaccaaaccctaaacccaacccattatcggcgtcccatctcgttagggtttttcgccgccagcaaagggatccaggttttctgaatctccttccccgtcacttggaacagcagccatgccgcccactaagaagacgaagaagagcaccgagagcatcaacaaccggcttgctcttgtgatgaagagcggaaagtacactctcggctacaaaactgttcttagatccctcaggaacaataaaggtaagttggtgatcatagcaaacaactgcccccctcttcgtaaatctgaaattgagtactatgcaatgttgggcaaggttggagtccaccattttaacggaaataatgttgatctgggaactgcttgtggcaaatatttccgggtgtgctgcctcagcatcattgatccaggtgattctgacatcatcaagagcatccctggtgaccaatgagcgtgccaaaagaattggtgaaggtgtattagaactttgtttaatatcatttttttaacttgccgacaaagtgacaatcttcatgcttccttaactgattactcaattcaatattcggaagcatgatttttttaaaattttattattttaataactccatacttaaaacatcatcatgttgactttttgaaagtaaggtatagggtttgatgaatacatatattgttcgttttgatgatcatgtatgatgaagaagttctaagattgacat

SEQ ID NO: 1192 - DNA, 572 bp, Lippia dulcis
tctcctcccatcgccgccgcatccgcattcaccaccgccgcacttcccagtctctacggtggtggctaccggaaaaaagacgaagaagactcatgagaacatcaacaacaggctggctcttgtgatgaagagtgggaaatacactcttggttacaaaactgtgctcaagactctcaggagttccaaaggtaaattgatattgatatccaacaactgcccaccgttgaggaagtctgagattgagtactatgcaatgcttgctaaaattggtgttcatcactacagtgggaacaacgttgatcttgggacggcatgtgggaagtacttccgtgtttcatgcctcagcatagttgacccaggtgactctgacatcatcaaaaatttgcccggagatcattgaatcattggaaccgcgctctcctctcttgtttgcttaagatccttagatgtttgaaattttgcacggatttgaaaatcgtggtggtcgaacagagttttgtttgagtttctactttttttggtaaggttggatgacctatataagaaatgacggtttctgaacttgattgtga

SEQ ID NO: 1193 - DNA, 570 bp, Cajanus cajan
ttttcttctctctgattgtgccgctacttgcatttcattgcgtaacaatggttgcaagctaaaaaaactaagaagacccatgagagcatcaacaacaggctcgctcctgtcatgaagagcggcaaatacacccttggatacaagaccgttctcaaatctcttaggagctccaaagggaaactcattatcattgccaacaactgcccccctttgaggaagtcagagatagagtattatgctatgttggctaaggttggagttcatcattataatgggaacaatgtggatttgggcactgcatgcggcaaatattacagagtgtgctgcctcagcattattgatcctggtgattcagatatcattaagacactgcccggggaacagtgaagtagcgtcggaagttctttgcttaatattttttgttttagttgactcagacatttgaaagaaaatctgattgagttgtaaactttggagtaaggtggcatttttttttgtgtactctagctaagcatcaagtaattttgactttgcaaattcttcatgatgtttatgtgccaatttctatag

SEQ ID NO: 1194 - DNA, 647 bp, Platanus occidentalis
tctcggtgtagcagtcatggtggccacgaagaagactaagaagactcatgaaagcatcaacaatcggctcgctctcgttatgaagagcgggaagtacaccctagggtacaagaccgttctcagatctctgcggaactccaaagggaagctaatcatcattgcaaacaactgccctcctcttagaaaatcagagattgagtattatgcaatgttagcgaaagttggagttcatcacttcaatgggaacaatgtggacttgggtactgcttgtggcaaatatttccgtgtctgctgcctcagcattattgatccaggtgattccgatatcattaagagcatgcctagtgatcactgagcagtcaaggagtggaataatctgtaactgtttctgcttagatattgtttttgatttttcctaattgacatcaggatttttcttctccctttgttttgacaatgcaagttttgatgggtgttagctcctgcaaaaactgttgctagagatagaaaagcagctaacgcttggtgtcctataattattgttactttggtgtgacaaaaccttttgggtcagcttgaagagtagtacttatttggctttactcggactgtcttagaactaggtagttaagcacaaatagaaattt

SEQ ID NO: 1195 - DNA, 801 bp, Platanus occidentalis
agcggaattttaattgttccaaccgggttcatcttaaggtgtggctataatcaaggctagggttgacaaaaaagcttggccctgtgggtacttggattcaagagaggggcggttgcgttagtgaagtgttttagattagattaccggtgaggactgcagcgaaggctagtgtttctttgccgccattggagattagggtttcgcagtcatctcggtatagcagccatggtggccacgaagaaaactaagaagactcatgagagcatcaataatcggctcgctctcgttatgaagagcgggaagtacacactaggctacaagactgttcttagatctctacggaactccaaagggaagctaatcatcattgcaaacaactgccctcctcttagaaaatcagagatagagtactatgcaatgttagccaaagttggagttcatcacttcaatgggaacaatgtggacttgggtactgcctgtggcaaatatttccgggtctgctgcctcagcattattgacccaggtgattctgatattattaagagcatgccaagtgatcaatgagcacaggagtggaattttctgtaactgtttctgcttagattttggctctatttctcttgatacactattctcttttgcggcagggttttccttttccccttcgttctggcaatgcaaattttgatgggtgttggcacttccaaaaatgttagaaatagaaaattattctagaaagactcttctgtttgtgtttaattggtaatggcggatactttggtgagacaattcccgtttgaa

SEQ ID NO: 1196 - DNA, 702 bp, Populus trichocarpa
aaatacacaaaccctacttccttctctctataactgccgccaagcttctggtgtttctttctgcttcagattctcaatcgcaataaaccctaaccaccgaaaactagccaaacaacatcgaaatggtgacggcaaagaaaactaagaagacccatgagagcatcaacaacagattggctttggtgatgaagagtggaaagtacactcttggttacaaaactgtgcttaaaactctgaggagctctaaaggaaaattgattttattatcaaacaattgcccacctttgaggaaatctgagattgagtattatgctatgcttgcgaaggttggggttcatcattataatggaaataatgtcgacttgggaactgcttgtggcaagtatttccgtgtatcttgcctgagcattattgatgcaggtgattctgatattatcaagacagtccctggtgatcattgagcagacttttcttctggttccgttattttacagcagaaatatgttttatttctttagattttccccatcttttttagaatattttggagtctataacactcatctttcatcccatccttcagttttggattttattcccatctgttgtgaactgctgtgtactgaagtggcaaattttgattcagttattgatacagcaagctttttattatgaagtattagttttctgaaactacccatc

SEQ ID NO: 1197 - DNA, 439 bp, Primula obconica
ctctctctctccgccgacagctcaaatcctctgcaatttcaacaatgccggccggcaagaagacgaagaagactcatgaaagcatcaacaacaggctcgctcttgtgatgaagagcgggaaatacaccctagggtacaaaactgtgttgaaaactctcaggagctccaaagggaagttgatcataatttcgaacaactgtcctcctttgaggaagtctgaaattgagtactacgcaatgcttgctaaagtcggggttcaccattatagtggaaacaatgttgatttgggaacagcttgcggaaagtatttccgtgtgtcatgccttagcattgttgatccaggtgattccgatatcatcaagactttgcccggagatcagtgacaaactatctccttccatgtcaatcctacatggattggatagcaattagcaattat

SEQ ID NO: 1198 - DNA, 669 bp, Primula obconica
ctctccgccgacagctcaaatcctctgcaatttcgacaatgccggccggcaagaagacgaagaagactcatgaaagcatcaacaacaggctcgctcttgtgatgaagagcgggaaatacaccctagggtacaaaactgtgttgaaaactctcaggagctccaaagggaagttgatcataatttcgaacaactgtcctcctttgaggaagtctgaaattgagtactacgcaatgcttgctaaagtcggggttcaccattatagtggaaacaatgttgatttgggaacagcttgcggaaagtatttccgtgtgtcatgccttagcattgttgatccaggtgattccgatatcatcaagactttgcccggagatcagtgacaaactatctccttccatgtcaatcctacatggattggatagcaattagcaattatcaattataaaatccagatttcctttctgtttgtcgttagtaaaaactacctccttccctctttgttcccaaacaagctctttcgagtttaatttgagagcatttttgtgtttgttggattcttcattccgcccataggtgggaatgctgtttttatcttctgtttaaagattcacaatttatgcttttgattgttcgttgaaaatttgacgtattgagtgctgctatgtgttgatg

SEQ ID NO: 1199 - DNA, 677 bp, Primula obconica
ctctctctccgccgacagctcaaatcctctgcaatttcaacaatgccggccggcaagaagacgaagaagactcatgaaagcatcaacaacaggctcgctcttgtgatgaagagcgggaaatacaccctagggtacaaaactgtgttgaaaactctcaggagctccaaagggaagttgatcataatttcgaacaactgtcctcctttgaggaagtctgaaattgagtactacgcaatgcttgctaaagtcggggttcaccattatagtggaaacaatgttgatttgggaacagcttgcggaaagtatttccgtgtgtcatgccttagcattgttgatccaggtgattccgatatcatcaagactttgcccggagatcagtgacaaactatctccttccatgtcaatcctacatggattggatagcaattagcaattatcaattataaaatccagatttcctttctgtttgtcgttagtaaaaactacctccttccctctttgttcccaaacaagctctttcgagtttaatttgagagcatttttgtgtttgttggattcttcattccgcccataggtgggaatgctgtttttatcttctgtttaaagattcacaatttatgcttttgattgttcgttgaaaatttgacgtattgagtgctgctatgtgttgatgggtg

SEQ ID NO: 1200 - DNA, 420 bp, Primula obconica
cacgagctcaattcctctgcaatttcaaccatgccggccggcaagaagacgaagaagactcatgaaagcatcaacaacaggctcgctcttgtgatgaagagcgggaaatacaccctagggtacaaaactgtgttgaaaactctcaggagctccaaagggaagttgatcataatttcgaacaactgtcctcctttgaggaagtctgaaattgagtactacgcaatgcttgctaaagtcggggttcaccattatagtggaaacaatgttgatttgggaacagcttgcggaaagtatttccgtgtgtcatgccttagcattgttgatccaaggtgattccgatatcatcaagactttgcccggagatcagtgacaaactatctccttccatgtcaatcctacatggattggatagcaattagc

SEQ ID NO: 1201 - DNA, 742 bp, Primula obconica
ccgacaatttcactcccatctccttctgcccacgtccaggtattggatgttttaaagtttaagaagtctaggggaagaaacgacgagatcgacatggcgttgaatatatcagcagacttacagtcgttgtttacatggaataccaaacaggtgtttgtgtttttagctgcggagtatgaaactccaaagaattctgtaaatcaggtatctttgtgggatgctattattcctacccccattacggccgaaactctctctccgccgacagctcaaatcctctgcaatttcaacaatgccggccggcaagaagacgaagaagactcatgaaagcatcaacaacaggctcgctcttgtgatgaagagcgggaaatacaccctagggtacaaaactgtgttgaaaactctcaggagctccaaagggaagttgatcataatttcgaacaactgtcctcctttgaggaagtctgaaattgagtactacgcaatgcttgctaaagtcggggttcaccattatagtggaaacaatgttgatttgggaacagcttgcggaaagtatttccgtgtgtcatgccttagcattgttgatccaggtgattccgatatcatcaagactttgcccggagatcagtgacaaactatctccttccatgtcaatcctacatggattggatagcaattagcaattatcaattataaaatccagattcctttctgtttgtcgttagtaaaactacctccttcc

SEQ ID NO: 1202 - DNA, 749 bp, Glycine max
gtagtggcagacgcagacgccgtgactagacactcatctcactcgcgccatcttagggtttctccttttgtttcgcaacatggttgccgctaagaaaactaagaagacccatgagagcatcaacaacaggctcgctcttgtcatgaagagtggcaaattcaccctcggttacaagaccgttctcaaatctcttaggaactccaaaggaaaattgattatcattgctaacaactgcccccctttgagaaagtcagagattgaatactatgctatgttggcaaaggttggagttcatcattacaatgggaacaatgtggatttgggcactgcatgtggaaaatattacagagtgtgctgccttagcattattgatcctggtgattctgatatcatcaagacactgcctggcgaccagtaaagtagtattgaagttccttgcttgatattttctatttttagttgattccagacattgttgaaagaatatctgattaagttctagactttggtgtaaggtgcatggtttttgggtattctagctgagcatcaagtgtttttgaccttgcaaattttttcatgatgtttcattatgccaatttctatagagatgatataattatagtttgatcacacgcttgctgttaacagcaagcccgtgttatccactttcgctcgcaaatagttgttgacattgaatttgcatggtaaaccccataactaagagctttaaatgggtggaaattttttat

SEQ ID NO: 1203 - DNA, 938 bp, Nicotiana tabacum
  misc_feature (81)..(81): n is a, c, g, or t
  misc_feature (129)..(129): n is a, c, g, or t
  misc_feature (132)..(132): n is a, c, g, or t
  misc_feature (393)..(393): n is a, c, g, or t
  misc_feature (459)..(460): n is a, c, g, or t
  misc_feature (519)..(519): n is a, c, g, or t
gttatataggagaaaactcccttcattaccgccgtcgacgcatttgcctcttcctataatttccgactacatttctccagnccagagccaaccatggttgctgcaaagaaaaccaagaagactcatganagnattaacaacaggctggctctggtaatgaagagcggcaaatacacattgggatacaagactgttctcaaaactcttagaaactccaaaggcaaactcgtcatcattgccaacaactgccctcctctcaggaagtctgagatagagtactatgctatgttggcgaagattggagtccaccactacaatggaaacaacgtagatttggggactgcatgtggtaagtatttcagagtctgttgcctcagcatcattgatccaggngattctgatatcattaagagcatgcctggtgaccagtgagatagcagctgatgttagatcgctccnntggacactgctcaatcttagtggaactttgccgtttttccttattgagaaaaatatctngtgtagatgagttttgctactttggtaatgttaaaggaagttttgatggtatttggaatctttaggacatcaattttttttttcctggagttttgaatcttctaattgactgtcatatgttgcttacgttctgcatgcaacacatacctgctgtaagaatttctaacctggttggttcccctgctaggacctaaagaaagagccaactcttctgagccattacaatactgcctatattgtatttgaggatgttatatcttgctttcactgttacttgagccgagtgtctaaaggaaatagcctgggtaaggtctgcgtatacactatccccagaccctacttgttatactggattttttgttgatgttatattttggttgtcacagaaccaatatggccaatccagggattttttggtg

SEQ ID NO: 1204 - DNA, 644 bp, Nicotiana tabacum
  misc_feature (389)..(389): n is a, c, g, or t
  misc_feature (462)..(462): n is a, c, g, or t
  misc_feature (468)..(469): n is a, c, g, or t
  misc_feature (487)..(487): n is a, c, g, or t
  misc_feature (511)..(511): n is a, c, g, or t
  misc_feature (521)..(521): n is a, c, g, or t
gaggagtgtcccgtggttatattaggaaaaagaagactccctctacatcagtagagtgttatctcgccgctccgtcgacgcattttacttcttccaagcacagagccaccatggttgccgccaagaaaactaagaagactcatgaaagcattaacaataggctggctcttgttatgaagagcggcaaatacaccttgggttataagactgttctcaagaccctaagaaactccaaaggaaagcttatcatcattgccaacaactgccctccactcaggaagtctgagatagagtactatgctatgttggctaaggttggagttcaccactacaatggaaacaatgtagatttgggaacggcttgtggtaaatatttcagggtctgttgnctgagcatcattgacccaggtgattctgacatcattaagagcatgcccgatgacaagtgagaggatgccattntgaatnngggaaaattatcccattntttcttatgagaagaatagcttantgtagatganaattttacttttattctggtgatttgcaagataattttgatgatattggaatcttcatgaccaccaattttctgtttagtgaagctactagcggccgcatgaggggatcctctagagtcgacg

SEQ ID NO: 1205 - DNA, 595 bp, Triphysaria pusilla
ttcattatctccgcgtctcgggcaaaaaactccagacttgagctccaatggcggccaccaagaaaaccaagaagacacatgagtccatcaataataggttggctctggtgatgaagtcggggaaatatacccttggttacaagacggttcttaaaaccctacgcagctccaaaggtaagttgatccttatctccaacaactgcccgccgttgaggaaatcagagatcgagtactatgcgatgcttgccaaagttggtgttcaccactataatggaaataatgttgatttgggaacggcttgcggaaagtatttccgtgtgtcttgcctcagcattgtcgacccaggtgactctgacatcatcaaatctctgcctggtgaccactgagaagaggatggaatttatgccttacttttactgttttggatatttgaagtgttctttatcttatgtagaacatgaattttgagttgaatgtttgttttgtctcattactttgcttggttattcaccctgcctgctgttttttgatcctctatttatgcctgcatttgacatgttagagtgtaatattgtgattttatgttttcacttgc

SEQ ID NO: 1206 - DNA, 745 bp, Zamia vazquezii
  misc_feature (733)..(733): n is a, c, g, or t
gctaccggactccggcggtaaggcctggtgagggcttcggaaaccctgaaatccatcgcaagctgcagcaatggtgaccgtcaagaagactaagaagactcatgagagcattaacaataggcttgctctcgtcatgaagagtggaaagtacactctcggctacaagaccgtgctcaggtctctcagaagctccaaagctaaactaataattattgccaacaattgccctcccctgcgaaagtcagaaattgagtactatgccatgctcgccaaggttggagtacatcatttcaatggaaacaatgttgatttgggaacagcatgtggcaaatatttccgtgtgggctgtttgagcataacagatccaggtgattctgacatcattaagacagtgccctctgatcagtgagtgtagtcctagtgggtcacaagttttttatgattttgctagcaaaggggctatattttcttatatccaattctcaaggggagtggtagagaagcttagagtaaatatttcttgagcaataacaagtgggatgaattttcagtatcccagtgacactgactgattttatttgatcctgcttcaagaaagggtcttcaactaatgttagtttatttaaattcagtggacaacgtattccttgtggcataagttttgtgaggattaagcatctgtagacttaatgaaagtccatgggatggtatacgtagtttaattaaatttgcncattgaaggttc

SEQ ID NO: 1207 - DNA, 614 bp, Zostera marina
gggggaacattagggttttctctgccgtcgcacttccattttcgtaggtcactgttcgttgtttttcgtagctatggtcgtcggaaagaaaacgaagaagacgcatgacaacatcaacaacaggctcgcgttagtcatgaagagcggaaagtacacgcttggatacaagaccgttctcaagacgctcaggaattcgaaatctaagttgatcataatatctaacaactgccctcctcttcggaaatccgagattgaatactatgcaatgcttgcaaagatcggtgttcatcatttcaatggaaacaacgtcgatttgggaacagcatgtggaaaatattacagagttggttgcttgagtatcattgatccaggtgattctgacattatcaagtctctgccaagtgatcattgaaggtcctaaagcccataatcatctagtgatctctacccagtttgtctatttttccttgaaaatcttccttgaaaatctggtgtctatgtttttctaattttcatgaatccatcaacagaaatctttctttatcttttaaccatatttcacaaatgatgtaatgttttttttaaagtttgaattcttagcaatttgctttagg

SEQ ID NO: 1208 - DNA, 671 bp, Secale cereale
gaagccgccgccgacgccgccgtcacttctcctcggggcgcaaccatggtgacctccacgaagaagacgaagaagtccggggacaacatcaacaacaagctgcagcttgtaatgaagagcggcaagtacacgctcggctacaagaccgtcctcaggaccctcaggaactccaaggcaaagcttgtgatccttgctaacaactgccctccgctccgcaagtctgagattgagtactatgctatgttggcgaaggtcactgtccaccactaccatggaaacaatgttgatttgggaactgcgtgtggtaaatacttccgagtctgctgcctgagtatcatcgatcctggtgattctgacatcatcaatgctacaccagctggccagtaaacctgtgtgtgccatttcagtgtctcgtctgatgtgtcatctgaggtgttctagagtgtagttcttgctggacttgatttggtcttgtgtacatcatttatcagtcaatcaagtttgatgggactatggttttggatcaaaaggttttgttactggcttaattaattgctctgctgtcagcaagcagggttttgctgtggtcagtaggtttctgtgtgttgctatttgacatcgttgtagagctacagtatgttcattgtgtggatgcaagttaacgagccgaa

SEQ ID NO: 1209 - DNA, 654 bp, Pseudoroegneria spicata
  misc_feature (49)..(49): n is a, c, g, or t
ccccgagcaggagccgccgccgacgccgccgaccctcgcgacgccgccnaccctcgcgacgccgccacttctcctcggggcgcaaccatggtgacctccacgaagaagacgaagaagtccggggacaacatcaacaacaagctgcagcttgtcatgaagagcggcaagtacacgctcgggtacaagaccgtcctcaggaccctcaggaactccaaggcaaagctagtgatccttgctaacaactgccctccactccgcaagtctgagattgagtactatgctatgttggcgaaggtcactgtccaccactaccatggaaacaatgttgatttgggaactgcctgtggtaaatacttccgagtctgctgtctgagtatcattgaccctggcgattctgacatcatcaacgcaacaccagctggccagtaaacctgtgtatgccattttcagtgtcttgtctgatgcgtcatctgaggtggttctggagtgtagttcttgctggacttgatttggtcttgtgtacatcatttatcagtcaatcaagtttgatgggactatggttttggatcaaaaggttttgttcctggcttaattaattgctcttcgttgtgctgctgtcagcaagcatggttttgctgcgatcagtagttttca

SEQ ID NO: 1210 - DNA, 578 bp, Eschscholzia californica
ccatggtggccgccaagaagacgaagaagactcatgagagcatcaacaataggttagctctcgtgatgaagagtggcaagtacactcttgggtacaaaactgttctcagaactctaaggagctctaaagggaagttgattatcattgccaataactgccctcctcttagaaagtctgagattgagtattatgctatgttagctaaggttggagttcatcactacaatggcaacaacgtcgacttgggcacggcttgtggtagatactacagggtatgctgcctcagtatcatcgatccaggtgattctgacatcattaagaccatccctggcgatcagtgagagaggaagatgatgtagtcttgtgttcttggggcactgattttgttctcggtttattttctgttatcaagttggttatgtagttcagttcttttcgatattacattagacattgttcatgttctgatttgtgcaagaattttatgtttagaggaagtatttgttctttcaaaccacgcaaaaggtcgtatttgctaaccttgtttttgttgttgagagctttgctaacctggtttg

SEQ ID NO: 1211 - DNA, 645 bp, Eschscholzia californica
ggtttcttggccgtcatcaaatcggagaagctttccttcgcccggaaaaagtagagcagaacaacaatggttgccgccaagaagactaagaagactcatgagagtattaacaacaggcttgctctcgttatgaagagcggcaaatacacccttggttacaaaactgttcttagaactctcaggagctctaaagggaagttgataatcatagctaacaattgcccacctcttcgaaagtctgagattgagtactacgctatgttagctaaagttggtgttcatcactacaatggaaacaatgtggacttgggtactgcttgtgggagatattacagggtttgctgcctcagcattatcgacccaggtgattctgatatcattaagaccattcccggtgaccagtgagaagactagcagtgacaattagctgtactttctctttattttagatttcggagttcatgttctatttagaactagttgtttttcgttctcgggtgcaagttatgtttttgtttttggttaatattagagatatgtaaccttactgtgtaagattggttctatttcatacttagaatggagacttcgaaccatgttttgtttttgacatccaacgacggaaaataaattttgagctcaaaa

SEQ ID NO: 1212 - DNA, 595 bp, Plantago ovata
aggagttctaggttttcagagaagatcacttgtcacttccagctgccgcaaaacctagcaacttgaaggcgaggcgacgaaggagaaccaatggcgccgacgaagaagaccaagaagactcatgagagcatcaacaacaggctggctctcgtcatgaagagtggcaagtacactcttggttacaagactgtgctcaagtctctccgcagctcaaaaggaaaattgatcctgatctcgaacaattgtccacctttgaggaaatcggaaatcgagtattatgcaatgctcgccaaaattggtgtccaccattattctggaaataatgtggatttgggaactgcctgcggtaagtttcaccgcgtctcatgcctcagcatcatcgacccaggtgactcggacattatcaagacattgcctggcgataactagacctgatagttttgttatctgtggcattttgaattcttcaatgttttcctattttcagatgtagtactttgtgagagtgattaaagttttgatctttaatgtttgtgttagacatattaactctcaatctgaatacattttatctcgcaattctatagatctaatc

SEQ ID NO: 1213 - DNA, 775 bp, Citrullus lanatus
atccgaagatttcggttgttttcatatctgtttcatctttgctttagggattttgttcaccttttgagcagcgacgatggcgccggcgaagaagactaagaagactcatgagagcattaacaacaggctcgcccttgtgatgaagagtggcaagtacacactgggttacaaaaccgtccttcgcactatccgcagttccaaagggaagcttattattctatcgaataactgcccgcctctgcgtaaatccgaaattgagtactacgcaatgcttgccaaaattggagttcaccactataacggaagtaacgtggatcttggaactgcttgtggcaagtattaccgtgtctcctgcctcagcattattgatccaggtgattctgatattatcaaatcgcttcccggtgatcagtgataattgtgtcattgaggacgttaggcttttttgtttttgcacctttttctcttcagcaaaggctagaatttgcatctattttaatgtctccagaatagctaccaactttatgcattaaaattgtactgttgataaccagattttgtcaatgtctttgaggttttatttagttgagacgtggtcttatatagaatgttcaagttgttttatacctatttatgcttaaacaattgagaatacggaatctcgttgccttttgtattagcaatgcaattacgttttttaattacaagattgttttagttcagcaatgagtagaaattaatcatttgatccaaatgccttgaaggcagccttaat

SEQ ID NO: 1214 - DNA, 649 bp, Persea americana
ctctttatttccaaggagggtttctttctgcatttcctcttcagcaaccatggtggccgccaagaagaccaagaagagtcatgagagcataaacaatcgtctggctcttgtgatgaagagcgggaagtacacattgggttacaagactgttcttaaatccctaaggagctccaaggggaagttgattatcatcgcaaacaactgccctccacttagaaaatctgagattgagtattatgcaatgttgtcaaaggttggagttcaccacttcaatgggaataacgtggatttgggaacggcttgcggcaaatattatcgggtgtgctgcctcagcattattgatgcaggtgattcggatatcattaagagtattccaggtgatcagtgacagtcaaagggacagctagtttcttttgatactggtagtctttaagtgacaaatttgtccgaaggatttggttgtatgtgagagtatgcagtttagcattgactccaagattagctagataaaatagggaacttatttgcgttacctacgttctgtcatctcttagcagtgccttcaattttgtacctttgtttcttcttgtcacagaaacatatattgaagtggtggcatgccaatatcagagatgtcttaattttgtga

SEQ ID NO: 1215 - DNA, 605 bp, Musa acuminata
ggcggccacggagaccgtcacctccgccttcgacaccttcaagcctctacgatggcgcccgtcaagaaggcgaagaagagcactgagagcataaacaacaggctcgctctcgtgatgaagagcgggaagtacacccttgggtacaagacagtccttagatccctccgcaactccaaagggaagttaattataattgctaataactgccctccacttcgcaagtctgaaatcgagtattatgcaatgttgggaaaggttggagtacatcatttcagtggcagtaacgttgatcttggaacagcctgtggcaaatacttccgtgtatgctgcctcagcattattgatcctggtgactccgacattatcaagagcattcctggagagcaataagagaagcacaaaacatatgctggctcatatgtttgacctgggcttatcattattccgaatctggtttgtctttaaaatgttgctaaatgatatcgctgtcgagaatatatatatgacctgtttgtttaatcatgtcttgttgtcatatatatatgactttaaaatgttgtttccttatctttttgtactttactaatgagatctctagagttagt

SEQ ID NO: 1216 - DNA, 798 bp, Cephalotaxus harringtonia
aggcggttgcggcggggattttattcgatcgggcgaaatggtggccactaagaaaactaaaaaggctcatgagagcatcaacaacaggttggctcttgtcatgaagagtggcaagtacacgttaggctacaaaactaccctcaagtctatcagaaccaacaaaggaaagcttattataatcgcaaacaactgtcctcctctacgtagatcagaaatagagtattatgccatgcttgcaaagattggggttcatcatttcaatggaaacaatgttgatctagggacagcatgtggcaagtattatcgggtgtgctgtcttagcattacagatccaggtgattctgatatcattaagacggtgccatcagatcagtgagtgcatatttaggtggctaaggcagtagggaattagtggtaaaaactttagatgagattcattttccagtttttctttcggcaacaaatagcaatcatgcttgttaggtttgagttgttaactgattaagagggctatttatgttgaatgaccttattctgtagtggcgggaacttgtaagtttgtcaattgaatttttatttcacactattttgcttttggatttgatgattgtaacattttaaacaaagttggtctacgttgtagtatttagtttttagaatcctgttagtttacaggatttgtaatcttgacagatgattgagtttatgttggagtagtgtataataatttatttaggtctttgcaggacttgtaatcttaacagataattaagttttgcttatatgaattaagtttat

SEQ ID NO: 1217 - DNA, 822 bp, Chelidonium majus
tcactagatcggagaattgttccttgcctcggagaaaacaggagcagcagtcatggttgccgccaagaagactaagaagactcatgagagcatcaacaataggcttgctctcgttatgaagagtggcaagtacaccctcggttacaaaaccgttcttaggtcactcagaagctccaaagggaagttgataatcatagctaacaattgcccaccacttcggaagtctgagattgagtactacgctatgttggcgaaagttggggttcatcacttcaacggaaacaacgtggacttgggtactgcttgtggaaaatattaccgggtatgctgcctcagcatcatcgacccaggtgattctgatatcattaaatccattcctggtgatcagtaaagagacaagcagtgacaaatagctgtatcttcgtttagattttggtttgtgctttttgtcagaggatttatctagtgttaatgaagtttctctttttgggtaatgcaagttgtggttgtgtttagccgacaatagagatcagtagcctgcttcaatggcctgttcgagtgtggtttcatttatgagatcatactttggtctagatattgggtctgtttaaaacttggaatggagtatgtggtccatgtttttattacctttaatggatgaaagaaaattttgagatgttaattatgttaatttttaagtcttattggaggttcttcatgcgtatatgcattttcttgtggcattcatgctggtacatatggcttagtgaaccactgaactcaactaatgattaagtttgtctgtagagaaattgcatacaa

SEQ ID NO: 1218 - DNA, 567 bp, Vigna unguiculata
gggggtttcttccttggggcaaattcagaccattatcacgctcttcagagagttccaacgccaccatggttgctgccaagaagactaagaagacccatgagagtatcaacaacaggctcgctcttgtgatgaagagtgggaaatatacattgggttataaaacggttctcaaatccctcaggagctccaaaggaaaattgattatcgttgccaacaattgcccaccattgaggaagtctgaaattgagtactatgctatgttggcgaaggttggagttcaccattacaacggcaacaatgtggatttgggcaccgcatgtggcaaatattacagagtttgctgccttagcattattgatcctggtgattcggatatcatcaagacaatgaacaccgagcagtagagttgtattaactccttttttttgtccttgaaaacttttgattgtttgatatttgttcctgttttttcggacttgtctttaagaaattttaatataggctgaacttttgagtatttaagcttttaagaaattatctacgtaatttatttttttcgtgatggtt

SEQ ID NO: 1219 - DNA, 589 bp, Vigna unguiculata
ggagggtttcttccttggggcaaattcagaccattatcacgctcttcagagagttccaacgccaccatggttgctgccaagaagactaagaagacccatgagagtatcaacaacaggctcgctcttgtgatgaagagtgggaaatatacattgggttataaaacggttctcaaatccctcaggagctccaaaggaaaattgattatcgttgccaacaattgcccaccattgaggaagtctgaaattgagtactatgctatgttggcgaaggttggagttcaccattacaacggcaacaatgtggatttgggcaccgcatgtggcaaatattacagagtttgctgccttagcattattgatcctggtgattcggatatcatcaagacaatgaacaccgagcagtagagttgtattaactccttttttttgtccttgaaaacttttgattgtttgatatttgttcctgttttttcggacttgtctttaagaaattttaatataggctgaacttttgagtatttaagcttttaagaaattatctacgtaatttatttttttcgtgatggttaacaagcgatacttttaactt

SEQ ID NO: 1220 - DNA, 708 bp, Cryptomeria japonica
ggggtttaaccagcaacaggagaatttttaaggcgtctgcggctgggctttatcatctatcggcaaaatggtggccactaagaaaactaaaaaggctcacgagagcatcaacaacaggttggctcttgtgatgaaaagtggaaaatatacgctaggttacaaaactaccctcaagtcaatcaggaccaacaaaggaaagcttattataattgcaaacaactgtcctcctcttcgtaggtcagaaatagagtactatgctatgcttgcaaagattggggtacatcatttcaatggaaacaatgttgatctagggacagcttgtggcaagtattatcgggtgtgctgtctcagcattacagatccaggtgattctgatatcatcaagactgtaccatcagatcagtgagtgcataattgggatggtttggtcaggaaattgttaatttttcttacctgcccaggatattgggaaggagtagggagtcagtggtaaaaactttttgtcaagatttttttcagtttttcttctagacggcaaaaaacaccaacctttctttttaggaatgagttgtcttctgattaagagggctatttatgctgaatgaccgaaatctgtaatcatggaaacttgtaaggtgtcaatcaaatctatattccattttagttttcttttggatgcggtgatgcaatttttcataaagctcttgt

SEQ ID NO: 1221 - DNA, 623 bp, Cucurbita pepo
gtcgatcggcagctttctctacttccaccatggtggccgcgaagaagaccaagaagactcatgagagtatcaacaacaggctcgctctcgtcatgaagagtgggaaatataccttgggatacaaaaccgttctcaagaccttgaggagctctaaaggtaagctgatcatcattgccaacaactgccctccactccgaaagtctgagatcgagtattatgcgatgttggccaaggttggagttcaccattacaacggaagcaatgtagatcttggaactgcgtgtggaaagtactacagagtatgctgcctcagtattatcgatcctggcgactctgatatcatcaagagcattcccggagacagttagtttgcaacttcctctcagatcatagatttttgtttcagagtttctttttcaatccatttaattttggggtgaacgtagtgatgtgttccgcttgcgaagcatgttattatcgatcgaatggtttcaatataaactttttatgtatgccagatcttattccagaatacttgttatattatcttgatgttcacactacccttaaccgattccaaacagcatgttgtgtccaatcattgatttattatgatttgcaat

SEQ ID NO: 1222 - DNA, 608 bp, Cucurbita pepo
ttgtggaaaagcctcgtttgggtagggcaggattttgtactccttttgagaagcgacaatggcgccggcgaagaagactaagaagactcatgagagcattaacaacaggctcgcccttgtgatgaagagcggcaagtacacactggggtacaaaaccgttcttcgcactatccgcagttccaaaggaaagcttattattctatcgaacaactgcccgcctctgcgtaaatccgaaattgagtactacgcaatgcttgccaaaattggggttcaccactataacggaagtaatgttgatcttggaactgcttgtggcaagtattaccgtgtttcctgcctcagcatcattgacccaggtgattcggatattatcaaatcgcttccaggtgatcagtgattattgtaccctgtagaactttagttttttttttttttggtcgcacctttttctcttcagcaaatgctagaattttgcatcgattataatgtcctcagaatagcttccttactttcttcattaaaaatttaatgttgtataacttgtattttgttcaatgtcttgtggttttattttcttcatgtctcgaggttcttattactatatctaa

SEQ ID NO: 1223 - DNA, 637 bp, Cyamopsis tetragonoloba
cacgaggcctaagtttcatcccgttggcacctgcacttccacaatccacacaacacagcaactatggtggccgcgaagaagacgaagaagactcatgagagcatcaacaacaggctagctcttgtcatgaagagtggcaaatacaccctcggttataaaaccgttctcaaaaccctcaggaactccaaagggaaattgatcatcattgctaacaattgtcctcctttgaggaagtctgaaatagagtactatgctatgttggccaaggttggagttcaccactacaatggaaacaatgtggatctgggcacagcatgcggcaaatatttcagagtgtgctgcctcagcattattgacccaggtgattcagatatcattaagacactgcctggcgaacactaaagtagtgttggagtgttttgcttgatctcttcttttttcagttcatttagacattgttaaaagaaaaatctgattaagccttaaggtgcatgtggcttctagcttattgagcatcacataattttgtttaggcgaattttttggtgattttcattgtggcgatttctatatagttgcaattgttgtcttatcgcacttgctgttaatggtgttattaaagttcactaccaaaaaa

SEQ ID NO: 1224 - DNA, 585 bp, Cyamopsis tetragonoloba
cacgagggcgcctcacagtttacgcaacacagcaacaatggtcgccgccaagaaaaccaagaagacccatgagagcatcaacaacaggctcgctcttgtcatgaagagtggcaaatataccctcggttataaaaccgttctcaaatccctccgcaactccaaagggaaattgattatcattgccaacaactgcccacctttgaggaagtctgaaattgagtactatgctatgttggccaaggttggagttcaccactacaatggaaataatgtggatctgggcacagcatgtgggaaatattacagagtttgctgcctcagcattattgatcctggcgactcagatatcatcaagacacttcctggagaccagtaaattagtgttggagttttgcttatttttctgttttcagttcattttgacattgataaatgaaaatctgattcagtggtagactctggtgtatgttgcgtggtttgtagcttaatgagcctgagtaattttgacttttgcaaaattttcgttatgtttcattattgcgaattgctatatagatagaattgttgttttgtcgtaaaaaaaaa

SEQ ID NO: 1225 - DNA, 778 bp, Cycas rumphii
ggttgacgcctaagagtgctccctatcgagaactgcggctgcttgactgatagcagagggttttgaatccttgcgatcagaagctgcaacaatggtgaccgtcaagaagaccaaaaaaactcatgagagcatcaacaacaggcttgctctcgtcatgaagagtggaaagtacaccttcggttacaaaaccgtccttaagtctctaaggaactccaaagggaaactaataattattgccaataactgccctcctctacggaagtcagaaatcgagtactatgccatgcttgcaaaaattggagtgcaccattttaatggaaacaacgttgatttgggaacagcatgtggcaaatatttccgtgtgggttgtttgagtataacagatccgggtgattctgacattattaagacggtgccttctgatcagtgagtgcaatgacagtagctcataaactgggatggttttgttagcaatggagcttttctcttatatccaattcttaagaggattagtagagaagttttaagtacattttcttaaatgaaaacaagtgggataaattttcaatatccaagtgaggctatctaattttatttgatcttgtgtcatagattggtgttgaaattgtattattagtttattttaagtctattggaatgtgcatttcttgcagcattgagtcttgtgaggattaagcattcataaacttgtgaaaattcatgctttattatgcaatttaatttattaagtttgcaaaaaaaaaaaactttggatcca

SEQ ID NO: 1226 - DNA, 643 bp, Solanum melongena
actctgtagtgttctgtactttcagcaaaacaagaaaaccacaactgccgctcgtggacgtaagtgcagaagcagaccaccatggttgcctccaagaaaactaagaagacccatgagagcattaacaataggttggctctagttatgaagagtggcaaatatactttgggttataagactgttcttaagactcttagaaactccaaaggaaagcttattatcattgccaacaactgccctcctctcaggaagtctgagattgagtattatgctatgttggcaaaagttggagtccaccactacaacggaaacaatgtagacttggggacggcttgtggtaaatactacagggtttgttgcctcagcatcatcgatccaggtgattctgacatcattaagagcatgcctagtgaccagtgaggcttgccattctgaatcttggaaaattgtccattttttttttctgagaagaatagctagtgtagatgataattctactttattgtggtgattggcttagataattttgatggtgttgggagtcattttttctatcttgaactagtgattttacctttatgaacaatgatttgttgtgccatattatacacttctaaattctaagtttttgaaatttgaacat

SEQ ID NO: 1227 - DNA, 438 bp, Eschscholzia californica
ctgaagtttgtaatctaaacagccatggtggccgccaagaagacgaagaagactcatgagagcatcaacaataggttagctctcgtgatgaagagtggcaagtacactcttgggtacaaaactgttctcagaactctaaggagctctaaagggaagttgattatcattgccaataactgccctcctcttagaaagtctgagattgagtattatgctatgttagctaaggttggagttcatcactacaatggcaacaacgtcgacttgggcacggcttgtggtagatactacagggtatgctgcctcagtatcatcgatccaggtgattctgacatcattaagaccatacctggcgatcagtgagagaggaagatgatgtagtcttgtgttcttggggcactgattttgttctcggtttattttctgttatcaagttgg

SEQ ID NO: 1228 - DNA, 566 bp, Ipomoea nil
gagggtcgcctctccgccgcaatcggctcgctcggtttcaggagtgcattgcagtgttccaatcgccggtcctagccaaagcgccaccatggttgcagccaagaagaccaagaagactcatgagagcattaacaataggttagctcttgttatgaagagtggaaaatacacattgggatacaaaaccgtcctcaagtccctcagaagctcgaaagggaaattgattatcattgccaacaactgtcctccactcaggaagtcggaaatagagtactatgctatgttggcgaaggttggtgttcaccactacaatggaaacaacgtagatttggggactgcttgtggtaaatattaccgggtatgctgcctcagcattatagatcctggcgattctgatatcattaagagcatgccgagcgatcagtaagacaggcaatggatggcgaaatttctgctggcagtgatgtttttgtatttctcaagaaaaatgaaaatgtcattgtttgcaaaattttctaatctattttggcattgttcaatgaaaaacatctctgttaaaaaaaaaa

SEQ ID NO: 1229 - DNA, 453 bp, Glycyrrhiza uralensis
gggcgaaagaactagggtttattgattccgaccatcttctctttctgcagagaaaccctaaatctctccaccaccatggttgccgctaagaaaaccaagaagacccatgagagtattaacaacaggctcgctcttgtcatgaagagtgggaagtacactcttggttataaaactgttcttaaatccctcagaaactccaaagggaaattgattatcattgccaacaattgtccaccattgaggaagtctgaaatagagtattatgctatgttggctaaggttggagttcatcattacaatggcaacaatgtggatttgggcacggcttgtggcaagtactacagagtgtgctgtctcagcattattgatcctggtgattcggatatcattaagacaatgcctaatgagcagtagagtggtatcaagtccttgttattggtccgattgaaattg

SEQ ID NO: 1230 - DNA, 627 bp, Glycyrrhiza uralensis
ggctactacaggtgcttgtttatatacccgaaagctctctgcctccaacaacgcgctcgggtttgttcataatctgcactctctccactccaaagaaccctaattcccaccaccatggttgccgccaagaaaactaagaagacccatgagagtattaacaacaggctcgctctcgtgatgaagagtgggaagtacactttgggttataaaactgttctcaaatccctcagaaactccaaaggaaaattgattatcattgccaacaattgcccaccattaaggaagtctgaaatagagtattatgctatgttggctaaggttggagttcatcattacaatggcaacaatgtggatttgggcacggcttgtggcaagtactacagagtgtgctgtctcagcattattgatcctggtgattcggatatcattaagacaatgcctagtgagcagtagagtggcatcaagcccttgtttttggtccaattattaaaagtgtggttgtttaatgtttgctatcttctgtttattcagacatttgagaagaaaatttgatgtagacttcactgtatggaaagattcatgtttttggataatcaagcattaagatatttcgaccatgcgagccat

SEQ ID NO: 1231 - DNA, 495 bp, Glycyrrhiza uralensis
gtcttcttcattccgacgatttcttctctgcagagagtgaaccttaactcccaaatcccaccaccatggttgccgcgaagaaaaccaagaagacccatgagagtattaacaacaggcttgctcttgtcatgaagagtggcaagtacactcttggttataaaactgttctcaaatcccttagaaactctaaagggaagctaattatcattgctaacaattgccctcctttgaggaagtctgaaatagagtactatgctatgttggctaaggttggagttcatcactataacgggaacaatgtggatttgggcaccgcttgtgggaagtactacagagtttgctgtctcagcattattgatcctggtgattctgatatcattaagacaatgcctagcgagcaatagagttgcatcaatcaagtccttgattttggtccatttagaactggttgtttttgttagtgttttctgttgattcaaacgttgttgatttaat

SEQ ID NO: 1232 - DNA, 580 bp, Liriodendron tulipifera
  misc_feature (62)..(62): n is a, c, g, or t
tgctctcttcagctcagcaatggtggccaccaagaagactaaaaagactcatgagagcatcnacaatcgcctcgctctcgtgatgaagagcgggaaatacactttgggatataagaccgtcctcagatccctcaggagctccaaagggaagttgataatcattgcaaacaactgccccccacttagaaagtctgagattgagtactatgcaatgttggcaaaggttggagtccaccattttaatggaaacaatgttgatttaggcaccgcttgtggcaaatactatcgggtctgctgcctcagcattattgatccaggtgattcggatatcattaagagcattcccggcgatcaatgagtgagtagggcctgtattgtctttattgatagagatttaaatggcagtttttcttaagggtttctctgttggtaagagaggttttgatgagtgtgcaatttttgctgctaactctttttacaagaacggccatttaatgactgtgaatcggttaaaatgatgacacccccaactcttgattttgtgttttttatgttgtgttgcctttaatagtccgttttc

SEQ ID NO: 1233 - DNA, 646 bp, Liriodendron tulipifera
  misc_feature (580)..(580): n is a, c, g, or t
cgagctctcgtctgcagtcgttgcagcttactagggtttccaatccttccgacctccaaaagccccaaatcaaatcagaggttttggattctcagtaagtagcacgatggttgccacgaagaagacgaagaagactcatgagagcattaacaacaggctcgcactcgtgatgaagagtgggaagtatacgcttggatacaaaactgttcttcgttcactgagaagctcgaaaggaaaactgattattatttcgaacaactgtccacctctgcggaaatctgagattgagtactatgcgatgcttgcgaaggttggagtgcaccatttcaatggaaacaatgtagacttggggacagcatgcggaaaatattatcgagtgtcgtgccttagcatcattgatccaggtgattctgatatcatcaaaacactgcctggtgaccagtaactggagtttggtaggaaaaatggtgtttcattggtacctctcttagaagcatgattaattttgtcattggaatgcggcagcgtgtggtttttcattttttatttctatttaattttgcaaatcagatcaacttantaagcatataaatgctttagattcgcatcttagtgttgaaaatcaaagacctgcatgtgtgactga

SEQ ID NO: 1234 - DNA, 636 bp, Lotus japonicus
gaacgacagtgaagtttgtatttatttaagcctctgcctccaacaattagggtttcttggttcagacagaagagtgtattcattctatcttcagagagagaagagaaccctgacgccgcgccaccatggttgccgccaagaaaaccaagaagacccatgagagtattaacaacaggctcgctcttgttatgaagagtggcaaattcactttgggttacaaaacggttctcaaatccctcagaagctccaaagggaaactgatcatcattgccaacaattgcccaccgttgaggaagtctgaaattgagtactatgctatgttggcgaaggtcggagttcatcattataatggaaataatgtggatttgggcactgcttgcggcaagtattacagagtgtgctgcctgagcatcattgatcctggtgattcggatattattaaaacattgcctggcgaccagtaaagttgtatcaagtctttataaaactgtgattgtttgacatttgctgttttctgttgattcagacattgtcaaaagaaaattgaatattggtttaaatgatctggtagcatgtatggttcatgtgtttggtatcttcaagcgaaattgattgagaatgcaattttttcccttg

SEQ ID NO: 1235 - DNA, 597 bp, Lotus japonicus
gggactcgcctctttcaccaccaccgtcaagtcgaagtgttcatcttctctgcactctcctctgaactcagcaacaatggttgccgccaagaaaaccaagaagactcatgagagcattaacaacaggctcgctcttgtgatgaagagtggcaaattcactctcggctacaaaaccgttctcaaatccctaaggagctccaaagggaaactgattatcattgctaacaactgtccccctttgagaaagtcagagatagagtattatgccatgttggcaaaggttggagttcatcattacaatgggaataatgttgatctgggcactgcttgcggcaaatactacagagtgtgctgcctcagcattatcgatcctggtgactcagatatcattaaaacactgcctggtgaccagtaaagcggtcttgaagcttgatatttttgtgttaccagtttattttagacatttgtgaaagataaactgatttagttatagactttgatgtacggctcatggttcttggttattctaccttgttgagcatctagtaattttgactatgcaaaatctttttcatctagtaatattctactttgatt

SEQ ID NO: 1236 - DNA, 703 bp, Cucumis melo
ccccttgtcgtgaaaaagccagaaggtattcgtacaccttttgagtagcgacgatggctccggcgaagaagaccaagaagactcacgagagcattaacaacaggctggcccttgtgatgaagagcggcaagtacacgctcggttacaaaaccgttcttcgcactatcagaagttccaaaggaaagcttattattctatcgaacaactgcccacctctgcgtaaatccgagattgagtactacgcaatgcttgccaaaatcggagttcaccactacaacggaagtaatgttgatcttggaactgcttgtggcaagtattaccgtgtctcctgccttagcattatcgatccaggtgattctgatattatcaaatcgcttcccggcgatcagtgatttttgtcattgagaacgttagttgtttttttcttcttcttttgcaccttttctcttcagcaaaggtaaaatttgcactgattttaatgtcccagagtagcaaccaactttaagcattaaaattgtattgttgataaccagattttgtcaatgtctttgagattttatgtagaatgctcaagtagtttcatacctatttatgcaagcaattgagaatcgaaaatctccttgcctttcgaatacaagattgtttatcgaaaatgagcaggaatttatcatttgatccaaatgcctcgtatgagacttaatta

SEQ ID NO: 1237 - DNA, 591 bp, Nuphar advena
actcgttacatctttcgctagggcttcatcggagaagaagctgcagcaaaatggcctccacgaagaaggcgaagaagactcacgagagcatcaacaatcggctcgctctcgtgatgaagagcgggaagtacaccctcggctacaagaccgtcctcagatccctcaggagctccaaagcaaagttgatcatcatcgcgaacaactgtcagcccctcaggaagtctgaaattgagtactatgccatgcttgcgaaagttggggttcaccatttcaatgggaataatgtggatttgggtacagcatgtggtaaatacttccgagtttgctgtcttagcatcacggatccaggtgactccgatattatcaaaagtgttccaggagatcagtgagacagagaacagagacagatgtcttccttttttgccgtttaatatatgattttgttcgtccgtaatctgtattagcaaacatttaccatggtgattgatgagtttggacacaagggtttctttataaatagaatgctgactttgtattcaaaacagcatttgattagttccctattttattagatccttttttggtttggtt

SEQ ID NO: 1238 - DNA, 559 bp, Nuphar advena
  misc_feature (558)..(559): n is a, c, g, or t
ggtttcagggcctccactctcacctctttctctaggccttcagtccgtcgaagaagaagctgcagcaaaatggcctccacgaagaaggcgaagaagactcatgagagcatcaacaatcggctcgctctcgtgatgaagagcgggaagtacaccctcggctacaagaccgtcctcagatccctcaggagctccaaagcaaagttgatcatcatcgccaacaactgccagcccctcaggaagtctgaaattgagtactatgccatgcttgcgaaagtgggggttcaccatttcaatgggaataatgtggatttgggtacagcatgtggtaaatacttccgagtttgctgtctcagcatcacggatccaggtgactccgatattatcaaaagtgttccaggagatcagtgagacagaggaaacagcgactaatatcttcctttttggctgtttaatatgattttgttggtccgtaatctgagcaaacagcatttaccatggtgattgatgagtttggacacgggtttctttataaagaggatggatactactttgtattcnn

SEQ ID NO: 1239 - DNA, 643 bp, Arachis hypogaea
acttgccatctcttccagagtccagcaacaatggtggccgccaagaagacgaagaagacccatgagagcatcaacaacaggctcgcccttgtcatgaagagtggcaagtacaccctcggttataagaccgttctcaaatccctcagaacctccaaaggtaagttgattatcattgctaacaactgtccacctttgaggaagtcagaaattgagtactatgccatgttggcaaaggtgggagtgcaccattacaatgggaacaacgttgacttgggcactgcatgtggaaaatattatagagtttgctgccttagcattattgatcctggtgattctgatatcattaagacactccctgctgaacagtaaaagtggaaagtgttttgattgttataacctgcttttagttttaagctattcggtgtaaggtgcattactttggggattctagcagattgtgcatttgagcaattttgacattcaaaattttgaacatgctgttggtgtttagttcatggaagttctcatatgtttggttcatattaaatttgtaaaagcaactgatgctgctattggtataaaattttgaagatttgctcgttttttgaattataaagttgagtaaactaataaaatggtatat

SEQ ID NO: 1240 - DNA, 603 bp, Arachis hypogaea
acttgccatctcttccagagtccagcgacaatggtggccgccaagaagacgaagaagacccatgagagcatcaacaacaggctcgcccttgtcatgaagagtggcaaatacaccctcggttataagaccgttctcaaatccctcagaaactccaaaggtaagttgattatcattgctaacaactgtccacctttgaggaagtcagagattgagtactatgccatgttggcaaaggttggcgtgcaccattacaatgggaacaacgtcgacttgggcaccgcatgtggaaaatattatagagtttgctgccttagtattattgatcctggtgattctgatatcattaagacactccctggcgaacagtaaaagtggaaagtgttttgattgttatatcctgcttttagttttaagctattcggtgtaaggtgcattgctttggggattctagcagattgtgcatttgagcaattttgacattcaaaattttgaacattctgttgatgtttagttcatggaagttctcatatgtttggttcatattaaatttgtaaaagcaactgatggtgctattggtataaaattttgaagatttgctcgttt

SEQ ID NO: 1241 - DNA, 612 bp, Pisum sativum
gtgcatccattttcatttctgtagccgcaatttctctgcaaatcgccaccaaatccatcaacaatggttgcggcaaagaagaccaagaagactcatgagagtatcaacaacaggctcgctcttgtcatgaagagtggcaaatataccctaggttacaaaaccgttctcaagtccctaaggagttcaaaagggaagttgattatcattgctaacaactgtcctcctttgaggaaatctgaaattgaatactatgctatgttggcaaaggttggagttcatcattacaatggaaacaatgttgacttgggtaccgcatgtggaaagtactacagagtgtgctgcctcagcattgttgatcctggtgattctgacatcattaagtcaattcccggtgaccagtaaaagtagttaagatatttgaatggtgttttctattctcagttttctagacattgttaagagtttctagttgtaaactttgtacaatgctcgcatttctgatatccagatgattgagcattgagtaattttgtctatgcaatttttgtttcattgtgctgatttctatatagataatatttccagtttgatatttaatttctgagttatctc

SEQ ID NO: 1242 - DNA, 720 bp, Capsicum annuum
aaaaaaaccaaaaccgccgcattcccactagcagagccaccatggttgccgccaagaaaaccaagaagacccatgagagcattaacaataggttggctctggtgatgaagagtggaaaatatactttgggttataagactgttcttaagacccttaggaactctaaaggaaaacttatcatcattgccaacaactgccctccactcaggaagtccgagatagagtattacgctatgttggcaaaggttggagtccaccactacaatggaaacaatgtagatttggggacggcttgtggtaaatactacagggtctgttgcctcagcatcatcgatccaggtgattcggacatcattaagagcatgcctggtgatcagtgaggatgcaatgccattctaaatcttggaaaattgttccattttgtttttctatgagaagaatagctagtgtagatgatcattttactttattgtggtgactagcaagataattttgatgttattggtatcaattttttctgtcttgagctagtgattttattttaatggacagtgatttgttgtgttatgtttttaagttctgagttagtgtttgaatgcaccaagttgaatcctatacaaaaccagttgcacagccttgaaatttggctggtcaaatcttgtttggagttaggtacattttattgttgtatgtatgatgcaaaaatgttttggatagtgg

SEQ ID NO: 1243 - DNA, 598 bp, Capsicum annuum
cattatttttattagcaaaaaaaccaaaaccgccgcattcccactagcagagccaccatggttgccgccaagaaaaccaagaagacccatgagagcattaacaataggttggctctggtgatgaagagtggaaaatatactttgggttataagactgttcttaagacccttaggaactctaaaggaaaacttatcatcattgccaacaactgccctccactcaggaagtccgagatagagtattacgctatgttggcaaaggttggagtccaccactacaatggaaacaatgtagatttggggacggcttgtggtaaatactacagggtctgttgcctcagcatcatcgatccaggtgattcggacatcattaagagcatgcctggtgatcagtgaggatgcaatgccattctaaatcttggaaaattgttccattttgtttttctatgagaagaatagctagtgtagatgatcattttactttattgtggtgactagcaagataattttgatgttattggtatcaattttttctgtcttgagctagtgattttattttaatggacagtgatttgttgtgttatgtttttaagttctg

SEQ ID NO: 1244 - DNA, 548 bp, Phalaenopsis aphrodite
ttttgttgctctgagcgaattagcacggccatggcgcccgtcaagaaggcgaagaagtctacggagagcattaacaataggctggccctggtaatgaagagtggaaagtatacgctcggttacaagaccgttctcagatctcttagaaattcgaaagggaagttggtaataattgctaacaactgccctccactccgcaagtctgagattgaatattatgcaatgcttggaaaggttggggttcatcattttaatggaaataatgtcgacctcggtactgcttgcggtaaatatttccgagtatgctgtctcagcattatcgatcctggcgactctgacataataaagtcactcccgggtgatcattgagatgtttctggtgtggaggttgggctgtcttggtttgaattatataggattatttgtttggatggctgagctttggatgattttgttgttgttttccatttagattttgacatgtacttttgctatggaattctgttatcattgaattttaaattttaatgtttttatcttgatgatgg

SEQ ID NO: 1245 - DNA, 616 bp, Plantago ovata
aggagttctaggttttcagagaagatcacttgtcacttccagctgccgcaaaacctagcaacttgaaggcgaggcgacgaaggagaaccaatggcgccgacgaagaagaccaagaagactcatgagagcatcaacaacaggctggctctcgtcatgaagagtggcaagtacactcttggttacaagactgtgctcaagtctctccgcagctcaaaaggaaaattgatcctgatctcgaacaattgtccacctttgaggaaatcggaaatcgagtattatgcaatgctcgccaaaattggtgtccaccattattctggaaataatgtggatttgggaactgcctgcggtaagtttcaccgcgtctcatgcctcagcatcatcgacccaggtgactcggacattatcaagacattgcctggcgataactagacctgatagttttgttatctgtggcattttgaattcttcaatgttttcctattttcagatgtagtactttgtgagagtgattaaagttttgatctttaatgtttgtgttagacatattaactctcaatctgaatacattttatctcgcaattctatagatctaatctcaaaatgtgtctggttgctc

SEQ ID NO: 1246 - DNA, 633 bp, Solanum tuberosum
aaaaagaaaaaaaaaatcacaattcaccgctcgtcgacgcatttgcagaagcagagccaccatggttgccgccaagaaaactaagaagacccatgagagcattaacaataggcttgctctagttatgaagagcggcaagtacactttgggttataagactgttcttaagactcttagaaactccaaaggaaagcttattatcattgccaacaactgccctcctctcaggaagtctgagattgagtattatgctatgttggccaaggttggagtccaccactacaacggaaacaatgtagacttggggacggcttgtggtaaatactacagggtctgttgcctcagcatcatcgatccaggtgattctgacatcattaagagcattcctggtgatcagtgaggcttgcaattctgaatcttggaaaattgtccattttgtttttttttttcttatgagaagaatagctagtgtagatgataattctactttatttgtgatgactgtcaagataattttgatggtattggaattattttttctgtcttgagctagtaattttactttttatgaacaatgatttgttgtgccatattatacacttctaaattctgagttaaaaaaaaaaaaaaaaa

SEQ ID NO: 1247 - DNA, 619 bp, Solanum phureja
aaaaaaagaaaaaaaaaaatcacaattcaccgctcgtcgacgcatttgcagaagcagagccaccatggttgccgccaagaaaactaagaagacccatgagagcattaacaataggcttgctctagttatgaagagcggcaagtacactttgggttataagactgttcttaagactcttagaaactccaaaggaaagcttattatcattgccaacaactgccctcctctcaggaagtctgagattgagtattatgctatgttggccaaggttggagtccaccactacaacggaaacaatgtagacttggggacggcttgtggtaaatactacagggtctgttgcctcagcatcatcgatccaggtgattctgacatcattaagagcattcctggtgatcagtgaggcttgcaattctgaatcttggaaaattgtccattttgtttttttttttcttatgagaagaatagctagtgtagatgataattctactttatttgtgatgactgtcaagataattttgatggtattggaattattttttctgtcttgagctagtaattttactttttatgaacaatgatttgttgtgccatattatacacttctaaattctgagtt

SEQ ID NO: 1248 - DNA, 678 bp, Glycine max
accctagtggcagtgaccaaactccatttctcactcgccgtcgtctcttccgtctagggtttctcctcttcacaaaaatggttgccgcaaaaaaaactaagaagacccatgagagcatcaacaacaggctcgctctcgtcatgaagagtggcaaattcaccctcggttacaagaccgttctcaaatctcttaggagctccaaagggaaattgattatcattgctaacaactgcccccctttgaggaagtcagagattgaatactatgctatgttggcaaaggttggggttcatcattacaatgggaacaatgtggatttgggcactgcatgtggcaaatattacagagtgtgctgccttagcattattgatcctggtgattcggatatcatcaagacactgcctggtgaacagtaaagtattcttgaagttccttgcttgttattttctggttttagttgttgattcaaactttgaaagaatatcttgttgagttgtagacattggtgtaaggtgcaaggtttttgggtattccagctgagcatctagtaattttgacttcaaatttttcatgatgtttcattgtgccaatttctagagatgatatgattatattttggtcgcgcttgctgttaatgcctgtgttatattttgaaagaatgtcggtgttcgcttgcaa

SEQ ID NO: 1249 - DNA, 656 bp, Glycine max
accctaataacgtgtagtgccagacgcagtgactaaaccaaacctctcactcgccgtcgtagggtttctcctttcgtttagcaacaacaacaatggttgcagccaagaaaaccaagaagacccatgagagcatcaacaacaggctcgctcttgtcatgaagagtggaaaattcaccctcggttacaagacggttctcaaatcacttaggagctccaaagggaaattgattatcattgctaacaactgcccccctttgaggaaatcagagattgaatactatgctatgttggccaaggttggagttcatcattacaatgggaacaatgtggatttgggcactgcatgtggaaaatattacagagtgtgctgccttagcattattgatcctggtgattctgatatcatcaagacactacctggcgaacagtaaagtattatttgaagttccttgcttgatattttctgtttttagttgattcaagacattgttgaaagaatatctgatttaagttgtacactttggtgtaaggtgcatggattttgggtattctagctgagcatcaaatgttttttaccttgcaaattttttcatgatgtttcattatgccaatttctatagagatgatataattatagtttgatcgcgcttgctgtt

SEQ ID NO: 1250 - DNA, 686 bp, Solanum lycopersicum
aaaaccctaattttgttcttcaaatttcactctgtagtgctctgtacttgcaaaaaaaaaaaaaaaaaaaaattcacaattcaccgctcgtcgacgcatttgcagaagcagagccaccatggttgccgccaagaaaactaagaagacccatgagagcattaacaataggcttgctctagttatgaagagcggcaagtatactttgggttataagactgttcttaagactcttagaaactccaaaggaaagcttattatcattgccaacaactgccctcctctcaggaagtctgagattgagtattatgctatgttggcaaaggttggagtccaccactacaacggaaacaatgtagacttggggacggcttgtggtaaatactacagggtctgttgcctcagcatcattgatccaggtgattctgatatcattaagagcatgcctggtgaccagtgaggcttgcaattctgaatcttggaaaattgttcattttgtttttcttttttcctatgagaagaatagctagtgtagatgataattctactttatttgtgatgactgtcaagataattttgatggtattggaattattttttctgtctttgagctagtaattttactttttatgaacaacctctaaatttggctggtcaaaatctttgttggagtttaagtttgcaaaatt

SEQ ID NO: 1251 - DNA, 683 bp, Carpinus betulus
gctccttcgctgccatttttgggttccgtcgccgcattggaacgctttttgctcttcgagctgtgctgtgctaagttgtgctgtaattctctcatccaaagcacccagccatggtggccgccaagaagaccaagaagactcatgagagcatcaacaataggctcgctctcgtcatgaagagtggcaagtacaccttgggatacaagaccgttctcaagtccctgaggagctccaaaggaaagctggtcatcattgccaacaactgccctcctctacggaagtctgagatagagtattacgctatgttagcgaaaattggtgttcaccactacaacggaaacaatgttgatttggggactgcttgtggaaaatacttcagagtatgctgcctcagcattattgatcctggtgattctgatatcatcaagagcatgcctgattattaagccatgaattgtatcaggtctagattttggtgtttttatcttgtttttcaaatcgagaggaggtatgttttgcttcaaggcaagcgtttatgttgttgacagaaatgcttcattagagaccaagctctgctttgatggtatttttggtagtgctgtgttggaccaaatgtctttatattctagtttgtatgcgtaccctaagatttggatcttaatctcttatctggaaagtgtttt

SEQ ID NO: 1252 - DNA, 683 bp, Cucumis melo
ttcatttggcgagtgcagcttcgagtcttcaatcatggtggccgctaagaagaccaagaagacccatgagagcatcaacaacagactcgctctcgtcatgaagagtgggaaatacaccttgggatacaaaaccgtcctcaaaaccttgaggaactctaaaggtaagctgatcatcattgccaacaactgccctccactccgaaagtccgagatcgaatactatgcaatgttggccaaggttggagttcaccattacaatgggagcaatgttgaccttggaaccgcatgtggcaaatactacagagtatgctgcctcagcattatcgaccctggtgattcggatattatcaagagcatgcccgaaagttagatttcaacttcgtgttaagatcatagaattttgtttcagagtttcttcttgattttgggttcaatgtagtgatgtgtttttgcttgtgaggcatgatattattgaacaaatggtttcattataaaccctttttttattgttcaagatcatcttattccaaaaaactttcgtatcaacctttgtgttatattagcctcgtaacagttaaccgtacaagcatgttacctccttatattttatcgttctattgttatattagtctctatttaatatgttatgttcgaacaaattaataaatttggaagtctttcat

SEQ ID NO: 1253 - DNA, 602 bp, Ipomoea batatas
atcttcatagcaccaaaccctaatatcccctttcccccaaccctagtcgcggcagatctcttcgcttctgtagtctttgaaaatggtgaccaccggaaagaagactaagaagacccatgagagcattaacaacaggttggctctggtgatgaagagcggaaagtatacacttgggtacaagactgttctcaagaccctcaggagctctaaaggaaagctcatattgatttccaacaattgcccacctctgaggaagtctgagattgagtactatgctatgcttgctaagattggggttcaccattacaatggaaacaatgttgatctgggtactgcttgcggaaagtatttccgtgtgtcttgccttagcatcgttgatccaggtgattcagacatcatcaagtctctgcccagcgagcagtaatagatcaataccatccagcaaagtagaaccatgttttccaggattatgttattccccaactattgttctttaataccaagaactggaagatcttttgaatgcttattatcgacgaattttgtttctttcttttcatgtttgagtttgagacaggataatagatgaattgagtattata

SEQ ID NO: 1254 - DNA, 550 bp, Vinca minor
gttttctctccctcgccgacgccgtagcctactccacctttctccgtcatggcggccaccggcaaaaaagtcaagaagactcatgagagcatcaacaacagattgcaacttgtgatgaagagtggaaaatacactcttggttacaagactgtactcaagaccctcaggagctctaaaggaaagctgattttgatctcaaacaattgcccaccgttgaggaaatctgagatcgagtattacgctatgcttgctaaagttggtgtccatcattacagtggaaacaatgttgatcttggaacagcatgcggaaagtattttagagtttcctgcctcagtgtcatcgatccaggtgattctgatatcatcaagtctttgcccggtgatcagtgagtttgtcgactggtgatatgatgaacgagtcgaacaatttttcttaggttgtgctaatttttttgtttaatgttaaaggaagcttattatgttctctcttagtctcactatttgtacaagatacagatatttcgtcattttgtgtgtttcaaggagagca

SEQ ID NO: 1255 - DNA, 786 bp, Vinca minor
aaacccttaaggcctcctcgttcattatcatcacccgccgccgcagcagcagccatcccgttctccaccttccgccatggccaccaccggcaaaaaagtcaagaagactcatgaaagcatcaataacagattgcaacttgtgatgaagagtggaaaatacactcttggttacaaaactgtgctcaagaccctcaggagctctaaaggaaagctgattttgatctcaaacaactgtcctcctttgaggaagtcggagatcgagtactacgctatgcttgctaaagtgggtgtccatcattacagtggaaacaatgttgatcttggtacagcatgtgggaagtatttcagagtttcctgcctcagcgtcattgatccaggtgattcggatatcatcaagtctttgcccggagatcagtgagtttgtcgactggtgatatagtgaatgcgtggaactatttttcttaggtcatgctaaaaaaattgtttaatgttaaaggaaccttatatcatgttgtttctgtcttggtcccaaagttgtgcaagattaaaaatttcgccattttgtatgtttctgggagcattgaatttattttaagtaccgcacaattaattgaatttctactaccatcactaagctaagcatgttgtttgagaagcctgtgatcaaaaatttgcaataatgggtcgtttgacaacttgattaaaaagaacatggatttttgttctgtgtttcgttgtctaaattagagtagtctagtagttgtgtatttgataatttacaagatc

SEQ ID NO: 1256 - DNA, 549 bp, Vinca minor
atctcccgccgacgctgcctctccgttctctaccgttcgccatggccaccaccggcaaaaaagttaagaagacacatgagagcatcaataacagattgcaacttgtgatgaagagtggaaaatacactcttggttacaagactgttctcaagaccctcaggagctctaaaggaaagctgattttgatctcaaacaattgtccaccattgaggaagtccgagatcgagtattatgccatgcttgctaaagttggtgtccatcattacagtggaaacaacgttgatcttggaacagcatgtggaaagtatttcagagtctcctgtcttagcgtcatcgatcccggtgattcggatatcatcaagtctttgccaggagatcagtgagtttgtcaattggtgatatagtgatcgattggaacaattttccttaggtttatgcttcattttttgtttgatgttaaacgaacctcattatgttgtctctgtcttagtctcgctacttgtacgagatcgaaatatttcaccattttgtgtgttttcagggacagcg

SEQ ID NO: 1257 - DNA, 670 bp, Musa acuminata
agggcgtcattcggagagatctccaagcttcgccgctgcctccgcctctcgccgcccgaacacaccactgcgcaccaatttccttcaccaatggcgcccgttaagaaggcgaagaagagtacggagagcatcaacaacaggctcgctctcgtgatgaagagtgggaagtacactctcggctacaagaccgtcctgagatctcttcggagctctaaagccaagttggttatgatttcaaacaactgtcctccgctccgcaagtccgagattgagtactatgcgatgttggcaaaggtgggagtacatcattttagcggaagtaatgtcgacctcggaactgcatgtggtaaatatttccgtgtttgctgcctcagcattattgaccctggtgactctgatatcatcaagagcatgcctggagagcagtgagaggagagcgcatgtgttttgggaattcaatgtggttcgcggcacttttctactttttagttgattaaattttgactccagtttgttgggattttatcgccactctagatttataaccttctataatagcagttggttgcctacttgaatatcttgatgctcctgatttatgaaattttggtgatgaatatttaaattccaatgaatctgaattaggtttcacaaattttcaacctctagc

SEQ ID NO: 1258 - DNA, 754 bp, Vaccinium corymbosum
cgttacggccggggaggacacccgaacctctcgtatagcatctctttgctttttggccgccgcaagggcttggggttcgttagggtttccgatacaacgccgaagggcttcagaagctgcaacaatggcggccggaaagaaaacgaagaagactcatgagagtatcaacaacaggctcgctctcgtcatgaagagcggcaaattcaccttggggtacaaaaccgtgctcaagaccctcagaagctccaaaggtaagctgataataatatccaacaattgcccacctttgcggaagtctgagatcgagtactatgcgatgctttcgaaggtcggggttcaccattacaatggaaataacgttgatctgggaacagcatgtggaaaatatttccgtgtctcatgcctaagcattattgatccaggtgattcggatatcatcaagacgctgcctggagaccagtgaacggctgcatcctcaatctggtgttcaagcggatatatctattttcttttagggttccggtgttactatttcgttctctcttttaatccgtcattttgtccttgtgttaaggagtattggttttggtttgtatgatgcctgtggaagacccaattatatgtagctgtggatgtttttctttgggaagttttgagccttgaggcaatacaatatggttcactaggtaatcgagtcgagagcttgtgtttgacaattggtattctctagttcaatcagtaatgcgatatactt

SEQ ID NO: 1259 - DNA, 736 bp, Gossypium hirsutum
ataagaggtaattttccttggcccaaccctagaaaccttcagtcaggcatcgagatattggtttaggttttagggtttcttcgcttcttgtggtgaaccagttgtagctgccgctgtcacttccccgctcccatctcaccgaagctctcccatcgacgacaatggttgccgccaagaagaccaagaagactcatgagagcattaacaacagattggctctcgttatgaagagtgggaaatacactttgggttacaaaactgttctcaagtctcttagaagctccaaaggtaagttgattatcattgccaacaactgccctcctcttaggaagtcggagatcgagtattatgccatgttgtgcaaggttggagttcaccactacaatggaaacaacgtagatttgggaactgcttgtggcaaatatttcagagtgtgctgcctcagcattattgaccctggtgactctgatattattaagagcatgcctggtgatcactaagctatggggggataacttcctaggtgctgatttagtttcaatttttgggtgtctaaaaacattgttgatgttaaagacaaacttattctgaaattcagaactttctttgtagtgtttgtgggacagagatgttattggcccatgtattagtgaatttttggagtggatttcgtttaaaaatctttctttcaacattttttatggtagattataaattaatgctcctttagaaaaga

SEQ ID NO: 1260 - DNA, 850 bp, Gossypium raimondii
tttgggtcataagaggtaattttccttggcccaaccctagaaaccttcagtcaggcatcgatatattggtttaggttttagggtttcttcgcttcttgtggtgaaccagttgtagctgccgctgtcacttccccgctcccatctcaccgaagctctcccatcgacgacaatggttgccgccaagaagaccaagaagactcatgagagcattaacaacagattggctctcgttatgaagagtgggaaatacactttgggttacaaaactgttctcaagtctcttagaagctccaaaggtaagttgattatcattgccaacaactgccctcctcttaggaagtcggagattgagtattatgccatgttgtgcaaggttggagttcaccactacaatggaaacaacgtagacttgggcactgcttgcggcaaatactttagagtgtgctgcctcagcattattgaccctggtgactctgatattataaagagcatgcccggtgatcactaagctatggggggataacttcctaggtgctgatttagtttcaatttttgggtgtctaaaaacattgttgatgttaaagacaaacttattctgaaattcagaactttctttgtagtgtttgtgggacagagatgttattggcccatgtattagtgaatttttggagtggatttcgtttaaaaatctttctttcaacattttttatggtagattataaattaatgctcctttagaaaagctaagaagttgaggaggacatggtaacttgtgtgatgaagtgaacatttttattctgaatatggaaatataaaatacataaatttgatctaataccaaaaagaaaaa

SEQ ID NO: 1261 - DNA, 638 bp, Gossypium raimondii
gcatgtggtgaaactgaaccatttgtagctgccgcagttcccttctcgccgaagatctcccgtcctccgacgacaatggttgccgccaagaagaccaagaagacccatgagagcattaacaacagattggctctcgttatgaaaagtgggaaatacactttaggttacaaaactgttctcaaatctctcagaagctccaaaggtaagttgattattattgccaacaactgccctcctcttaggaagtcggagatcgagtattatgccatgttgtgcaaagttggagttcaccactacaatggaaacaacgtagatttgggaactgcttgtggcaaatatttcagagtgtgctgcctcagcattattgaccctggtgactctgatattattaagagcatgcctggtgatcactaagctacagcggatgacatatcttcataggttttgttctgatatagtttcttctattttttgggtagtttgaaacattaatgatactctgaaattcagaactttctttgttgccatcttgatgttagacttgtggtgatgatattattggtctatgttctggaaattttgtgagtcaatttcgttttaagactattgctatctttgtattttttctggtttacttc

SEQ ID NO: 1262 - DNA, 539 bp, Allium cepa
ctagcacgatataaattccaacgaaattctctctcttttgcagccgccatcttcatttttgtttcagggttttccatcgcctatctcctgtcatctgctccaatggcgcccataaagaaaaccaagaagacaacggagagcataaataatagattagctctggtaatgaagagtggaaagtacactctaggattcaaaaccgtgcttagatctctcagaagctccaaagcaaagttggttatcatcgcaaacaactgtcctcccctacgcaggtctttaattgaatattatgctatgttggccaaggttggagttcatcattttaatggaaacaatgttgatcttggaactgcatgtggaaagtattttcgtgtttgctgcctgagcattattgatccaggtgattcggacatcattaagactcttccaggagaccagtgagaatgattgatatgttattttcgtttgtttaaaacttaatttctattgtgtttgtccttatactatttatttttgtattcttggttcgtagtatttct

SEQ ID NO: 1263 - DNA, 616 bp, Allium cepa
ctagcacgatataaattccaacgaattctctctcttttgcagccgccatcttcatttttgtttcagggttttccatcgcctatctcctgtcatctgctccaatggcgcccataaagaaaaccaagaagacaacggagagcataaataatagattagctctggtaatgaagagtggaaagtacactctaggattcaaaaccgtgcttagatctctcagaagctccaaagcaaagttggttatcatcgcaaacaactgtcctcccctacgcaggtctttaattgaatattatgctatgttggccaaggttggagttcatcattttaatggaaacaatgttgatcttggaactgcatgtggaaagtattttcgtgtttgctgcctgagcattattgatccaggtgattcggacatcattaagactcttccaggagaccagtgagaatgattgatatgttattttcgtttgtttaaaactatttcatgtgtttgtcctatacattatttttgatcttggttcgagtatttctagtgggaattgttctgttttggttatgatattttgtatgcgctgttttattgatgttatgttatctaagtgcactttgcatggagttg

SEQ ID NO: 1264 - DNA, 672 bp, Papaver somniferum
cttcttctattctaggttttctctcactgccgtcgccagaaaactaaccatcgatctaaatctcttctcctccgtttctctgcaactaatcagcaaaaatggtggccgttaagaaaatgaagaagactcatgagagtattaacaacagacttgctcttgtgatgaagagtgggaaatacacccttggttacaaaacagttcttaggactctcagaagctccaaatcaaagctcattatcatctcaaacaattgtcctcctttaaggaaatctgagattgagtactatgctatgcttgctaaggttggagttcaccacttcaatggaaacaatgttgacttgggaacagcttgtggacgatactaccgtgtttcatgccttagcatcattgatccaggtgattctgacatcatcaaaacccttcctggtgaccagtaaagggcagaaagacctagtgtatgagtcactagattatgattttgcttgttcggttgtctctttttgtatctctactctatttagtttaagttgagttttagttgaattcaattaaccttttttaggtttgtttcaaacttgtaatgatggaagaacacattaatacttattttgggagatgatagtatgcctttgcactttatgaatgccgtatgacttgtgttttaattcgcta

SEQ ID NO: 1265 - DNA, 700 bp, Papaver somniferum
aatctcttctttctgcctcctctctggtctccactgccgtcttcggagaaaactcaacaatctctaaaaatggtggccgttaagaaaatgaagaagactcatgagagtattaacaacagacttgctcttgtgatgaagagtgggaaatacactcttggttacaaaactgttcttagaactctcagaagctccaaatcaaagcttataatcatctcaaacaattgtccacctttgaggaaatctgagattgagtactatgctatgcttgctaaagttggagttcaccattttaatggaaacaatgtcgacttgggaacagcttgtggacgatactaccgtgtttcatgccttagtatcattgatccaggtgattctgatatcatcaaaacccttcctggtgaccagtgagtgaagaaagctagctgatccaatcattagatccagaattttctttgtttgggtcgactctttttctatctagtttgagttgagttatcgtgaaattgaatcaggctatttcaaatttgtaagtccgaaagaacacattaatactgaatgttttttggtagctgaatctgaaagtatgttgagacactattgttgcgtactgcccttgctctaaaaatgtgattgtcatttttctagtcattggtacttctgccgaaattgtcgtggctgcttataaattgtgtcatttttt

SEQ ID NO: 1266 - DNA, 667 bp, Papaver somniferum
ttcttcttctattattctagggtttctctcactgccgtcgccagaaaactacctaacgatctaaatctcatctcctccgtttctctgcaactaatcagcaaaaatggtggccgtgaagaaaatgaagaagactcatgagagtattaacaacagacttgctcttgtgatgaagagtgggaagtacacccttggttacaaaacagttcttaggactctcagaagctccaaatcaaagctcattattatctcaaacaattgtccccctttgaggaaatctgagattgagtactatgctatgcttgccaaggttggagttcaccacttcaatggaaacaatgttgacttgggaacagcttgtggacgatactaccgtgtttcatgccttagcatcattgatccaggtgattctgacatcatcaagacccttcctggtgaccagtaaagtgcagaaagacctagtgtattgaatcactagattaagattttgcttttttgcttgtctctttttgtatctctactctatttagtttcagtcgagttatagttgaattcaattaacctctttaggtttcttttaaatttgtaatgatggaaggacacataaatacttaatgttttgggagatgaaagtttgcacacttttatgaatgccgtattagactaaaaa

SEQ ID NO: 1267 - DNA, 681 bp, Papaver somniferum
ctcttggattcactgctgtgccgtattcagagaaaactaacaatctctaaacatggtggtcgcaaagaaaatgaagaagactcatgagagtattaacaacagacttgctcttgtaatgaagagcgggaaatacacacttggttacaaaactgtccttaggactctcagaagctccaaatcaaagcttataattatctcaaataattgtcctcctttgagaaaatctgagattgagtactatgctatgcttgctaaagttggagttcaccatttcaatggaaacaatgtcgacttgggaacagcttgtggacgatactaccgtgtgtcatgccttagtatcattgatccaggtgattctgatatcatcaaaacccttcctggtgatcagtaagcggagaaagctagtgtttccaacatttgaggttttctgtttctcccttatttagtttaagttgattcatagctgaatttaatcaaaagttggaggtctatttcaaatttgtaaggccagaagaagaatgaaatatacatcgaattttggtgaatgaaagtagctcttgtactttatgaatgtggtgtgagactattttgtgtttttctttctacatttaacctagaagtttccacaacattgcctactgccattgcttcaaaaatgcttaaatgtcactttcctggtca

SEQ ID NO: 1268 - DNA, 796 bp, Papaver somniferum
gttccattataaaccctaaaaccatattctgtatcatttcttttttccattatagattcgctgccggcttctgagaagtgacaatcgaaatctccatttccgtttctcttgaagtaagcaaagatggtggtcgcaaagaaaatgaagaagactcatgagagtattaacaacagacttgctcttgtgatgaagagtgggaagtacacccttggttacaaaacagtcctcaggactctcaggagctccaaatcaaagctcataattatctcaaacaactgtcctcccttgagaaaatctgagattgagtactatgctatgcttgccaaggttggagttcaccatttcaacgggaacaatgtcgacttgggaacagcttgtgggcgatactaccgtgtatcatgcctgagtatcatcgatccaggtgattctgatatcatcaaaactcttcctggtgaccagtaagcagagaaagctagggtatccattcacttgattcagattttccttttggtcatctcgttttctccttttcccctatttagcttaagttgagttacagttgaattgaatcgaatcaaatcaaactttgtaggtttatttgtaagaacggaagagatacaatggttttggaaagtgaaagtatgctcttgcactttatgaatgtcgtatgagactatctcttttgtttgtgtttgtccacttgagcctagaaatttccaaaattgccagggtcattttgtcattagtactttctccaaaattgttgctgttaacattacaaaaaaaaactaaaagg

SEQ ID NO: 1269 - DNA, 817 bp, Papaver somniferum
tttgctgccgtcttcagagagaactaactccgattctctagaagcaagcagcaaagatggtgatggcaaagaaaatgaagaagactcatgagagtattaacaacagacttgctcttgtgatgaagagtgggaagtacacccttggttacaaaactgtccttaggactctcagaagctccaaatcgaagctcattattatctcaaacaattgtccacctttgaggaaatctgagattgagtactatgctatgcttgccaaggttggagttcaccatttcaatggaaacaatgtcgacttgggaacagcttgtggacgatactaccgtgtttcatgccttagtatcattgatccaggtgattctgatatcatcaaaacccttcctggtgaccagtaagtgcagaaagctagtgtatccaatcactaaatcagattttccttgttgcaccgtctcttttgtatctctactatatctagtttaagttgagttatagtttaaatggatcaaactttagaggtttatatcaaatttgtaaggtcagaaggatgcataaatacttaatgtttaggtaaatgaaagtatgccttcgcactttatgaatgtcgtactgtgttttattttctccatcttagcctaaaagtttccacaacattgcctacctgttattgtgaaacatttgcatgtagcttcacatttgttgtgcactcgtagtcgtttttaattcatgaatttagattttactcaagatttaacttacaccacttgagctaatgatttaactttgcctacaatatgtatcaatgaagttacatttgttt

SEQ ID NO: 1270 - DNA, 600 bp, Papaver somniferum
gggttttctttctttcaatctcttctttctgcctcctctctggtctccactgccgtcttcggagaaaactcaacaatctctaaaaatggtggccgttaagaaaatgaagaagactcatgagagtattaacaacagacttgctcttgtgatgaagagtgggaaatacactcttggttacaaaactgttcttagaactctcagaagctccaaatcaaagcttataatcatctcaaacaattgtccacctttgaggaaatctgagattgagtactatgctatgcttgctaaagttggagttcaccattttaatggaaacaatgtcgacttgggaacagcttgtggacgatactaccgtgtttcatgccttagtatcattgatccaggtgattctgatatcataaaaacccttcccggtgaccagtaagcgaagaaagctagtggatccaatcaatagatccagaatttttcttgtttgggttgactctttttctatctagtatgagttgagttatagtgaaattgaatcaggctatttcaaatttgtaagtccgaaagaacacattaatactgaatgttttttggtagctgaatctgaaagta

SEQ ID NO: 1271 - DNA, 659 bp, Papaver somniferum
tcttccctcagtgctgccgtcgccagaaaactaactagcgatctaaatctcttcgcctccgtttctctgcaactaatcagcaaaaatggtggccgttaagaaaatgaagaagactcatgagagtattaacaacagacttgctcttgtgatgaagagtgggaagtacacccttggttacaaaacagttcttaggactctcagaagctccaaatcaaagctcattattatctcaaacaattgtcctcctttgaggaaatctgagattgagtactatgctatgcttgctaaggttggagttcaccacttcaatggaaacaatgttgacttgggaacagcttgtggacgatactaccgtgtttcatgccttagcatcattgatccaggtgattctgacatcatcaaaacccttcctggtgaccagtaaagtgcagaaagacctagtgtattgaatcactagattaagattttgcttgttcgctgtctctttttgtatctctactctatttagtttcagttgagttatagttgaattcaattaaccttttttaggtttgttttaaacttgtaatgatggaagaacacattaatacttattttgggagatgatagtatgccttagcactttatgaatgctgtatgactattttgtgttttcattc

SEQ ID NO: 1272 - DNA, 339 bp, Aquilegia formosa
atggtggccgccaagaaaaccaagaagactcatgagagcattaacaacagactcgctcttgtgatgaagagtgggaagtacactcttgggtacaaaactgttcttgattcactcagaagctcgaaaggaaaattgatcattattgctaacaattgccctcctttgaggaaatctgagattgagtactatgttatgcttgcaaaggttggagtccaccatttcaatggaaacaatgtcgatttggggacagcttgtggtaaatatttccgagtgccatgcctcagcattattgatcctggtgattctgatatcatcaaaacattgcctggtgaccattaa

SEQ ID NO: 1273 - DNA, 637 bp, Musa acuminata
cattcggaagagatctccaacccttcgccgttgcgtccgcctctcgccgcccgatcacaccactgcgcaccaatttccttcgccaatggcgcccgttaagaaggcgaagaagagtacggagagcatcaacaacaggcttgctctcgtgatgaagagtggcaagtacactctcggctacaagaccgtcctaagatctcttcggagctctaaagccaagttggttatgatttcaaacaactgtcctccgctccgcaagtccgagattgagtactatgcgatgttggcaaaggtgggagtacatcattttagcggaagtaacgtcgaccttggaactgcatgtggtaaatatttccgtgtttgctgcctcagcattattgaccctggtgactctgatatcatcaagagcatgcctggagagcagtgagagggagagcgcatgtgttatgggaattcaatgtggttcgccgcacttttctactttttagttgattatattttggctccagtttgttgggattttatcgccactctagatttataaccttctatagtagcagttggttgcctacttgaatatcttgatgctactgatttatgaaattttggtgatgaatatttaaattccaatgaatctgaa

SEQ ID NO: 1274 - DNA, 659 bp, Manihot esculenta
tgtgttgagcgaactttaatattcagtggattccctccttgaaagcacccaacagcaaccatggtggccgccaagaagaccaagaagactcatgagagtatcaacaacaggctggctttggttatgaagagtggaaaatacactttgggttacaagactgtactcaaatctctcagaaactctaaagggaagctgatcatcattgccaacaactgtcctccccttaggaagtctgagatagagtactatgcaatgttggctaaagttggagtccaccattacaatggcaacaatgtagacttggggactgcctgtggcaaatatttcagggtgtgctgcctgagcatcattgatccaggtgattctgatatcattaaaagcatgcccggtgaccactgataagaccatgaggaatagcaattgtccctaggttttggtcatgtttcgtcttgctgggattgtgggttttcgattgcaaacgatcatattattaaacaaaccattgtggaacttgttgagctcctatttatagtcatttcagtaaatgtttaattagttgaaatgatgacctaaaatgaatttcgtggttacaaaaatgctgaggaccttcatttttgtttactgtcgcgattttatttattttacttctctgtttttgc

SEQ ID NO: 1275 - DNA, 891 bp, Catharanthus roseus
gaatattcaaagcgggaaataattgggctcctattcggcccaaagggaagtgccaaatctagggttcaaagcaagacccttttctccgaccgtaatattgagaaatattcaaagctagggttcttcgtttcgcctcctcctctcatctctctgttctgacgtcgcaggttcgccaccggaagctccgccgacgccatggccccgggaaagaaagtcaagaagacccatgagagcatcaacaataggttggctctggtgatgaagagtggaaaatacactctgggttacaagaccgtgctcaagacccttagaaattctaaaggtaagttgattttgatttcaaacaactgcccaccattgaggaagtcagagattgaatactatgctatgcttgctaaggttggagtacaccactataatggaaacaacgtggatctaggaacagcatgtggaaagtacttccgtgtatcttgccttagcatcgtcgaccctggtgattctgatatcatcaaatctttgcccggagatcaatgagtgatgataatctgcaaatgcccctcaattttttaggccatggacctgtcacttgttttgttgtcattaagaggatttagttttacttgtctgcacccataatcagaaatgtgaactttagtttgtctcatgtaaaagatccatatatttaaggtttgtgcttctatttgatatccttgaatttgagatagggacaacagaatggagatgcttctgttctgcagttaacatgaaaattttgggtttgcagttagtttcatttttttctatactgtgaacctttatgtttttcatccagctcattacgccatgaacatgattactgtcaaattgacaatttattaaaattaaaatttt

SEQ ID NO: 1276 - DNA, 563 bp, Chelidonium majus
agttctagggtttcaaactccaaactctcataaaccctaatcactgtgtaggattctttagaagtagcgaagatggtggcggtgaagaaaacgaagaagactcatgagagcatcaacaacaggctcgctcttgtgatgaagagtgggaagtatacgctcggatacaaaactgttctcaggaccctaagaagctccaaatcaaaactgatcatcatttcaaacaattgtccacctctgcgaaaatctgaaatcgagtactatgctatgcttgcaaaggttggggttcaccattttaatggaaacaatgttgacttgggaacagcttgtggtcggtactatcgtgtttcatgccttagcattgtagatccaggtgattctgatatcatcaaaactcttcctggtgaccagtgagcagtggaagtgttttttcaaagtaggattcgttttctcctttccgtggttgttttgacagtttagtttgaggcagagccctagtttaatttgcatttttgaaccgagatccatgctgaatgggtcgtatatgaaatatgcttttgcacttt

SEQ ID NO: 1277 - DNA, 530 bp, Cirsium arvense
ttctctcaacgaaactactctccaccctttgattctcccttcgcttcttagcaaccatggtgtctggaaagaagacgaagaagactcatgagagcatcaacaatcggctggctctcgtgatgaagagtggaaagtacactcttggttacaaaactgtgcttgaatctctcaggagctccaaaggtaagttgatcatcatatccaacaattgtccgcccttgagaaaatctgagatcgagtactatgccatgctcgccaaaattggggttcatcattataacggaaacaatgtggatttgggaacagcatgtggaaagtacttcagagtgtcatgcctcagcattgttgatcctggtgattctgatatcatcaagactctccctggagacaactgaaaaaacccaaattgaatgcttgatccccttacggaattagtgtctcgaatttaattttctgttattatgaacttgatgaatcttttgtattagcagtttgatcttacagagttatggaaggatataattattcaa

SEQ ID NO: 1278 - DNA, 574 bp, Cucurbita pepo
tcgtggaaaagcttcagaacaggaattttgtacaccttttgagaagcgacaatggcgccggcgaagaagactaagaagactcatgagagtattaacaacaggcttgcccttgtgatgaagagcggcaagtacactttggggtacaaaaccgtccttcgcactatccgcagctccaaagggaagcttattattctatcgaacaactgcccgcccctgcgtaaatccgagattgagtactacgcaatgcttgctaaagttggggttcaccactacaacggaagcaatgttgatcttggaactgcttgtggcaagtatttccgtgtatcctgccttagcattattgatccaggtgattctgatattatcaaatcgcttcccagtgagcagtgatgctacccatcatttagaacgatgtattcaatgtggtaccaccttttctcttcagtaaacggtagaattgcatctttttcaatgtccttagcatagcccttcttaatttctgcactttaatcttttacattgatggccagattttgtcattgacttcgaggttttgtttaattgacatggttga

SEQ ID NO: 1279 - DNA, 886 bp, Eucalyptus grandis
ccattacggccgagggtttacactcctctcctcgctcgccgctctctctccgtctccacagctttgggcagcgaccagcgaggagcaacaatggtggcctcgaagaagaccaagaagacccatgagagcatcaataacaggctcgctctcgtgatgaagagcgggaagtacaccctggggtacaagacggtcctcaagaccttgaggaactccaaaggtaagctggtcatcattgcgaacaactgccctcctcttcgcaagtccgagatcgagtattacgccatgttggcgaaggttggagttcaccactacaatgggaacaatgtagacttgggcacagcttgtggaaaatatttccgggtatgctgcctcagcatcattgacccaggtgattcggatatcattaagagcatgcccggtgactcttaggctgtcaacgtcctgatgccatgagattttggtctagcattcgtagatttatgggtttgggcaaggagggtgcctcatgaaaagggcactttgctgttgacagggaaaatcttaaatatcaagctaatgtgagatgcagctactgtaacccatctttagttgtttcatttggcattgttctaagaattcatttttccaatactataaagagttgaaccttgtgctcgtgtttgtgtttctgaatcgctctgcatctcacatgatcaaagagagaacatctgttggcaacatatttaagctagagctttgctgatcagattgctgatgctcaatgattaaaagatctgttgatatgtgtggaacttttcagaaggccgtgtgattgtttcagttggtcctctatgcattgacatccttccagtgtttctaattgctgaatcttcaactttttttacaa

SEQ ID NO: 1280 - DNA, 564 bp, Fagopyrum esculentum
acttctccagccttcaagcacgacgacggagaactctcgtataggcaagcattcgcctaacgctcatctgactcgcaaccatggtcgccgccaagaagaccaagaagactcatgagagcatcaacaacagacttgccttggtgatgaagagtgggaaatacaccttgggctacaagaccgtgctcaagacattgagaagctctaaagccaagttggtaataatttccaacaactgcccacctctaaggaagtctgagatagagtattatgctatgttggcaaaggttggagttcaccattacaatgggaataatgttgatcttggaactgcctgtggaaagtactacagagtgtgctgtctcagcattattgacccaggtgattcggatattatcaagaacatgccaagcgaccactaaggagcaggctggagaaagtagttctcgaattgaaaccccgttttcgcattccttagcagttgtcatgagctttgttgcactcaattttgttgacatgatgaatgtaagttaacctgtgagaattgagattccttttatatttgag

SEQ ID NO: 1281 - DNA, 603 bp, Fagopyrum esculentum
agtgtttgcagccgttcatcacaaaaaaggggactgtccaaggtaagctgttgcttgaagctcatccagatcgcaaccatggtggccgccaagaagaccaagaagactcatgagagcatcaacaacaggctcgcccttgtgatgaagagtgggaagtacaccttgggctacaaaaccgttcttaagacactcaggagctctaaagcaaagttggtaataatctccaataactgcccaccactaaggaaatctgagatcgagtattatgctatgttggcaaaggttggagttcatcattacaacggaaacaacgttgatttggggactgcctgtggtaaatactacagggtctgctgcctcagcatcattgacccaggtgattctgatatcatcaagaacatgcccagtgaccactgaagagtaaaactaagaagaatccattgttgtttgaaactctttaccctcccttttatctttacgcattcaggaattctgctttagcaagttatttatgtttccaaatagaagattttgtgctctcagttttgatgccctgaacgttacttgtagaaattcccggtattggaatggagattgtctttt

SEQ ID NO: 1282 - DNA, 716 bp, Fagopyrum esculentum
gcctccaagcacgacgacggagaactctcgtataggcaagaaatcgcctaaagctcccccgactcgcaaccatggtcgccgccaagaagaccaagaagactcatgagagcattaacaacaggcttgcgttggtgatgaaaagtggaaaatacaccttgggctacaagaccgtgctcaagacattgagaagctctaaagccaagttggtaataatttccaacaactgcccacctctaaggaagtctgagatagagtattatgctatgttggcaaaggttggagttcaccattacaatgggaataacgttgatcttggaactgcctgtggaaagtactacagagtgtgctgcctcagcattattgacccaggtgattctgatatcatcaagaacatgccaagcgaccactaagaagcaggctggagaaagtatttatcgaattgaaaacccattttcgccttcgctgagcagttgtcattagctttgttgcactcaattttgttgacatcatgaatgtaacttgtgagattccctttttatttgagatgattttttggccattttgtttagcctagcttctgctgttatgaacttatgatacttaggtacgtttcctttggtgctgtgttatgattaatgacattgctaaatgctcagtagctcaccttgtacgcatgtctacaaggacatatcatataccaagttgtgcgtttccac

SEQ ID NO: 1283 - DNA, 652 bp, Fagopyrum esculentum
cagccgtccattacgaaaaaggggactctccaaggtaagctgttgcttgaagttcatccagatcgcaaccatggtggccgccaagaagaccaagaagactcatgagagcatcaacaataggctcgcccttgtgatgaagagtgggaagtacaccttgggctacaaaaccgtccttaagaccctcaggagctctaaagcgaagttggtaataatttccaataactgccctccactaaggaaatctgagatcgaatattatgctatgttggcaaaggttggagttcatcattacaacggaaacaacgttgatttggggactgcctgtggtaaatactacagggtctgctgcctcagcatcattgacccaggtgattccgatatcatcaagaacatgcccagtgaccactgaagagagttaactaagaagtggccattgttgttttaaactcttatcctctctctttttatctttacgcattcagtaattctgcgttagcaagtaatctatgtttccaaatagaagattttgtgctctcagttttgatgccatgaaagttacttgtagaaattccagtcttttaatggagattgttttttcaatcacgttgattacctggttgtatggtggaacaaactgttttttgagatactt

SEQ ID NO: 1284 - DNA, 589 bp, Zingiber officinale
  misc_feature (143)..(143): n is a, c, g, or t
  misc_feature (171)..(171): n is a, c, g, or t
  misc_feature (195)..(195): n is a, c, g, or t
  misc_feature (197)..(197): n is a, c, g, or t
  misc_feature (226)..(226): n is a, c, g, or t
  misc_feature (292)..(292): n is a, c, g, or t
  misc_feature (415)..(415): n is a, c, g, or t
  misc_feature (438)..(438): n is a, c, g, or t
  misc_feature (585)..(585): n is a, c, g, or t
atcattctatatcccgtcgggtcctccacactgcacgcggatctccttctgcaatggcgcccgtcaagaaatcgaagaagaatgccgagaacatcaacagtaggctagctcttgtgatgaagagcgggaagtacactcttggntacaaaacggtcctccgaacacttcggngctctaaagcaaagttgattatcntntcaaacaactgcccgccactccgcaagtntgagatcgagtactatgcaatgctggcgaaggttggagttcatcatttcagtggaaataacgttgnccttggaacagcatgtggaaaatatttccgagtttgctgcctcagcatcatcgatcctggcgactcagatatcatcaagagcatccctggggatcagtgagagaagtccataggattttgggngaaattacatcttttttcttagnggacaatttcctgtttgtttttcatcttgagttatctagtttgtggccaatcaactcaagtatcttgatgtagaatgcttttgaatatctttcatttcttatgattttcaaatattccttaattataagataagagaagatgcttcngctt

SEQ ID NO: 1285 - DNA, 833 bp, Vitis vinifera
attagggttgctatatggcatataaaccctagttgctcgcttgcggcaagtctctgtggctagggtttcctctctatctcgccgaaaaccccttcgtcctcattttctcagcagccaaacacaaagatggtggccggaaagaagaccaagaagactcatgagagcatcaacaacaggcttgccctcgtcatgaagagcggcaagtacacacttgggtacaagaccgtgctcaaatctctcagaagctcgaaaggaaaattgatcctcatttccaacaactgtccaccactgaggaaatctgagatcgagtactatgccatgcttgcaaaggttggcgttcaccacttcaatggaaacaatgttgacttgggaacagcatgtggcaagtatttccgtgtatcttgcctgagcattattgatccaggtgattctgatatcatcaagacactgcctggtgatcactaagacaactgagttgaatggatggctgcatttaaattgtcataaactgctaagtagaatgaatttgcctttttctttttttaattatttccctggaccagagacatgtgtgttgtggaattttgttcgactaaatgtggtgcacttttttttaaaaatcaaatttgactttggtcacattttggaatcaaactaagcatgcttctggttatatatgattgagtggatgccccatttatatatcattaaatcttattgtagtagtttaccatgatgaggtgtacaacgtgcctttttaatttttttaattttacacttaatgtggtgggagaaaaatggctttactggtgcatgcttaaggcatacaggtg

SEQ ID NO: 1286 - DNA, 460 bp, Heritiera littoralis
ctctctcatcctccgacgacaatggttgccgctaagaagaccaagaagactcatgagagcattaacaacagattggctctcgttatgaagagtgggaaatacactttgggttacaaaactgtcctcaaatctctcagaagctccaaaggtaagttgattattattgccaacaactgccctcctcttaggaagtctgagattgagtattatgccatgttgtgcaaggttggagttcaccactacaatggaaacaacgtagacttgggcactgcttgcggcaaatacttcagagtgtgctgtctcagcattatcgaccctggtgactctgatatcattaagagcatgcccggtgatcactaagctatgacggataaggtatcttctttggttttgttccgattttgtttctttttcttgtgtaataggaatgtttaagagaacttgttctgaaatgcagaac

SEQ ID NO: 1287 - DNA, 419 bp, Humulus lupulus
catcgccgctgcagagattttcctcaacgaagcacccaaccatggttgccgccaagaagaccaagaagactcatgagagcatcaacaacaggcttgctctcgtcatgaagagtggcaagtacaccttgggctacaaaacagtcctcaaatctctcaggaactccaaagggaagctaattattattgccaacaactgccctcctctaaggaaatctgagattgaatattatgccatgttggctaaggttggagttcatcactacaattgggaacaacgtagacgtggggactgcatgtggaaaaatactacagagtatgctgccttagcattattgatccaggtgattcggatatcattaagaacatgcctggtgaacattaagtagcccatatgatctgtaacaggtcttagattttgg

SEQ ID NO: 1288 - DNA, 650 bp, Ipomoea nil
ggccgctgccttagacgcttccgcttcgaatcgcatctgactccggccctccgagctaaagcacagccatggttgccgccaagaagaccaagaagactcatgagagcattaacaataggctggctctggtcatgaagagtgggaagtacactttgggatacaagaccgtcctcaagtccctcagaagctcgaaagggaaattaattataatttccaacaactgccctcctcttaggaagtctgagatagagtactatgccatgttggcgaaggttggcgttcaccactacaacggaaacaatgttgatttgggaactgcatgcggtaaatacttcagagtctgttgcctcagcattattgaccctggggactctgacattatcaagagcttgccgagcgagcagtaagatagcagtcaatgggcggttgccgttctcttaatgtgatatttcttaatttcgccagaaactgagattgtcattctaatttttgttctacaatgttagtgtgtactgtgtagtttatacaaaccattttatgcgaatgcctagtaggttttggatttgtctcatctatgaattttgtttttgtctatgatgtaatgaagttggtttttcttgttttcacaagttttgcaaacaaaaaaaaaa

SEQ ID NO: 1289 - DNA, 1269 bp, Nuphar advena
gagctaatcaaccatttatttcattcaaatgtacatcacatataatcccccatcaaaaaatagaacaccactccatcctacccctttataagtaataaggaggagaagaaataatagggatgatgggaataaagacgtaagtactaaaagaaatgaagaaacatcattattccctacaaccaaactaataaaacaaatacaccacctccttccaaacaagaaaagcccactggatccacaaaaatcaagctggaaaaccaaaattccagccactcaaccattaaatgaacatagagatcatcccctcatcgtgagaacaaggccatcacagacatcaaagatgcgaaggcgaccacaccgaatgtcggcaaactgatcggggaagcactctccatcggtgagggtgctgatgcaatctgcgcagagaccatgctggatgcagcaactaggagaacaaggagaagggagaagagggatgcaagccttggtgcctccatgatcaagtttctagagagagaaatagagagagagagggagagcttgcgtgggcagacaattggatgttaaagagagggagagactatgagatgaagagtttgagggtttccaatggggtctttatagagagagagaggtttgaacaaagagggagagcttgcgtgggcagacaattggatgttaaagcttcgctagggtttcgttttcgagcgtttgttccggaggagcggcggcgatggcgtccaccaagaagactaagaagacccacgagagcatcaacaatcgtctcgctctcgtgatgaagagcgggaagtacaccctcggctacaagaccgtcctcagatccctcaggggctctaaagcaaagttgatcatcatttcgaacaactgcccgcctctcaggaagtctgaaatcgagtactatgccatgctttcgaaagttggggttcaccatttcaatgggaataatgtggatttgggtacagcatgtggtaaatactaccgagtgtgctgtctcagcatcacagatccaggtgactctgatatcatcaaaagcattcctagtgagcaatgagtgagcaaacggcaaagtgactgatatttttgtttggtagtttgatatgattttggtagttctgtagcttgtttcagtcaattaggttttgttgtgttgagattggacatacgagtggtttatggaagggaatgaaaactttgtaacaagacccatttgtttctcctctgtgcattagattcttttatcttgttttc

SEQ ID NO: 1290 - DNA, 568 bp, Allium cepa
atttttgtttcagggttttccatcgcctatctcctgtcatctgctccaatggcgcccataaagaaaaccaagaagacaacggagagcataaataatagattagctctggtaatgaagagtggaaagtacactctaggattcaaaaccgtgcttagatctctcagaagctccaaagcgaagttggttatcatcgcaaacaactgtcctcccctacgcaggtctttaattgaatattatgctatgttggccaaggttggagttcatcattttaatggaaacaatgttgatcttggaactgcatgtggaaagtattttcgtgtttgctgcctgagcattattgatccaggtgattcggacatcattaagactcttccaggagaccagtgagaatgattgatatgttattttcgtttgtttaaaactaatttcatgtgtttgtcctatacattatttttgatctggttcgagtatttctagtgggaattgttctgttttggttatgatattttgtatgcgctgttttattgatgttatgttatctaagtgcactttgcatggaaaaaaaaaa

SEQ ID NO: 1291 - DNA, 641 bp, Carica papaya
cttttcttcatcgccaccagtcttcagcctgcatcttctctcgcagcctcggcttggtctctcacgaataggaagcgaccatggtttccgccaagaagacaaagaagacccatgagagcatcaacaacaggttggctctggtgatgaagagtggaaaattcactcttggttacaagacagtccttaaatcgcttcgcaattcaaaagggaagttgattattatctctaacaattgcccacctctgcgcaagtctgagattgagtactatgccatgctcgcaaagattggggtgcaccacttcaatggaaacaatgtcgatctgggtacagcgtgcggcaagtacttccgagtctcatgcctgagcattattgatccaggtgattctgatatcatcaagacgctgccaggtgaccagtgattgactcattttggcttatagtacaattcagaagcgaattataaacttgtggtcttctgttctagttcaagtagaagtgtgagacttacttttgttaagatattggtatcttattgcttccatagtttatttttcagcctttcaagactcttatattcggaagttgtgtatgattaatttgtcatcttgaggcatggtttaatgaagaaatatttgagtcat

SEQ ID NO: 1292 - DNA, 464 bp, Petunia hybrida
ccccacccagccccagatcccaaccatggttgctgctaagaaaaccaagaagacacatgagagcattaacaacaggctggctctggttatgaagagcggcaaatacacattgggttacaaaactgttctcaagacccttagaaactccaaaggcaaacttatcatcattgccaacaactgccctcctcttaggaagtccgagatagagtactatgctatgttggcaaaggttggagtccaccactacaatggaaacaacgtagattcggggactgcatgtggtaagtactacagagttcgttgcctcagcatcattgatccaggtgattcggatatcattaagagcatgcctggtgaccagtgagatagcatctggtgttagatcgatcttctaatggatactgctcaatctttactagatctttgcatctcccctcttattgagaaaattatctagtgtagct

SEQ ID NO: 1293 - DNA, 563 bp, Petunia hybrida
gtgttcgctgcttccaacccacaaacagagccaccatggttgctgccaagaaaactaagaagacccatgaaagcattaacaataggctggctcttgttatgaagagtggcaaatacactttgggttataagactgttcttaagaccctcagaaactccaaaggaaaacttatcattatcgccaacaactgccctccactcaggaagtctgagatagagtactatgctatgttgtcaaaggttggagtccaccactacaacggaaacaacgtagatttgggaaccgcttgtggtaaatatttcagggtctgttgcctgagcatcattgacccaggtgattctgacatcattaagagcatgcctggtgaccagtgaggatgtcattctgaatctgggaaaatagcccattgtttttttatgagaatagttagtgtagatttgttcatttaaaattactgtggtgacctgtgagataattttgatgatattggaatcttaatgacatctatttttcagtctgagctaatgatctatttatatggacaatgatttgttgtgccattg

SEQ ID NO: 1294 - DNA, 708 bp, Petunia hybrida
gcggcactaggaagaaaccctaaccgcacatataactcgtagaaagaagctactatactcccttttcctcctttccccttagtacagatctttgtaagaatcaacaagaatggtgactactacaggaaagaaaacaagaagacccatgaaagtattaacaacagattagctcttgttatgaagagtggcaaatacactcttggttacaagactgttctcaagactcttaggagctccaaaggaaagttgatattgatatctaataactgcccccctttgagaaagtctgagattgagtactatgctatgcttgctaaaattggtgttcaccatttcaatggaaacaatgttgatcttggaacagcatgtgggaagtattaccgtgtgtcatgcctcagcatcattgacccaggtgattccgatatcatcaagtctctgcctggagatcactaagagttggtaatctagtagtccccgtgtgatggaccggaaaatatttcccgggttatttaaacctttttactgatgttgagaaaatctgtactatccttttctgttcttgtatttcagagtattttagggcaagattacagaggatcttggtatcatttagttatgttgcttgctttatcatttcttcaagtttgagaccagatgatcagagttgagatattttacgaattatcaaaatcattttcatttctattt

SEQ ID NO: 1295 - DNA, 610 bp, Lippia dulcis
ccgctgtgcaaaacaacgctttctcacctcggccacaaagccctagctcaacttttcgtaacaatggtggccgcgaagaagactaagaagactcatgagagcattaacaacagattggctctggtgatgaagagcgggaaatacacgcttggttacaagaccgtgctcaaaactctccgcagctccaaaggaaaattgatactgatctccaacaactgcccgcctttgaggaaatcggagattgaatattatgccatgcttgcaaaaattggggttcaccactacaacggaaacaatgtcgatttgggcacagcttgtgggaaatacttccgcgtatcatgcctcagcatagtcgatccgggtgactcagacatcatcaagtcgttgcctggtgaccattgagaagaggtagtattttgtaatgccttttctttttctggatatgcttcttgtttcaagttgtagaatctcgaagtttgtatcaagttttgttttaccgtgaattttgtttggtatttttgacagcacatttttttcgacaaattaagaattggattattgaaatattcctattgcatgtacgctatattaagagaaattgttattataa

SEQ ID NO: 1296 - DNA, 651 bp, Podocarpus macrophillus
cgaagaagaagaagaataggaagcgcggctagggccgtgaatcggcgagatcagggaaggtagatcaggctgaggtgaagcagctatataaggaaaaatggtggccaccaagaagactaaaaagacccatgagagcatcaacaacagattggcacttgtcatgaagagtggcaagtacaccctaggttacaagactaccgtcaagtctatcaggaataataaagggaagcttatcataattgcaaacaactgccctcctcttcgtaggtcagaaatagagtattatgcaatgcttggaaagatcggggtgcatcatttcaatggaaataatgttgacctaggtacagcttgtggcaagtattatcgagtgtgctgtctcagcataacagatccaggtgattctgatatcattaaaacagtaccatcagatcagtaagcacacttgtaggatagttcaatgagaaactgattaattttaagacataccagaattttgagatgctaatgggaattagttgattacagcttttattcaagagccattttcagtatattcattgttttgagatgactccaaatggtaaccttgtcttttttcattttgtattgtattaattaaaagaataatttatgttgatttgttatattatt

SEQ ID NO: 1297 - DNA, 560 bp, Podocarpus macrophillus
ggaagggcggctagggccggtgaatgggcgagatcaggctgaggtgaagcagctacatcgggaaaaatggtggccaccaagaagactaaaaaggctcatgagagcatcaacaacagattggcactcgttatgaagagtggcaagtacaccctaggttacaagactaccgtcaagtctatcaggaataataaagggaagcttatcattattgcaaacaactgccctcctcttcgtaggtcagaaatagagtattatgcaatgcttggaaagatcggggtgcatcatttcaatggaaataatgttgacctaggtacagcttgtggcaagtattatcgagtgtgttgtctcagcattacagatccaggtgattctgatatcattaaaacagtaccatcagatcagtaagcacacttttaggatagttcaatgagaaactgattaattttaagacataccacaattctgggatgctaatgttaattagttgataggaacttttattcaagagccatattcagtatgttcattattttgagatgactccaaatggtaaccttgct

SEQ ID NO: 1298 - DNA, 614 bp, Podocarpus macrophillus
aaaatggtggccacgaagaagactaaaaagacccatgagagcatcaacaacagattggcacttgtcatgaagagtggcaagtacaccctaggttacaagactaccgtcaagtctatcaggaataataaagggaagcttatcataattgcaaataattgccctcctctccgcaggtcagaaatagagtattatgccatgcttggaaagattggggtgcatcattttaatggaaacaatgttgacctaggtacagcatgcggcaagtattatcgagtgtgctgtcttagcattacagatccaggtgattctgatatcattaagacagtgccatcagatcagtgaggagtgagcacacttttagtatatatttgaatgagaaactgattaattttcagacatacccaaatttcgggatgctgttagaaattagttggtaacagcttttctacaagagccattttctgtattttctttgagatagttacagatggtaatcttcctttttaattgtgttgtcctaattacaagagtagtgtatgtggatttactatattctagtggcgcacttttatggtggccaattgacttttgacttaatacaagctttattttgg

SEQ ID NO: 1299 - DNA, 844 bp, Populus trichocarpa
agattaaatctggctagggtttcttgctgtggcgagccttcattttgtctgcagaaacctctcgcataactaccatggtggccgccaagaagacaaagaagactcatgagtctatcaataacagactggccctggtcatgaagagtgggaaatacaccctggggtacaagactgtgctgaaatctctcagaaactcaaaggggaagcttatcatcatctccaacaattgtcctcctctgagaaagtctgagattgaatattatgctatgttggccaaggttggagttcatcactacaatggaaataatgttgacttgggcactgcctgtggaaaatatttcagagtatgctgcctcagcattattgatccaggtgattccgatatcattaagagcgtacctggtgatcattgacccagtttccaagcaatagcatgtctacttagttttggttccttttccatttggaatgcgggtttcaattgagagcactgtgatattttgttaacaagcacaatttttctgaacctccatgcttccttgatagccattttctatctactagatgtctgagtgaatctatcagagtactttatttcctgtgttaatttttatctctattttcttctcctagtcgatgttttgtggcttgtatcagaagctacagtcgcttattagactttcagtctctttgatgctcattgccatcgacgtcgtgtatcaaattcatccgaacctgcttttaaggatgataaccagcgttgggtgctttgtggtcaccttatagttttaacttggtgccagttacacctatcaaatctatggccatggtttgatgtttctag

SEQ ID NO: 1300 - DNA, 768 bp, Populus trichocarpa
atccaaccagatccattccacaaaagccctagcctcctctttatataagtacacattattccagtgttcctcgctgtggtaagccctattttctccgccgaactatctcacatcacaaccatggtggccgccaagaaaactaagaagactcatgagtctatcaacaacagactagctcttgtgatgaagagtggaaaatacactctagggtacaagaccgtgcttaaatctctcagaaactcaaaggggaagcttataatcatctccaacaattgccctcctctgagaaaatctgagattgagtattatgctatgttggcgaaggttggagttcaccactacaacggaaacaatgtcgacttgggcactgcttgtggtaaatatttcagagtgtgctgcctcagcattattgatccaggtgattccgatatcattaagagcgtgcctggtgatcactgattctgtttccaggcagtagaatgtctcgttagtttgatacctttttttgtatttttggaactgggtttcaatcgagagcattgtgttattgttagcaagaactatttatctggaacttgtatgctgctttcgtagccattttatatgtactagatgtttaagtgaatctcgtcgtgtactttatttcctttttgtgttcatttttattccttttgttgaatgtttgtggcttcttatatctcagaagatgaggttattgttcctgcaatgagtagatgctgtgtcacacgttcaatttctttgatgctt

SEQ ID NO: 1301 - DNA, 766 bp, Populus trichocarpa
ccctagtgctctgtacatctgccgtcaagcttctagggtttctttcagcttctgattctaaatctcaataaaccctaagcgctgaaaacagccaaacagcatcaaaatggtcacagccaagaaaactaagaagacccatgagagcatcaataacagattggctttggtgatgaagagtggaaagtacactcttggttacaaaactgtgcttaaatctctaaggagctccaaaggaaaattgattctattatcaaacaattgcccacctttgaggaaatccgagattgagtattatgctatgctcgcaaaggttggagtgcatcattataatggcaacaatgttgatttgggaactgcttgtggcaagtacttccgtgtatcttgtctgagcattgttgatgcaggtgattctgatatcatcaagacagtccctggtgatcattaagcaggtcattcttccagttctgttaatttaccgcagagattttttttccccttccaactttagaatagtttggaaactacaacaattgtcaatccttcagttttggattttattcccgtctgctgtgcgcactcaagtggcaagttttgattcagatatttgatacagcaagctttctattatgaatcactagttttctgaaattacccatccagatatggctccactcatgcgctacacgattttagcgtagcagtaaaaaaattgaaagtgtagttgattcgcgattctattatataatgagtgttttttcccttttgg

SEQ ID NO: 1302 - DNA, 665 bp, Papaver somniferum
  misc_feature (32)..(33): n is a, c, g, or t
  misc_feature (47)..(49): n is a, c, g, or t
  misc_feature (51)..(51): n is a, c, g, or t
  misc_feature (60)..(62): n is a, c, g, or t
  misc_feature (404)..(404): n is a, c, g, or t
  misc_feature (433)..(433): n is a, c, g, or t
  misc_feature (439)..(439): n is a, c, g, or t
  misc_feature (444)..(444): n is a, c, g, or t
  misc_feature (454)..(454): n is a, c, g, or t
  misc_feature (458)..(459): n is a, c, g, or t
  misc_feature (465)..(466): n is a, c, g, or t
  misc_feature (480)..(480): n is a, c, g, or t
  misc_feature (487)..(487): n is a, c, g, or t
  misc_feature (499)..(499): n is a, c, g, or t
  misc_feature (502)..(503): n is a, c, g, or t
tcgccagaaaactaaccatcgatctaaatctnntctcctccgtttcnnngnaactaatcnnnaaaaatggtggccgttaagaaaatgaagaagactcatgagagtattaacaacagacttgctcttgtgatgaagagtgggaaatacacccttggttacaaaacagttcttaggactctcagaagctccaaatcaaagctcataatcatctcaaacaattgtcctcctttgaggaaatctgagattgagtactatgctatgcttgctaaggttggagttcaccatttcaatggaaacaatgtcgacttgggaacagcttgtggacgatactaccgtgtttcatgccttagtatcattgatccaggtgattctgatatcatcaaaacccttcctggtgaccagtnagtgaagaaagctagctgtatccaatcantagatncaganttttctttgnttgnntctttnnctcttttctctatntagtttnagttgagttatngtnnaattgaatcaggctatttcaaatttgtaagtccgaaagaacacattaatactgaatgttttttggtagctgaatctgaaagtatgttgagacactattgttgcgtactgcccttgctctaaaaatgtgattgtcatttttctagtcattggtacttctgccg

SEQ ID NO: 1303 - DNA, 418 bp, Primula obconica
gaacggctgctgcactttctctctctagcttagggtttcgccggagcagctctctctctctacccacgcatcatgtccaccgtcggcaagaaaacgaagaagacacatgagagcatcaacaacaggctcgctcttgtgatgaagagcgggaagtatactcttggctacaagactgtgctcaagaccctcagaagctccaaaggtaagctgatcattatctcaaacaattgtcctccgctgaggaagtccgagatagagtactatgctatgcttgccaaagttggggttcaccattacagtggaaataacgtcgaccttggaactgcatgtggaaagtattttcgcgtctcttgccttagcatcgttgatccaggtgattcagacatcatcaaaacactacctggagatcagtgaaatg

SEQ ID NO: 1304 - DNA, 533 bp, Salvia sclarea
ctactagaccttggctgtcactcaggccgcagtcctaaattacgctctcgaaatcaagtgattgctcacttcagctcggccgcgaagccctaactccattctcgtaacaatggtggccgggaagaagacgaagaagactcatgagagcatcaacaacagattggctctggtgatgaagagcgggaaatacacgcttggttacaagaccgtgctcaaaactctccgcagctccaaaggcaaattgattctgatatcaaacaattgcccgccattgaggaaatcggagattgagtattatgccatgctcgcaaaaattggagttcaccactacaacggaaacaatgttgatttgggaacagcttgtggaaaatacttccgagtttcatgcctcagcattgtcgacccaggtgactcggacatcatcaagtcgttacccagtgatcattgagtagtgatagtcttttgtcttgtatttgccttttccatttcttgatatgctctttcttatttcaatttgtagaacatttcggagg

SEQ ID NO: 1305 - DNA, 430 bp, Salvia sclarea
ctactagaccttggctgtcactcagctaaattacgctgtgattgcgcagttcagctccgccggcgaaaccctaactccaatcgcgcaacaatggtggccgggaagaagaccaagaagactcatgagagcatcaacaacagattggctctggttatgaagagcggtaaatacacgcttggttacaagaccgtgctgaaaactctccgcagctccaaagggaaactgatcctgatctcgaacaattgcccgccgttgaggaaatcggagattgagtattatgccatgctcgcaaaaattggcgttcaccactacaacggaaacaatgtcgatttgggaacagcttgtgggaaatacttccgtgtctcatgcctcagcattgtcgatccaggtgactcggacatcatcaagtcattacccagtgaccattgag

SEQ ID NO: 1306 - DNA, 527 bp, Salvia sclarea
ctactagaccttggctgtcactcagcgaaaccctaactccactctcgtaacaatggtggccggcaagaagactaagaagactcatgagagcatcaacaacagattggctctggttatgaagagcggtaaatacacgctcggttacaagaccgtgctcaaaaccctacgcagctccaaagggaaattgattctgatctcgaacaattgcccgcctttgaggaaatcggagattgaatattatgccatgctcgccaaaattggcgttcaccactacaatggaaacaatgtcgatttgggaacagcttgtggaaaatacttccgtgtctcatgcctcagcattgtcgatccaggtgattcggacatcatcaagtcattgcccagtgaccattgagaagagataagtcttttgtcttgtattcgccgtttccatgtcttgatatgctctttcctatttcaagttgtagaacatttcggaggcgatatagagttttttgaccgtgaaatttatgtgttgtttttgacagcac

SEQ ID NO: 1307 - DNA, 821 bp, Sciadopitys verticillata
aaaaagataactaagacttttactcgagttgtttcccaccataaaaacacctcactagggtttgtgcgggttttaaaaccccgtggagtattcattaacctcctctgggagtttagcgcgtaggtgatcagagaatttctaaggcggccgcggctggtgattttccttcacacatcatggtggccactaagaagactaaaaaggctcatgagagcataaataacagattagctcttgttatgaagagtggcaagtacacgctaggctacaagactaccatcaagtctatcaggggcaacaaaggaaagcttattataattgcaagcaactgccctcctcttcgcaggtcagaaatagagtactatgctatgcttgcaaagattggggtgcaccatttcaatggaaacaatgttgacttagggacagcatgcggaaagtattatcgggtttgctgtcttagcattacagatccaggtgattctgatatcatcaagacagtgccatcagatcagtgagtacatgtttagaattgttttacagtaacatgattaatttttgtacatgcccccaaaattttgggaagacagtaggaaattggtatgattttttagaggagtcatttttcagtttcattttgagacagcctcaaatggtaactgcattttttaaatttgtgctgtactaattaagagggttatttatggttgaatgaccttgtgctctaattgcgggaacttgtatggttgttaattgacttatttattccacactagttttctcattagatgcaatgattgcaaatatttcataaatcatcggta

SEQ ID NO: 1308 - DNA, 871 bp, Taxus baccata
agtacgcggggagggttttgaagcaggtccaacaagggtttgtcacgctctagggtttccaaggttaacagttttaaaaaccttcagtgaaaattattgttctccggaagtaccagaagaaacttagaggcggccgaggctcgtgacgttcttcgatcgggcaaaatggtggcaactaagaaaactaaaaggctcatgagagcatcaacaacaggttggctcttgtcatgaagagtggcaagtacactctaggctacaagaccaccctcaagtctatcaggaccaacaaagggaagcttattattatagcgaacaactgtcctcctcttcgtagatcagaaatagagtactatgccatgcttgcaaagattggggtgcatcattttaatggaaacaatgttgatctagggacagcatgtggcaggtattatcgggtttgctgtcttagcattactgatccaggtgattctgatatcattaagacagtcccatcagatcagtgagtgccatcagatggtgttgaccgggaaattgttagttttcatacatgcccagaactttgggaaggcaatgaggattatttggttaaatctattaggtgagattgatttttcagtttttctgagacagctacaaatagcagccatacttattaggttggagttgtacttattaagaaggccatttatgttgaatgaccttattctgtaatgttgggaacttgtaaaggttaatcaaatctttattccggaatagtttctttagatgtggttgattgaatctattttatagagcatttaattaacacagcaaattttactaaaaaaaaaaaaaaaaaaagtaaactactagacgttagataccactgctt

SEQ ID NO: 1309 - DNA, 512 bp, Triphysaria pusilla
tctcaacatctcggccaaaagaacacattctcgagctccaatggccgccaccaagaaaaccaagaagactcatgagagcatcaacaataggttggctctggtgatgaagagtggcaaatacactcttggttacaagacggttctcaaaaccctccgcagctccaaaggtaagttgattcttatctccaacaactgcccgccgttgaggaaatctgagatcgagtactatgcaatgctctccaaagttggtgttcatcactataatggaaacaatgtggatttgggaactgcttgcggaaagtacttccgtgtgtcttgcctcagcattgtcgacccaggtgactcggacatcatcaaatctctgcctggtgaccactgagaagagagattaattttatgccccttacatttgctgttttttacagatgtttgaagtgttatttatttttaaatatagaacaggagttttgagttgagtatctgtggtttgtcttattgctcggattggttat

SEQ ID NO: 1310 - DNA, 648 bp, Triphysaria pusilla
aaaagaacacactctcgagctccaatggccgccaccaagaaaaccaagaagactcatgagagcatcaacaataggttggctctggtgatgaagagtgggaaatacactcttggttacaagacggttctcaaaaccctccgcagctccaaaggtaagttgattcttatctccaacaactgcccgccgttgaggaaatctgagatcgagtactatgcaatgctctccaaagttggggttcatcactataatggaaacaatgtggatttgggaactgcttgcggaaagtacttccgtgtttcttgcctcagcattgtcgacccaggtgactcggacatcatcaaatctctccctggtgaccactgagaagagagattaattttatgccttatatttgcagttttggacagatatttgaagtgttatttgattttaactatagaacatgagttatgagttgaatatttgtgttttgtcttattgctctgtttggttatttaccctgctctagttagatactttcgttttgtttcagactagcaacagtgattaagatcttgtgatggattattcaacagaaatgttagttgcaaagaagtttgtgttcatcgtgtttgtatggtgaaattaataaaaaaaaaaaaaaaaaag

SEQ ID NO: 1311 - DNA, 636 bp, Valeriana officinalis
ttcactgatctttttcttctccgccgcaagtccaaaaggatctaggttttagcgcaatggctgccggaaagaaaacgaagaagactcatgagagtatcaacaacaggcttgccctcgtgatgaagagtggcaaatacactctcggttacaaaaccgttctcgaatcccttcgcagctccaaaggcaagctgatcataatatccaacaattgtcctccccttcgcaaatccgagattgagtactatgctatgcttgctaagattggagtccaccactacaacggaaacaatgttgatctcggaacagcttgtggaaagtacttccgtgtgtcctgcctaagcattgttgatcctggtgattcggacatcatcaagtctctgcccggtgatcagtaagcgaggaacataatggtggaacaacaaatctttgttaaagcaaaattctcttctttttgtttcatgagttttagagctgttattttgtttaaactacatttgatgtgttcacataatattagcatatttgatgactttttactgttatgtgatgtttgtttcttttcgttgtcctagatgctatattgtgtgtgccatagcaattttgaccttattctatatgttcatcaatcattctctg

SEQ ID NO: 1312 - DNA, 638 bp, Valeriana officinalis
ttcactgatctttttcttctccgccgcaagtccaaaagaaggatctaggttttagcgcaatggctgccggaaagaaaacgaagaagactcatgagagtatcaacaacaggcttgccctcgtgatgaagagtggcaaatacactctcggttacaaaaccgttctcgattcccttcgcagctccaaaggcaagctgatcataatatcaaacaattgtcctccccttcgcaaatccgagattgagtactatgctatgcttgctaagattggagtccaccactacaacggaaacaatgttgatctcggaacagcttgtggaaagtacttccgtgtgtcctgcctaagcattgttgatcctggtgattcggacatcatcaagtctctgcccggtgatcagtaatcgaggaacataatggtgcaacaacaaatctttgttaaagcaaaattctcttctttttgtttctatgagttttagagctgttattttgtttaaactacatttgatgtgttcacataatattagcatatttgatgacttcatactgttatgtgatgtttatttcttttccttgtccaagatgctatagtgtgtgtgccatagcaattttgaccttattctatatgttcatcaatcattctc

SEQ ID NO: 1313 - DNA, 838 bp, Juglans hindsii x Juglans regia
ttgtgttggtcccggggatcggccattacggccgggggagctcctgcgcctccatccaagggttcctacgccgcattggaacgctcgggctcccactacttcgcagtagttctcccactcaaagctcccaaccatggtggccgccaagaagactaagaagactcatgagagcatcaataacaggctcgccctcgtcatgaagagtggcaagtacaccttgggatataagaccgtcctcaaatcactgagaaactccaaagggaagctgatcattattgccaacaactgccctcctctacggaagtctgaaatagagtattatgcaatgttggcaaaggttggagttcaccattacaatgggaacaatgttgatttggggactgcttgtggaaaatatttcagagtttgctgtctcagcatcattgatcctggtgattctgatatcatcaagagcatgcctagtgaacattaagccctgaattgtagcacgtctagattttggtggttttacccttttttggaatttgagaggagtcttctgtttcaaggcaaagcttttatgttaactgaaataatttgagtagtgactaagttgccttgatggtgtttttaatagtaatgtggttgggactaatattttatgttttagtttgtatgagtacaaaatcatatatgaaagacttggatctttgtttccatatcttcatttctctccagagctcttcttatagaagctgccagactggttgaaccagtaagttgtttccaggcaaggcaacttgagataattggcttgcttgcatcctgttctttcctaaatgagaagttcttgtgttag

SEQ ID NO: 1314 - DNA, 757 bp, Zostera marina
gttttagcagctttgacttatataaacgaggcaagtctggattagggtttccctgccgccattcttcttcctttctgagttttcaagatctccgttttcgccgatttccgcagccatggttgccgctaagaagacgaagaagagccatgataacatcaacaataggcttgcactcgtcatgaagagtggaaagtatactcttggttacaagaccgtccttaaaactatcaggagctctaaatctaagctggtcataatatgcaacaactgcccacctctccgtaagtctgagattgagtattatgctatgttggcaaagatcggtgttcatcatttcaatggaaacaatgttgatttgggaacagcatgtggaaaatatttccgtgtcggctgtctgagcatccttgatccaggtgattctgatataatcaaatcactatccagtgatcattgaagaaatcgcaattttcaactaccaatttaagttatattttcataatcatgttttgggttacttttgtttttttcctatctagaagttctttcgaatcgaatattctcttcaggatttcctcttaattaactcattgtcctgtcaaattttcttaattattatttagccactaattttttcttgcaattctctctttatttgaatttatataaaatatgttcctttcctctctcttcttcttttcatcaaatccatagattttttgttattaagtatgagtttctattatattgtgcattgaag

SEQ ID NO: 1315 - DNA, 1465 bp, Triticum aestivum
cactcagctcttctctcgcccgcaattcttcccatccgcctcggctcgggctccatctccaaggattccgttcccgagtcgtacgtgatcctgctgaagcgtgagctcgagctacagccacacaggcaggatggtgaccaaggtggtggacctccgctccgacacggtcaccaagccatccgaggccatgcgcgccgccatggccgcggcggaggtggacgacgacgtcctgggcgcggacccgaccgcgcagcgcttcgaggcggagatggccaggatcatggggaaggaggccgccctgttcgtgccctcgggcaccatgggcaacctcgtctccgtcctcgcgcactgcgacaccaggggcagcgaggtcatcctcggggacaactcccacatccacatctacgagaacgggggcatctccaccctcggcggcgtccaccccaggaccgtgcccaacaatcccgacggcaccatggacatccacaagatcgttgctgccatcaggcatcgggacggggccatgtattatcccaccaccaggctcatctgcttggagaacacacacggaaacactggcggaaagtgtctgtctgtagagtacaccgacaaggttggtgaggttgctaaaagccatggcttgaagcttcatatcgacggagctcgtatttttaacgcttccgtggcactcggagttcctgttcatagacttgtgagagctgctgattcagtttcggtatgcctatcaaaaggtttaggcgctcctgttggatcagttattgttggttcgaaggccttcatagacaaggctaagattcttaggaagacactaggtggtggaatgaggcaggttggaattctctgtgctgctgcctatcttgcggttcgcgacaccgtaggcaagcttgccgatgaccataggaaggccaaagttttagcagatggtctgacgaaaattaaacagtttacagttgatttagcttcagtggagaccaacatggtattctttgatattgcggatccacgcataacacctgacaaactctgtcaagtcctggaacagcgcaatgtgcttgcaatgccagcaagctccaagagcgtcagacttgtcactcactaccaaatttcagacagtgacgtgcagtatactttgacatgcatcgagaaagccgtggaggaaatactgtcaggcaacgccaaattcgagcgcctgacaaacggcactaccacgaactcatatgggcactaggccacggcctatggagtgcagtcagtggtatccagcttgtttgtggccgtggcctttgcagtagtgaagtagtaacaactttgcagaataatctgttgctatttgggccgatggaagccccccacttggtgtcaatgtgatgtgttcacttcagcccggatacaggaaaatgttcgccaggccggcccatcatcactcaagtgtactctacctttt

SEQ ID NO: 1316 - DNA, 2534 bp, Triticum aestivum
ctcaactcttctctcgcccgccattcccatccgcctcggctcgggctccatcccctccacggattctggtcccgagtcgtacgtgatcctgctgaagcgtgagctccagctacagccacacaggcaggatggtgaccaaggtggtggacctccgctccgacacggtcaccaagccatcggaggccatgcgtgccgccatggccgcagcggaggtggacgacgacgtcctgggcgcggacccgaccgcgcagcgcttcgaggcggagatggccaggatcatgggcaaggaggccgccctgttcgtgccgtcgggcaccatgggcaacctcgtctccgtcctcgcgcactgcgacaccaggggcagcgaagtcatcctcggggacaactcccacatccacatctacgagaacggaggcatctccaccctcggcggcgtccaccccaggaccgtgcccaacaaccctgacggcaccatggacatcgacaagatcgttgccgccatcaggcatcgggacggggcgatgtattatcccaccaccaggctcatctgcttggagaacacacacggaaacactggtgggaagtgtctgtctgtagagtacaccgacaaggttggtgaggttgctcaaagccatggcttgaagcttcatatcgacggagctcgtatttttaacgcttccgtggcacttggagttccagttcatagacttgtgagagctgctgattcagtttctgtatgcctatccaaaggtttgggtgctcctgtcggatcagttatcgttggttcgaaggccttcatagacaaggctaaaattcttaggaagacacttggtggtggaatgaggcaggtaggaattctctgtgctgctgcctatgttgcggttcgcgacacagtaggcaagctcgccgatgaccatacgaaggccaaagttttagcagatggtctgaagaaaattaaacagattacagttgatttagcttcagtggagaccaatatggtattctttgatatcgcggatccacgcataacacctgataaactgtgtcaagtcctggaacagcgcaatgtgcttgcaatgccagcaagctccaagagtgtcagacttgtcacccactaccaaatttcagacagcgacgtccagtatactttgacctgcatcgagaaagccgtggaggaaatactgtcagggaatgccaaattcgagcgcctgacaaacggcactaccacgaattcatatgggcactaggccacttcctttcgcgccacctatggagtgcagcagtccagtatccagcttgtttgtggccgtggcctttgcagtagtgaagtagtaacaactttgcagaataatctgtttctgtttgggccgatggaagccccccacttggtgtcaatgtgatatgttcacttcagcccggatgcaggaaatgttcgccaggccggcccatcatcacttaagtgttctctaccttttttccagcaaaatagaagaagtgtttctaaaaaaaaaagcaaaaaagaagaagtgtactttgggtcagtttggttcatgtccacatttcaatctgcctggcctggagcttgcctggaatctgcctgggatgtgtttggttagtgacctgggatttttctgcctggtgaagttgcctgggtacgctgcctgcctccaggcgtagcaaatcggacgcctggccctctccccaacctgcctgggcaagatggccccacttacaatttactataccccgtaatatgggcaaagcactttcccctccacctccactcacgtttcccctccccacagctcacaatcttctctctctctttgggattgttcttgagagaaggggagaaggaattgcatgggaaattgattattggctttgattcttctttcccccaacaatatttctagttcctagtcagatctggtgaaatcatgaagatgtatacggaatctgtccattatgttatcaagaaacgacgggcgttaggtgttctagctgtaatgttggccattgtccggtggcgtcgtcaacgtagacattacagtcttagaatgtctcgaagaaagtatgggccattggttgatagagatctggagaggcaaaaaagttgaatgacctgtacaattcaaccgataaaaattgcatcagtcaactccggacgacggggccgctgcgcagtgggtttgatgatgtgaacaaacaagtgatgctctccaaatctactctagatggcttatcggctaatgatcgtggaattctctctaaaccgattcagttctacgacaagttgaaggattatttagtggctcgtcggcagatggctcttttatgcaagaccctttctctgcagctgaaactgacaatgatgataaggtaaaagatgacatgatgaatgatatgtccacctttgatgaagcgaagggtccaacaggtcatgactcggataaattagatacagatagtgatgattgtgaagcggtggctgctcttgctgcactgatagtcaagtttcctcgtccaatgtt

SEQ ID NO: 1317 - DNA, 1528 bp, Triticum aestivum
ccactccactctccactcagctcttctctcgcccgcaattcttcctatccgcctcggctcgggctccatctccaaggattctgttcccgagtcgtacgtgatcctgctgaagcgtgagctcgagccacagccacacaggcaggatggtgaccaaggtggtggacctccgctccgacacggtcaccaagccatccgaggccatgcgcgccgccatggccgcggcggaggtggacgacgacgtcctgggcgcggacccgaccgcgcagcgcttcgaggcggagatggccaggatcatgggcaaggaggccgccctgttcgtcccctcgggcaccatgggcaacctcgtctccgtcctcgcgcactgcgacaccaggggcagcgaggtcatcctcggggacaactcccacatccacatctatgagaacgggggcatctccaccctcggcggcgtccaccccaggaccgtgcccaacaaccccgacggcaccatggacatccacaagatcgttgctgccatcaggcatccggacggggccatgtattatcccaccaccaggctcatctgcttggagaacacacacggaaacactggcggaaagtgtctgtctgtagagtacaccgacaaggttggtgaggttggtaaaagccatggcttgaagcttcatatcgacggagctcgtatttttaacgcttccgtggcactcggagttcctgttcatagacttgtgagagctgctgattcagtttcggtatgcctatcaaaaggtttaggcgctcctgttggatcagttattgttggttcgaacgccttcatagacaaggctaagattcttaggaagacactaggtggtggaatgaggcaggttggaattctctgtgctgctgcctatcttgcggttcgcgacaccgtaggcaagcttgccgatgaccataggaaggccaaagttttagcagatggtctgacgaaaattaaacagtttacagttgatttagcttcagtggagaccaacatggtattctttgatattgcggatccacgcataacacctgacaaactctgtcaagtcctggaacagcgcaatgtgcttgcaatgccagcaagctccaagagcgtcagacttgtcactcactaccaaatttcagacagtgacgtgcagtatactttgacatgcatcgagaaagccgtggaggaaatactgtcaggcaacgccaaattcgagcgcctgacaaacggcactaccacgaactcatatgggcactaggccacggcctatggagtgcagtcagtggtatccagcttgtttgtggccgtggcctttgcagtagtgaagtagtaacaactttgcagaataatctgttgctatttgggccgatggaagccccccacttggtgtcaatgtgatgtgttcacttcagcccggatacaggaaaatgttcgccaggccggcccatcatcactcaagtgtactctaccttttcccagcaaagaaaaaaaaagaagaagtgatcctcaaaaaattaaataaaa

SEQ ID NO: 1318 - DNA, 1466 bp, Triticum aestivum
cactcagctcttcttttcccttccgcctcggctccatcgggctccgcctcgtccagggattctgctcctgagtcgtacgtgatcctgctgaagcgtgagctccagctacagccacacaggcaggatggtgaccaaggtggtggacctccgctccgacacggtcaccaagccatccgaggccatgcgcgccgccatggccgcggcggaggtggacgacgacgtcctcggcgcggacccgaccgcgcagcgcttcgaggcggagatggccaggatcatgggcaaggaggcggccctgttcgtgccgtcgggcaccatgggcaacctcgtctccgtcctcgcgcactgcgacaccaggggcagcgaggtcatcctcggggacaactcccacatccacatctacgagaacgggggcatcgccaccctcggcggcgtccaccccaggaccgtgcccaacaatcccgacggcaccatggacgtcgacaagatcgttgccgccatcaggcatcgggacggggccatgtattatcccaccaccaggctcatctgcttggagaacacacacggaaacactggtgggaagtgtctgtctgtagagtacaccgacaaggttggtgaggttgctcaaagccatggcttgaagcttcatatcgacggagctcgtatttttaacgcttccgtggcactcggcgttcctgttcatagacttgtgagagccgctgattcagtttcggtatgcctatcgaaaggtttaggtgctcctgttggatcagttattgttggttcgaaggacttcatatacaaggctaagattcttaggaagacactaggtggtggaatgaggcaggttggaattctctgtgctgctgcctatgttgcggttcgcgacacggtaggcaagcttgccgatgaccatacgaaggctaaagttttagcagatggactgaagaaaatcaaacagtttacagtcgatctaacttcagtggagaccaatatggtattctttgatattgcggatccacacataacgcctgacaaactgtgtcaagtcctggaacagcgcaatgtgcttgcaatgccagcaagctccaagagcgtcagacttgtcacccactaccaaatttcagacagcgacgtccagtatactttgacctgcatcgagaaagccgtggaggaaatactgtcgggcaacgccaaattcgagcgcctgacaaacggcaccaccacgaattcatatgggcactaggccacggcctatggagtgcagcagtcagtagtatccagcttgtttatggccgtggcctttgcagtagtgaagtagtagtaacaactttgcagaataatgtgttgctatttgggccgatggaagccccccacttggtgtcaatgtgatgtgttcacttcagcccggatacaggaaaatgttcgccaggccggcccatcatcacttaagtgtgctctagcttttt

SEQ ID NO: 1319 - DNA, 1545 bp, Triticum aestivum
aagccagacggaccactctccactcagctcttcttttcccttccgcctcggctccatcgggctccgcctcgtccagggattctgctcctgagtcgtacgtgatcctgctgaagcgtgagctccagctacagccacacaggcaggatggtgaccaaggtggtggacctccgctccgacacggtcaccaagccatccgaggccatgcgcgccgccatggccgcggcggaggtggacgacgacgtcctcggcgcggacccgaccgcgcagcgcttcgaggcggagatggccaggatcatgggcaaggaggcggccctgttcgtgccgtcgggcaccatgggcaacctcgtctccgtcctcgcgcactgcgacaccaggggcagcgaggtcatcctcggggacaactcccacatccacatctacgagaacgggggcatcgccaccctcggcggcgtccaccccaggaccgtgcccaacaatcccgacggcaccatggacgtcgacaagatcgttgccgccatcaggcatcgggacggggccatgtattatcccaccaccaggctcatctgcttggagaacacacacggaaacactggtgggaagtgtctgtctgtagagtacaccgacaaggttggtgaggttgctcaaagccatggcttgaagcttcatatcgacggagctcgtatttttaacgcttccgtggcactcggcgttcctgttcatagacttgtgagagccgctgattcagtttcggtatgcctatcgaaaggtttaggtgctcctgttggatcagttattgttggttcgaaggacttcatatacaaggctaagattcttaggaagacactaggtggtggaatgaggcaggttggaattctctgtgctgctgcctatgttgcggttcgcgacacggtaggcaagcttgccgatgaccatacgaaggctaaagttttagcagatggactgaagaaaatcaaacagtttacagtcgatctaacttcagtggagaccaatatggtattctttgatattgcggatccacacataacgcctgacaaactgtgtcaagtcctggaacagcgcaatgtgcttgcaatgccagcaagctccaagagcgtcagacttgtcacccactaccaaatttcagacagcgacgtccagtatactttgacctgcatcgagaaagccgtggaggaaatactgtcgggcaacgccaaattcgagcgcctgacaaacggcaccaccacgaattcatatgggcactaggccacggcctatggagtgcagcagtcagtagtatccagcttgtttatggccgtggcctttgcagtagtgaagtagtagtaacaactttgcagaataatgtgttgctatttgggccgatggaagccccccacttggtgtcaatgtgatgtgttcacttcagcccggatacaggaaaatgttcgccaggccggcccatcatcacttaagtgtgctctagctttttccagcaaaaacagaagaagaagtgatcctcaaaaatttaaataaaaataaagttgtatc

SEQ ID NO: 1320 - DNA, 1613 bp, Triticum aestivum
caccactccactctccactcaactcttctctcgcccgccattcccatccgcctcggctcgggctccatcccctccacggattctggtcccgagtcgtacgtgatcctgctgaagcgtgagctccagctacagccacacaggcaggatggtgaccaaggtggtggacctccgctccgacacggtcaccaagccatcggaggccatgcgtgccgccatggccgcagcggaggtggacgacgacgtcctgggcgcggacccgaccgcgcagcgcttcgaggcggagatggccaggatcatgggcaaggaggccgccctgttcgtgccgtcgggcaccatgggcaacctcgtctccgtcctcgcgcactgcgacaccaggggcagcgaggtcatcctcggggacaactcccacatccacatctacgagaacggaggcatctccaccctcggcggcgtccaccccaggaccgtgcccaacaaccctgacggcaccatggacatcgacaagatcgttgccgccatcaggcatcgggacggggcgatgtattatcccaccaccaggctcatctgcttggagaacacacacggaaacactggtgggaagtgtctgtctgtagagtacaccgacaaggttggtgaggttgctcaaagccatggcttgaagcttcatatcgacggagctcgtatttttaacgcttccgtggcacttggagttccagttaatagacttgtgagagctgctgattcagtttctgtatgcctatccaaaggtttgggtgctcctgtcggatcagttatcgttggttcgaaggccttcatagacaaggctaaaattcttaggaagacacttggtggtggaatgaggcaggtaggaattctctgtgctgctgcctatgttgcggttcgcgacacggtaggcaagctcgccgatgaccatacgaaggccaaagttttagcagatggtctgaagaaaattaaacagattacagttgatttagcttcagtggagaccaatatggtattctttgatatcgcggatccacgcataacacctgataaactgtgtcaagtcctggaacagcgcaatgtgcttgcaatgccagcaagctccaagagtgtcagacttgtcacccactaccaaatttcagacagcgacgtccagtatactttgacctgcatcgagaaagccgtggaggaaatactgtcagggaatgccaaattcgagcgcctgacaaacggcactaccacgaattcatatgggcactaggccacttcctttcgcgccacctatggagtgcagcagtccagtatccagcttgtttgtggccgtggcctttgcagtagtgaagtagtaacaactttgcagaataatctgtttctgtttgggccgatggaagccccccacttggtgtcaatgtgatatgttcacttcagcccggatgcaggaaatgttcgccaggccggcccatcatcacttaagtgttctctaccttttttccagcaaaatagaagaagtgtttctaaaaaaaggggggccggtaccaattcgcccaacctgatcgtattaccgcgccacggcctcgtttaaacttctgacgggaaacctgggttccact

SEQ ID NO: 1321 - DNA, 1614 bp, Secale cereale
tctctccagccccagccccagcccgcgcctgcctgccattgccgtccgcctcctcggcttgggctccatctgatccacagattctgttacagagtcgtacgtggtcctgctcaagcatggtgaccaaggtggtggacctccgctccgacacggtcaccaagccatccgaggccatgcgtgccgccatggccgcggcggaggtggacgacgacgtcctgggcgcggacccgaccgcgcagcgcttcgaggcggagatggccaggatcatgggcaaggaggccgccctcttcgtgccgtcgggcaccatgggcaacctcgtctccgtcctcgcgcactgcgacaccaggggcagcgaggtcatcctcggggacaactcccacatccacatctacgagaacgggggcatctccaccctcggcggcgtccaccccaggaccgtgcccaacaaccctgacggcaccatggacatcgacaagatcgttgctgccatcaggcatccggacgggggtctgtattatcccaccaccaggctcatctgcttggagaacacacacggaaactctggtgggaagtgtatatctgtagaatacaccgacaaggttggagaagttgctaaaagccatggcttgaagcttcatatcgacggagctcgtatttttaacgcttccgtggcacttggagttcctgttcatagacttgtgagggctgctgattcagtttcggtatgcctgtccaaaggtttaggtgctcctgtgggatcagttattgttggttccaaggccttcatagacaaggctaagattcttaggaagacactaggtggtggaatgaggcaggtaggaattctctgtgctgctgcctgggtcgcagttcgcgacaccgtaggcaggcttgccgatgaccacaggaaggctaaagttttagcagatggactgaagaaaattaaacagtttacagttgatttaacttcagtggagaccaatatggtattctttgatatcgcggatccgcgcataacgcctggcaagctgtgtcaagtcctggagcagcgcaatgtgcttgcaatgccagcaagctccaagagcgtcagacttgtcacccactaccaaatttcagatagtgacgtccagttcactttgacatgtatcgagaaagccgtggaggaaatactgacaggcaatgccaaattcgagcgcttgacaaacggcactagtaccacgaattcgtatgggcactaggccacacctccttatatggagcctgtctgcggccctggccttagcagtagtaactactgtactttgcagaataatctgttgcaatttgagccgatgaaagcccatcactccgaaatatgttctcttcagcccggatgcaagaaatgttcgccaggcccatcaattatcaacaagtgtactcttacctttcccgcaaaagaagtgtactctgtacctggcgctggcgccgtactctactactgttgactgtaccgcttgtccagctacggctactatcgcaccgtacgttttttaccgtagcgcttaatagcatcatctctcccaccggatgcaccacgttcaccacgattggtatacttggccgtagacgtgtgga

SEQ ID NO: 1322 - DNA, 1634 bp, Secale cereale
gactgtcatctataaagcgcgactccgcaccggcaccgcagtggcaacgatcgccacccaagctccactccactcatcttctccagccccagccccagcccgcgcctgcctgccattgccgtccgcctcctcggcttgggctccatctgatccacagattctgagtcgtacgtggtcctgctcaagcgtgagctcaagcatggtgaccaaggtggtggacctccgctccgacacggtcaccaagccatccgaggccatgcgcgccgccatggccgcggcggaggtggacgacgacgtcctgggcgcggacccgaccgcgcagcgcttcgaggcggagatggccaggatcatgggcaaggaggccgccctcttcgtgccgtcgggcaccatgggcaacctcgtctccgtcctcgcgcactgcgacaccaggggcagcgaggtcatcctcggggacaactcccacatccacatttacgagaacgggggcatctccaccctcggcggcgtccaccccaggaccgttcccaacaaccctgacggcaccatggacatcgacaagatcgttgctgccatcaggcatccggacgggggtctgtattatcccaccaccaggctcatctgcttggagaacacacatggaaactctggtgggaagtgcatatctgtagaatacaccgacaaggttggtgaagttgctaaaagccatggcttgaagcttcatatcgacggagctcgtatttttaacgcttccgtggcactcggagttcctgttgatagacttgtgagagctgctgattcagtttcggtatgcctatcgaaaggtttaggtgctcctgtcggatcggttattgttggttccaaggtcttcatagacaaggctaagattcttaggaagacactaggtggtggaatgaggcaggtaggaattctctgtgctgctgcctgcgtcgcggttcgcgacaccgtaggcaagcttgccgatgaccacaggaaggctaaagttttagcagatggactgaagaaaattaaacagtttacagttgatttaacttcagtggagaccaatatggtattctttgatatcgcggatccgcgcataacgcctggcaagctgtgtcaagtcctggagcagcgcaatgtgcttgcaatgccagcaagctccaagagcgtcagacttgtcacccactaccaaatttcagatagtgacgtccagtacactttgacatgtatcgagaaagccgtggaggaaatactgacaggcaatgccaaattcgagcgcttgacaaacggcactagtaccacgaattcgtatgggcactaggccacacctccttatatggagcctgtctgcggccctggccttagcagtagtaactactgtactttgcagaataatctgttgcaatttgagccgatgaaagcccatcactccgaaatatgttctcttcagcccggatgcaagaaatgttcgccaggcccatcaattgtcaacaagtgtactcttacctttcccgcaaaagaagtgtactctgtacctggcgctggcgccgtactctactactgttgactgtaccgcttgtccagctatcgcaccgtacgttttgtaccgtagcgcttaatagcatcatctcttt

SEQ ID NO: 1323 - DNA, 1260 bp, Brachypodium distachyon
cgcaacacacacaatggtgaccaaggtggtggacctccggtcggacacggtgacgaagccctcggatgccatgcgcgccgccatggcggccgcggacgtggacgacgacgtcctgggcgcggacccgacggcgcagcgcttcgaggcggagatggccaggatcatgggcaaggaggccgccctgttcgtgccgtccggcaccatggccaacctcgtctccgtcctcgtccactgcgacaccaggggcagcgagatcatcctcggcgacacctcccacatccacatctacgagaacggcggcatctcctccctcggcggcgtccaccccaagaccctgccgaacaaccccgacggcaccatggacatcgacaagatcgtcgctgccatcaggcatcaggacggggcgctctattaccccaccaccaggctcatctgcttggagaacacacacgcaaattgtggtggcaagtgtctgtctgtagaatacactgacaaggtcggtgaagttgccaaaagccatggactgaagcttcatatcgacggagctcgcatttttaatgcttctgtggcacttggagttcctgttcatagacttgtgagagcagctgattcggtttcggtgtgcctatccaaagggttaggtgctcctgttggatcagtcattgttggttcaaaggccttcatagacaaggctaaaattgttaggaagaccctaggtggtggaatgagacaggtgggaattctttgtgctgctgcctatgttggcgttcgggacactgtgggcaagcttgccgatgaccataggaaggctaaagttttggcagaaggactgaagaaaattaaacagtttacagttgatttaacttcagtggagaccaatatggtattctttgatatcacggatccacgcatatcacctgacaagctgtgtcaagtcctggaacagcgcaatgtgcttgcaatgccagcaagctcaaagagcgtcaggcttgtcattcactaccaaatttcagatactgacgtccagtatgcattgacatgtatcgagaaagttgtcgaagaaatactgtcaggcaatgttaagttggagcatttgacaaatggtactaccgcaaattcatacgggcactagggatatcgacacatctttgcatctattgcagtaatccagcgtgtttgtgatcgtggccgttgtagtaacaactttgcagaataatctagtgctgtttactctctactaggaatgtcttatggcgtgct

SEQ ID NO: 1324 - DNA, 1624 bp, Brachypodium distachyon
atcattcattcattctagtttcctcaggtcatatcgctgttgcagcgtgagtttgagcgcaacacacacaatggtgaccaaggtggtggacctccggtcggacacggtgacgaagccctcggatgccatgcgcgccgccatggcggccgcggacgtggacgacgacgtcctgggcgcggacccgacggcgcagcgcttcgaggcggagatggccaggatcatgggcaaggaggccgccctgttcgtgccgtccggcaccatggccaacctcgtctccgtcctcgtccactgcgacaccaggggcagcgagatcatcctcggcgacacctcccacatccacatctacgagaacggcggcatctcctccctcggcggcgtccaccccaagaccctgccgaacaaccccgacggcaccatggacatcgacaagatcgtcgctgccatcaggcatcaggacggggcgctctattaccccaccaccaggctcatctgcttggagaacacacacgcaaattgtggtggcaagtgtctgtctgtagaatacactgacaaggtcggtgaagttgccaaaagccatggactgaagcttcatatcgacggagctcgcatttttaatgcttctgtggcacttggagttcctgttcatagacttgtgagagcagctgattcggtttcggtgtgcctatccaaagggttaggtgctcctgttggatcagtcattgttggttcaaaggccttcatagacaaggctaaaattgttaggaagaccctaggtggtggaatgagacaggtgggaattctttgtgctgctgcctatgttggcgttcgggacactgtgggcaagcttgccgatgaccataggaaggctaaagttttggcagaaggactgaagaaaattaaacagtttacagttgatttaacttcagtggagaccaatatggtattctttgatatcacggatccacgcatatcacctgacaagctgtgtcaagtcctggaacagcgcaatgtgcttgcaatgccagcaagctcaaagagcgtcaggcttgtcattcactaccaaatttcagatactgacgtccagtatgcattgacatgtatcgagaaagttgtcgaagaaatactgtcaggcaatgttaagttggagcatttgacaaatggtactaccgcaaattcatacgggcactagggatatcgacacatctttgcatctattgcagtaatccagcgtgtttgtgatcgtggccgttgtagtaacaactttgcagaataatctagtgctgtttactctctactaggaatgtcttatggcgtgctgcatgattcacgttccttccctggttggatcttttaggtctccttgaaatacttatttctcgttccactgaaaaaagaaagctaatagtaatactccttccgtccaataaaggatgcttcaactttgactttgttcaaaaaaaaaagcttcgactttgactaaatcatgtctagatacattcaaattttgacaaacttaaaatatttttttttagacggaaggagtagcaaggaataaaagacaccggtcgaccttgagttatcgccatgtctgtggaaagctagaaatgaagttgttgataaattg

SEQ ID NO: 1325 - DNA, 1300 bp, Triticum aestivum
aggcaggatggtgaccaaggtggtggacctccgctcggacacggtcaccaagccatccgaggccatgcgtgccgccatggccgcggcggaggtggacgacgacgtcctgggcgcggacccgaccgcgcagcgcttcgaggcggagatggccaggatcacgggcaaggaggccgccctgttcgtgccgtcgggcaccatgggcaacctggtctccgtcctcacgcactgcgacaccaggggcagcgaggtcatcctcggggacacctcccacatccacatgtgcgagaacggaggcatctccaccatcggcggcgtccaccccaggaccgtcagaaacaatcctgacggcaccatggacattgacatgatcgtagctgcgatcaggcatcatgtaggggcgggggcgctgcattatcccaccaccaggctcatctgcctggagaacacgcatggaagatctggtggaaagtgtctgtctgtagaatacaccgacaaggttggcgaagttgctcaaagccatggcttgaagcttcatatcgacggagctcgtatctttaacgcgtccgtggcacttggagttcctgttgataggcttgtgagagctgctgactcagtttcggtatgcctatcgaaaggtttaggtgctcctgttggatcagttattgttggttctaaggccttcatagacaaggctaggattcttaggaagacactaggtggtggaatgaggcaggtcggagttctctgcgctgctgcctatgtcgcagttcgcgacaacgtagccaagcttgccgatgaccataggaaggctaaagttttagcagatggactgaagaaaattaaacagtttacagttgatttaacctcagtggagaccaatatggtattctttgatatctcggatccacgcataacatctgacaaactgtgtcaactcctggaacggcgaaatgtgcttgcgatgccaggaagctccaagagcgtcagacttgtcattcactaccaaatttcagatagtgacgtccagtatactttgacatgtatcgagaaagccgtggaggaaatactgtcaggcaatgttaaattcgagcacttgacaaacggcagtaccacgaattcatatgggcactaggccacttcctttggcacccacctatgaagtgcactatcgagcatgtttgtggccatggccttttgtggtaacaacttcgcagaataatatatgttgctgtttgggccgatgggaaccgaattttctaactgacgcttgttgcgtcaaaatgctaacttttcgcgagca

SEQ ID NO: 1326 - DNA, 1404 bp, Triticum aestivum
ctcctccccactcatcttctctggcccaaccgcggctgccattcccatccgcctcggctggggctccatctgatccacggattctgcgtgagctcgagctacaggtacgcaggcaggatggtgaccaaggtggtggacctccgctcggacacggtcaccaagccgtccgaggccatgcgtgccgccatggccgcggcggaggtggacgacgacgtcctgggcgcggacccgaccgcgcagcgcttcgaggcggagatggccaggatcacgggcaaggaggccgccctgttcgtgccgtcgggcaccatgggcaacctggtctccgtcctcacgcactgcgacaccaggggcagcgaggtcatcctcggggacacctcccacatccacatgtgcgagaacggaggcatctccaccatcggcggcgtccaccccaggaccgtcagaaacgatcctgacggcaccatggacattgacatgatcgtagctgcgatcaggcatcatgtaggggcgggggcgctgcattatcccaccaccaggctcatctgcctggagaacacgcatggaagatctggtggggaagtgtctatctgtagaatacaccgacaaggttggcgaagttgctcaaagccatggcttgaagcttcatatcgacggagctcgtatctttaacgcgtccgtggcacttggagttcctgttgataggcttgtgagagctgctgactcagtttcggtatgcctatcgaaaggtttaggtgctcctgttggatcagttattgttggttctaaggccttcatagacaaggctaggattcttaggaagacactaggtggtggaatgaggcaggtcggagttctctgcgctgctgcctatgtcgcagttcgcgacaacgtagccaagcttgccgatgaccataggaaggctaaagttttagcagatggactgaagaaaattaaacagtttacagttgatttaacctcagtggagaccaatatggtattctttgatatctcggatccacgcataacatctgacaaactgtgtcaactcctggaacggcgaaatgtgcttgcgatgccaggaagctccaagagcgtcagacttgtcattcactaccaaatttcagatagtgacgtccagtatactttgacatgtatcgagaaagccgtggaggaaatactgtcaggcaatgttaaattcgagcacttgacaaacggcagtaccacgaattcatatgggcactaggccacttcctttggcacccacctatgaagtgcactatcgagcatgtttgtggccatggccttttgtggtaacaacttcgcagaataatatatgttgctgtttgggccgatgggaaccgaattttcaactacgcttgtgcgtcaaaacgccacttttcgcga

SEQ ID NO: 1327 - DNA, 1611 bp, Hordeum vulgare
gcacttcctcctctataaagcgcgagcccgcaccgcagtggcagcgacgccaccgaagtctctctccactccactcatcttcgctggcccaacccgcgccccccattcccattcgcctcggctggggctccatctgatccacggattctggtaaaaagcacctgctagcagagcactacgtgttcctgctgaagcgtgagctcgggctacgcaggcaggatggtgaccaaggtggtggacctccgctcggacacggtcaccaagccatccgaggccatgcgtgccgccatggccgcggcggaggtggacgacgacgtcctgggcgcggacccgaccgcgcagcgcttcgaggcggagatggccaggatcacgggcaaggaggccgccctgttcgtgccgtcgggcaccatgggcaacctcgtctccgtcctcacgcactgcgacaccaggggcagcgaggtcatcctcggggacagctcccacatccacatgtgcgagaacggaggcatctccaccatcggcggcgtccactccatgcccgttgttaacaatcccgacggcaccatggacattgacaggatcgttgctgcgattaggcatcgggtcggggcgggggctctgcattatcccaccaccaggctcatctgcctggagaacacgcatggaagatctggtggaaagtgtctgtcagctgaatacatcgacaaggttggtgaagttgctcaaagccatggcttaaagcttcatatcgacggagctcgtatttttaacgcgtccgtggcacttggggttcctgttgacaggcttgtgagagctgccgactcagtttcggtatgcctatcgaaaggtttgggtgctcctgttggatcggttattgttggttctaaggccttcatagaccaggctaggatactgaggaagacactaggtggtggaatgaggcaggtaggagttctatgtgctgctgcctatgttgcagttcgcgacaacgtaggcaagcttgccgatgaccacaggaaggctaaagtattagcagatgggctgaagaaaattaaacagtttacagttgatttaacttcagtggagaccaatatggtattcttcgatatcgcggatccacgcataacatctgacaaactgtgtcaactcctggaacggcgcaatgtgcttgcgatgccaggaacctccaagagcgtcagacttgtcattcactaccaaatttcagatagtgacgtccagtatattttgacatgtatcgagaaagctgtggaggaaatactgtcaggcaatgcaaagttcgagcacttgacaaacggcagtaccacgaactcatatgggcactaggccacttccttctgcgcccacctatgaagaagggcagtatctagcttgtttgtggccttggccctttgtagtagtaacaactttgcagaataatatgttgctctttgggccgatggaagtccccccacactgaactttgtgtttgtgcatgcccggatggatatgtttgccaggccggcccatcacttgtcaaagaagtgtactctaactttcctggaaaaaaagtgtacccgatttgatcatacgctaatcatacacgtaaatgcg

SEQ ID NO: 1328 - DNA, 1376 bp, Secale cereale
tctgccccaacccgcgttcccctgccattcccatccgcctcggctcgggctccatccatttgatccacagactctgcgtgagctcgagctacagctacgaaggcaggatggtgaccaaggtggtggacctccgctcggacacggtcaccaagccatccgaggccatgcgcgccgccatggccgcggcggaggtggacgacgacgttctgggcgccgacccgaccgcgcagcgcttcgaggcggagatggccaggatcatgggcaaggaggccgcactgtacgtgccgtcgggcaccatgggcaacctgatctccgtcctcacgcactgcgacaccaggggcagcgaggtcatcctcggggacagctcccacatccacatgtgcgagaacgggggcatctccaccatcggcggcgtccaccccaggaccgtcagaaacaatcctgacggcaccatggacattgacatgatcgttgctgccatcaggcatcatgtcggggcgggggcgctgcattatcccaccaccaggctcatctgcctggagaacacgcatggaagatctggtggaaagtgtctgtctgtagaatacatcgacaaggttggcgaagttgctcaaagccacggcttgaagctgcatatcgacggagctcgtatttttaacgcgtccgtggcacttggagttcctgttgatagacttgtgagagctgctgactctgtttcggtatgcctatcgaaaggtttaggtgcgcctgttgggtcagtaattgttggttctaaggccttcatagacaaggctaggattcttaggaagacactaggtggtggaatgaggcaggtaggagttctctgtgctgctgcccatgttgcagttcgcgacaacgtagccaagcttgccgatgaccacagaaaggccaaagttttagcagaaggactgaagaaaattaaacagtttacagttgatttaacctcagtggagaccaatatggtattctttgatatcgcggatccacgcataacatctgacaaactgtgtcaactcctggaacggcgcaatgtgattgcaatgccaggaagctccaagagcgtcagacttgtcattcactaccaaatttcagatggtgacgtccagtatactttgacatgtatcgagaaagccgtagaggaaatactgtcaggcaatgctaaattcgagcacttgacaaacggcagtaccacgaattcgtatgggcactaggccacttcctttggcgcccacctatgaagtgcagtatccagcttgtttgtggccatggccttttgtagtaacaacttcgcagaataatatttgttgctgtttgggccgatgggaaccgaattttctaactgatgctcgttgcgt

SEQ ID NO: 1329 - DNA, 1287 bp, Secale cereale
gttcctgctgaagcgtgagctcgagctacagctacgcaggcaggatggtgagcaaggtggtggacctccgctccgacacggtcaccaagccatcggaggccatgcgcgccgccatggccgcggcggaggtggacgacgacgttctgggcgccgacccgaccgcgcagcgcttcgaggcggagatggccaggatcacgggcaaggaggccgccctgttcgtgccgtcgggcaccatgggcaacctgatctccgtcctcacgcactgcgacatcaggggcagcgaggtcatcctcggggacagctcccacatccacatgtgcgagaacggaggcatctccaccatcgggggcgtccaccccagggccgtcagaaacaatgctgacggcaccatggacattgacatgatcgttgctgccatcaggcatcatgtcggggcgggggcgctgcattatcccaccaccaggctcatctgcctggagaacacgcatggaagatctggtggaaaatgtctgtccgtagaatacatagacaaggttggcgaagttgctcaaagccatggcttgaagcttcatatcgacggagctcgtatttttaacgcgtccgtggcacttggagttcctgttgatagacttgtgagagctgctgactcagtttcggtatgcctatcgaaaggtttaggtgcgcctgttgggtcagtaattgttggttctaaggccttcatagacaaggctaggattcttaggaagacacttggtggtggaatgaggcaggtaggagttctctgtgctgctgcctatgtcgcagttcgcgacaacgtagccaagcttgccgatgaccacaggaaggccaaagttttagcagaaggactgaagaaaattgaacagtttacagttgatttaacctcagtggagaccaatatggtattctttgatatcgcggatccacgcataacatctgacaaactgtgtcaagtcctggaacggcgcaatgtgattgcaatgccaggaagctccaagagcgtcagacttgtcattcactaccaaatttcagatagtgacgtccagtatactttgacatgtatcgagaaagccgtggaggaaatactgtcaggcaatgctaaattcgagcacttgacaaacggcggtaccacgaattcgtatgggcactaggccacttcctttggcgcccacctatgaagtgcagtatccagcttgtttgtggccatggccttctgtagtaacaactttgcagaataatatatgttgctgtttgggccgatgggaaccg

SEQ ID NO: 1330 - DNA, 1322 bp, Secale cereale
aaagccagaccactctagtctctctgcgccgcactcatcttctctgtctctgccccaacccccgcctgccattcccatccgcctcggctcgtgctccatctgatccacggattctgctaccgactcgtacgtgttcctgctgaagcgtgagcgcaggcgggatggtgaccaaggtggtggacctccgctccgacacggtcaccaagccatccgaggccatgcgcgccgccatggccgcggcggaggtggacgacgacattctgggcgcggacccgacagcgcagcgcttcgaggcggagatggccaggatcacgggcaaggaggcggccctgttcgtgccgtcgggcaccatgggcaacctgatctccgtcctcacgcactgcgacatcaggggcagcgaggtcatcctcggggacagctcccacatccacatgtgcgagaacgggggcatctccaccatcgggggcgtccaccccagggccgtcagaaacaatactgacggcaccatggatattgacatgatcgttgctgccatcaggcatcatgtcggggcgggggcgctgcattatcccaccaccaggctcatctgcctggagaacacgcatggaagatctggtggaaaatgtctgtccgtagaatacatagacaaggttggcgaagttgctcaaagccatggcttgaagcttcatatcgacggagctcgtatttttaacgcgtccgtggcacttggagttcctgttgataggcttgtgagagctgctgactctgtttcggtatgcctatcgaaaggtttaggtgcccctgttggatcagttattgttggttctaaggccttcatagacaaggctaggattcttaggaagacactaggtggtggaatgaggcaggtaggagttctctgtgctgctgcccatgtcgcagttcgcgacaacgtagccaagcttgccgatgaccataggaaggccaaagttttagcagaaggactgaagaaaattaaacagtttacagttgatttaacctcagtggagaccaatatggtattctttgatatcgcggatccacgcataacatctgacaaactgtgtcaagtcctggaacggcgcaatgtgattgcaatgccaggaagctccaagagcgtcagacttgtcatccactaccaaatttcagatagtgacgtccagtatactttgacatgtatcgagaaagccgtggaggaaatactgtcaggcaattctaaattcgagcacttgacaaacggcggtaccacgaattcatatgggcactaggccacttcctttggcgcccacctatgaagtgcagta

SEQ ID NO: 1331 - DNA, 1422 bp, Secale cereale
accggcccaacccgcgcccgccattcccatccgcctcggctcgggctccatctgatccacagactctgctcccgagtcgtacgtgttcctgctgaagcgtgagctcgagctacagctacgcaggcaggatggtgagcaaggtggtggacctccgctccgacacggtcaccaagccatcggaggccatgcgcgccgccatggccgcggcggaggtggacgacgacgttctgggcgccgacccgaccgcgcagcgcttcgaggcggagatggccaggatcacgggcaaggaggccgccctgttcgtgccgtcgggcaccatgggcaacctgatctccgtcctcacgcactgcgacatcaggggcagcgaggtcatcctcggggacagctcccacatccacatgtgcgagaacgggggcgtctccaccatcggcggcgtccaccccaggaccgtcagaaacaatcctgacggcaccatggacattgacatgatcgttgctgccatcaggcatcatgtcggggcgggggcgctgcattatcccaccaccaggctcatctgcttggagaacacgcatggaagatctggtggaaaatgtctgtccgtagaatacatagacaaggttggcgaagttgctcaaagccatggcttgaagcttcatatcgacggagctcgtatttttaacgcgtccgtggcacttggagttcctgttgataggcttgtgagagctgctgactctgtttcggtatgcctatcgaaggtttaggtgcccctgttggatcagttattgttggttctaaggccttcatagacaaggctaggattcttaggaagacactaggtggtggaatgaggcaggtaggagttctctgtgctgctgcccatgtcgcagttcgcgacaacgtagccaagcttgccgatgaccacagaaaggccaaagttttagcagaaggactgaagaaaattaaacagtttacagttgatttaacctcagtggagaccaatatggtattctttgatatcgcggatccacgcataacatctgacaaactgtgtcaactcctggaacggcgcaatgtgattgcaatgccaggaagctccaagagcgtcagactagtcatccactaccaaatttcagatagtgacgtccagtatactttgacatgtatcgagaaagccgtggaggaaatactgtcaggcaatgctaaattcgagcacttgacaaacggcagtaccacaaattcatatgggcactaggccacttcctttggcgcccacctatgaagtgcagtatccagcttgtttgtggccatggccttttgtagtaacaacttcgcagaataatatttgttgctgtttgggccgatgggaaccgaattttctaactgatgctcgttgcgtcaaaatgccaacttttcgagagcacc

SEQ ID NO: 1332 - DNA, 1642 bp, Oryza sativa
gcgcttgtgacgcgcgcgtttggtgctgtggactgtatgtccaccggttcacgaatcgctcggcgcagcgcgcgtcccacctctataaagggcaggtctcatgggccgaagaggccaccaccccacccccacttttgctgctgcggaccgcgcctcatcgcgtcccgtctccacccgcgcctctcctctcgtcccgcgcctcggccgccgtctgattccgtgcagttggaggctaggaggagctcctcaaaatggtgaccaacgtggtggacctacggtcggacacggtgacgaagccctccgacgcgatgcgcgccgccatggccgccgcggacgtggacgacgacgtccttggcgccgacccgaccgcgcaccgcttcgagatggagatggcgaggatcacgggcaaggaggccgcgctgttcgtgccgtccggcaccatggccaacctcatctccgtcctcgtccactgcgacaccaggggcagcgaggtcatcctcggcgacaactcccacatccatatctacgagaacggcgggatctccaccatcggcggcgtccaccccaagaccgtcaggaacaaccccgatggaaccatggacatcgacaagattgtcgtcgccatcaggcatccggatggggcgctgtattatccgaccacaaggctgatctgcctggagaatacccatgcaaactgtggtggaaagtgtctgtctgctgaatatactgacgaggttggtgaagttgccaagagtcatggtctgaagcttcacatagatggagctcgcatttttaatgcttctgtggcccttggagttcctgttcatcgacttgtgaaagctgcggattcagtctcggtgtgcatatctaaagggttaggcgctcctgttggatcagttattgttggttcgacggccttcatagaaaaggctaaaattcttaggaagacactaggtggtggaatgaggcaagtgggaattctttgtgcggctgcctatgttgccgttcgcgacactgtaggaaaacttgctgatgaccatagaagggctaaagttttagcagatggtctgaagaaaatcaagcattttagagttgatacaacttcagtggagaccaatatggtattctttgatattgtggattcacgcatatcacctgacaaactgtgtcaagtccttgaacaacgcaatgtgcttgccatgccagcaggctcgaagagcatgaggcttgtcatccactaccaaatttctgatagtgatgttcagtatgcactgacatgcgtggagaaagctgctgaagaaatactgacaggcagtaagaagtttgaacatctgacaaacggtactaccaggaattcatacgggcactagtagatcactcctttcgtgcccactgatgcatcagtccagcgtccagcttgcttgtcatctcatgactgatgtactcacaacttggcttaataataactgatgttcactctgttggaatgagctgttactatgtgcgcggtggttcaccttcaaataactgcctttttctgttctttttctgaaagagtgctatatttgactttgaaacaaaggctaacagaagaaaatttaacaaaataaaaggaaggctaacagaagaaaattttcccggc

SEQ ID NO: 1333 - DNA, 1364 bp, Oryza sativa
accaccccacccccacttttgctgctgcggaccgcgcctcatcgcgtcccgtctccacccgcgcctctcctctcgtcccgcgcctcggccgccgtctgattccgtgcagttggaggctaggaggagctcctcaaaatggtgaccaacgtggtggacctacggtcggacacggtgacgaagccctccgacgcgatgcgcgccgccatggccgccgcggacgtggacgacgacgtccttggcgccgacccgaccgcgcaccgcttcgagatggagatggcgaggatcacgggcaaggaggccgcgctgttcgtgccgtccggcaccatggccaacctcatctccgtcctcgtccactgcgacaccaggggcagcgaggtcatcctcggcgacaactcccacatccatatctacgagaacggcgggatctccaccatcggcggcgtccaccccaagaccgtcaggaacaaccccgatggaaccatggacatcgacaagattgtcgtcgccatcaggcatccggatggggcgctgtattatccgaccacaaggctgatctgcctggagaatacccatgcaaactgtggtggaaagtgtctgtctgctgaatatactgacgaggttggtgaagttgccaagagtcatggtctgaagcttcacatagatggagctcgcatttttaatgcttctgtggcccttggagttcctgttcatcgacttgtgaaagctgcggattcagtctcggtgtgcatatctaaagggttaggcgctcctgttggatcagttattgttggttcgacggccttcatagaaaaggctaaaattcttaggaagacactaggtggtggaatgaggcaagtgggaattctttgtgcggctgcctatgttgccgttcgcgacactgtaggaaaacttgctgatgaccatagaagggctaaagttttagcagatggtctgaagaaaatcaagcattttagagttgatacaacttcagtggagaccaatatggtattctttgatattgtggattcacgcatatcacctgacaaactgtgtcaagtccttgaacaacgcaatgtgcttgccatgccagcaggctcgaagagcatgaggcttgtcatccactaccaaatttctgatagtgatgttcagtatgcactgacatgcgtggagaaagctgctgaagaaatactgacaggcagtaagaagtttgaacatctgacaaacggtactaccaggaattcatacgggcactagtagatcactcctttcgtgcccactgatgcatcagtccagcgtccagcttgcttgtcatctcatgactgatgtactcacaacttggcttaataataactgatgttcactct

SEQ ID NO: 1334 - DNA, 1611 bp, Hordeum vulgare
gggaggattagaaagcaacggcacaacgctttgtaggtgaaggtcgcctcgtccagctccagctccagctcctctcctcttcttctagccgcctctataaatcaagcacgactcgtcctcggcggcaacgtactgccctccactcactcttggtccggccggcgcctcacaagtcagaaagaatggcgaccaaggtggtggacctgcggtcggacacggtgaccaagccgtcggaagccatgcgcgccgccatggccgcggcggacgtcgacgacgacgtgctgggagccgacccgacggcgcgccgcttcgaggcggagatggcccggatcatgggcaaggaggccgccctgttcgtgccgtccggcaccatggccaacctcatctccgtcctggcgcactgcgacaccaggggcagcgaggtcatcctcggcgacgactcccacatccacgtctacgagcacggcggcatctccaccctcggcggcgtccaccccaggactgtccccaacaaccccgacggcaccatggacgtcgacaggatcgtcgctgccatccggagccccgacggcgcgctctactaccccaccaccaggctcatctgcctcgagaatacccatggaaattctggtgggaagtgtctgactgtcgaatatactgacaaggttggggaagttgcaaaggctcatggcttgaagcttcatatcgacggagctcgtattttcaatgcttctgttgcgcttggagttcctgtcgatacacttgtgagagctgctgattcagtttcggtatgcctgtcgaaagggataggtgctcctgttggatcagttattgttggttccaaggccttcataaacaagactaaaattcttaggaagacgctaggtggtggaatgaggcaggtaggggttctctgtgctgctgcagaagtcggagttcgcgataccatcggcaagcttaccgacgaccataggaaggccaaagttttagctgacggactgaagaaaatcgaacagtttacagttgatttgacttcagtggagaccaatatggtattctttcacatggcggatccacgcatcactccggccaaactgtgcaaagtcctggagcagcgcaatgtgcttgcaatgccaacaagttccaagagcgtaagacttgtggttcattaccaaatttcagatagtgatgtccagtataccctgacatgcatcgagaaagccgttggtgaaatactggcatgcgacgctaaactggagcgtccgacgaacggcgccgccgcgaattcataagggcactagcactaagctagctaggccacttcctctttgtggcaacctatgcacaatgcatcgatgaagaaatgcagtaccatcctgcttgtttttggtcgtggccttggtgacagtatcgacaactgtgcggaataatcgattgcctgcttatgagtccaatgtcaatgtgaacgttgttcttcagcttggataacatgatatgcaatccagctagggataataaggatactggaaatgttggccatcgcttgtccacaagtgtattttttaaattcatgtatatcttttgggatacacgaccgtttttttaatttcg

SEQ ID NO: 1335 - DNA, 1974 bp, Setaria italica
ggcggcagctccagggcacccagattgcgcccgcgcccagttcccctcttccaaggcgcgcgcgccctgcgcctctcgtcctctataaaggacagccgctccgcatcgcgaaggccaaggccaccaccgcgccccgcgctctccggcagtcttcggtctgatcgccgaccgcgcgttccgtcaccgactcaccgcccgtcccggccgggctcccggcaggtcgaggtgctccgtcccatcgccggatccccggggcgcgacgcgacccctctcgtgatcccggtctattgcaccctgaaagcctccgttgctcccctgcagcggtgagcgagctgtagccgctgcaggatggtgaccaaggtggtggacctgcggtcggacacggtcaccaagcccacggaggccatgcgcgcagccatggccgcggccgacgtcgacgacgacgtcctgggcgccgacccgaccgcgcagcgcttcgaggcggagatggccaagctcatgggcaaggaggccgcgctcttcgtgccctcgggcaccatggccaacctcgtctccgtcctcgtgcactgcgacgtccggggcagcgaggtcatcctcggcgacaactcgcacatccacatctacgagaatgggggcatctccaccatcggcggcgtgcaccccaggaccgtcaagaacaaccccgacggcaccatggacatcgacaagatcgtcgctgccattaggaaccgggccggggcgctgttgtacccgacgaccaggttgatctgcttggagaacacacatgcaaattgtggtgggaaatgtttgtctgcagaatacactgataaggttggagaagttgccaagagtcatggcctgaagctccatattgacggagcacgcatttttaacgcctctgtggcacttggagttcctgtagatagactcgtgaaagctgctgattcagtttcggtatgcctatcaaaaggtttaggcgcccccgttggatcagttatcgttggttcgcaggccttcattgacaaggcaaaaattcttaggaagaccctaggtggtggaatgaggcagattggtgttgtttgtgctgctgcttatgttgccgttcgtgacactgtgggaaagcttgcggatgaccacagaaaggctaaagctttagcagagggactgaagaaaattaaacagtttaaagtggattcagcttcggtggagaccaatatggtattctttgatatcatggatccacgcatatcacctgatagattatgtcaagtcttggaacaacgtaatgtgcttgcaatgccagcgagttcaaaaagtatgaggttcgtcctccattaccaaatttcagatagtgatgttaagtacgcgttgacatgtgtcgagaaagctgttgaagagctactgaagggcagtaccaaattcgagcatttgacaaatggctttaccaaacactcgtatgggcactagatcacgtcctctctacggccttgaagcatctgctggctgtcctgcttatttgtgatcaacgctagctattgtagtcagttagtcactagccaaacctttcctgaataatcgttgcccttcagctcggatgtgttaattcgtgttgcggtttaccttgctataattgctcgatctgctttcgcttcccggtaagatggatgcaaagaggaaatacagcgaaaagtaaacgtaaaccaaagaattacaggtgcagaattaatataggacaaaaggaatacagtgagctctgagctctcatagaagaatgatgctggacttgccatcgcgacgatatctgtgatagtgtgattctgtgaaatgctagaaatgggcttaatgggccgatcgctcctccgtcgtcacgctccggcacggcggtacctccctcccctttcaggcctccacagcgttcttggagccatgcgtgcgattctctctaccgtcttgtccgttttgacggactcgtag

SEQ ID NO: 1336 - DNA, 1572 bp, Hordeum vulgare
acgactggtgttggtgtgctgctgctatctacagtatctatctatgaaaacgatagcgatcaaccagagtattctctagcaagtcgtctcgctgctgcagaaacgatggcggccaaggtggtggacctgcggtcggacacggtgaccaagccgtcggaggccatgcgggccgccatggcggcggcggacgtcgacgacgacgtgctgggagccgaccccacggcccggcgcttcgaggcggagatggcccggatcatgggcaaggaggcggcgctgttcgtgccgtccggcaccatggccaacctcatctccgtcctggcgcactgcgacgccaggggcagcgaggtcatcctcggcgacgactcccacatccacgtctacgagcacggcggcatctccaccctcggcggcgtccaccccaggactgtccccaacaaccccgacggcaccatggacgtcgacaggatcgtcgctgccatccggagccccgacggcgcgctctactaccccaccaccaggctcatctgcctcgagaatacccatggaaattctggtgggaagtgtctgactgtcgaatatactgacaaggttggggaagttgcaaaggctcatggcttgaagcttcatatcgacggagctcgtattttcaatgcttctgttgcgcttggagttcctgtcgatacacttgtgagagctgctgattcagtttcggtatgcctgtcgaaagggataggtgctcctgttggatcagttattgttggttccaaggccttcataaacaaggctaaaattcttaggaagacgctaggtggtggaatgaggcaggtaggggttctctgtgctgctgcagaagtcggagttcgcgataccatcggcaagcttaccgacgaccataggaaggccaaagttttagctgacggactgaagaaaatcgaacagtttacagttgatttgacttcagtggagaccaatatggtattctttcacatggcggatccacgcatcactccggccaaactgtgcaaagtcctggagcagcgcaatgtgcttgcaatgccaacaagttccaagagcgtaagacttgtggttcactaccaaatttcagatagtgatgtccagtataccctgacatgcatcgagaaagccgttggtgaaatactggcatgcgacgctaaactggagcgtccgacgaacggcgccgccgcgaattcataagggcactagcactaagctagctaggccacttcctctttgtggcaacctatgcacaatgcatcgatgaagaaatgcagtaccatcctgcttgtttttggtcgtggccttggtgacagtatcgacaactgtgcggaataatcgattgcctgcttatgagtccaatgtcaatgtgaacgttgttcttcagcttggataacatgatatgcaatccagctagggatactaaggatactggaaatgttggccatcgcttgtccacaagtgtattttttaaattcatgtatattttttgggatacacgaccgtttttttaatttcgaaaatgtttttctttataaatttagcaaaaaaaagtaa

SEQ ID NO: 1337 - DNA, 1675 bp, Sorghum bicolor
cggtccttttggcctctagcgtgtaggctggtgttgtgttctgttggaaacaagtgcaatgagcatcaatgcatcatcagccatcatactggtattacttccaaaagcgcgaaaaaattgccaattttcaaggagaaagcaaaccatatctcaaagacaaagcgtggtggttgagcatccaattcgttcgtgagctttggcgtgtgtaatttattgggagacgactctgtcgctccgctgcagtggaggcctggagggagctgtagtgtagctagaggttctgttcgagcagcaccagctaaatggcgagcaaggtggtggacctccggtcggacacggtgaccaagccctccgaggcgatgcgggccgccatggccgccgccgtcgtcgacgacgacgtcctgggcgccgacccgaccgcgcagcgcttcgaggcggagatggccgcgatcatgggcaaggaggccgcgctcttcgtgccgtcgggcaccatgggcaacctcatctccgtcctcgtgcactgcgacgtcaggggcagcgaggccatcctcggcgacaactcgcacatccacgtctacgagaacggcggcatctccaccatcggcggcgtgcaccccaggaccgtcaagaataaccccgacggcaccatggatgttgacaagatcgtcgccgccatcaggcatccggatcttcattacccgacgaccaggctcatctgcttggagaacacacacgggaattctggtggaaaatgtttatcagtagaatacactgacaaggttggtgaaattgccaagagccatggcttgaagcttcatattgatggagctcgcatctttaacgcgtctgtggcacttggagttcctgtagatagacttgtgaaagctgctgattcagtttcggtatgcctatcaaaaggattaggcgcacccgtgggatcaattattgttggttcgaaggccttcattgacaaggccaaaattctccgaaagaccctaggtggtggaatgagacaggtgggagttctttgtgctgctgctcatgttgccattcgtgacactgtgggaaagctcgcggatgaccacagaaaggctaaagttttggcagagggactgaagaaaattgaacagcttacagtggattcggcttcggtccagacaaatatggtattctttgatatcatggatccaagaatatcacctgacaaactgtgtgcagtcttggaacaacacaatgtgcttgcaatgccagctagttcaaaaaggattaggttcgtgatccattaccaaatttcagatagcgatgttcagtatgcattgacatgtgtcgagaaagctgttgaagaactactgaaaggcagtactgaattcgagcatctgacaaacggaactaccaaaagctcatatgggcactagatcgatcacttcgattctgccgacctgatgcattcacactagttggtgccctgcttgtttgtgagtgaccgaagctatagctagctattgtagtcaggccgcatgtcccgaataattgttgctgttcagtctttgcttggatttgctcattcttgtgtctctgctttcaccggtaataatacgggcgctgttaattttttttttgaaagatcgacatcgctcgagtttatttgccgaatctggcagcctatttttctctc

SEQ ID NO: 1338 - DNA, 2121 bp, Sorghum bicolor
atcagactttgttctgtatccctttctttccagtgaccagtgcagtctgtagtctggacacggcgcacctggacgcatacgttgtcgacgtgtgcgtgtggaggaggacgacgtcggagtcgtctcctgactccctcgcctgtttgcttcgtttgggagcgagcgggcgtcctggactgtggcgactctgagcggtccttttggcctctagcgtgtaggctggtgttgtgttctgttggaaacaagtgcaatgagcatcaatgcatcatcagccatcatactggtattacttccaaaagcgcgaaaaaattgccaattttcaaggagaaagcaaaccatatctcaaagacaaagcgtggtggttgagcatccaattcgttcgtgagctttggcgtgtgtaatttattgggagacgactctgtcgctccgctgcagtggaggcctggagggagctgtagtgtagctagaggttctgttcgagcagcaccagctaaatggcgagcaaggtggtggacctccggtcggacacggtgaccaagccctccgaggcgatgcgggccgccatggccgccgccgtcgtcgacgacgacgtcctgggcgccgacccgaccgcgcagcgcttcgaggcggagatggccgcgatcatgggcaaggaggccgcgctcttcgtgccgtcgggcaccatgggcaacctcatctccgtcctcgtgcactgcgacgtcaggggcagcgaggccatcctcggcgacaactcgcacatccacgtctacgagaacggcggcatctccaccatcggcggcgtgcaccccaggaccgtcaagaataaccccgacggcaccatggatgttgacaagatcgtcgccgccatcaggcatccggatcttcattacccgacgaccaggctcatctgcttggagaacacacacgggaattctggtggaaaatgtttatcagtagaatacactgacaaggttggtgaaattgccaagagccatggcttgaagcttcatattgatggagctcgcatctttaacgcgtctgtggcacttggagttcctgtagatagacttgtgaaagctgctgattcagtttcggtatgcctatcaaaaggattaggcgcacccgtgggatcaattattgttggttcgaaggccttcattgacaaggccaaaattctccgaaagaccctaggtggtggaatgagacaggtgggagttctttgtgctgctgctcatgttgccattcgtgacactgtgggaaagctcgcggatgaccacagaaaggctaaagttttggcagagggactgaagaaaattgaacagcttacagtggattcggcttcggtccagacaaatatggtattctttgatatcatggatccaagaatatcacctgacaaactgtgtgcagtcttggaacaacacaatgtgcttgcaatgccagctagttcaaaaaggattaggttcgtgatccattaccaaatttcagatagcgatgttcagtatgcattgacatgtgtcgagaaagctgttgaagaactactgaaaggcagtactgaattcgagcatctgacaaacggaactaccaaaagctcatatgggcactagatcgatcacttcgattctgccgacctgatgcattcacactagttggtgccctgcttgtttgtgagtgaccgaagctatagctagctattgtagtcaggccgcatgtcccgaataattgttgctgttcagtctttgcttggatttgctcattcttgtgtctctgctttcaccggtaataatacgggcgctgttaattttttttttgaaagatcgacatcgctcgagtttatttgccgaatctggcagcctatttttctctcacaacaaatcagcgaacaaagctcagctggtggtaaaagaaaacatttatatatagccaaaggaaaacctttatatacacagagaagaaatatgatagaaggttaaggtaaagcagagcattacagatgcgaaggaataatgcagttctcgatgtttgtggaagggtagaaatgaggttaatgaaccgaactctcactcactgcacatgagctttgctttctgcatatgaaacatcgcgatggttttttttttt

SEQ ID NO: 1339 - DNA, 1350 bp, Secale cereale
cgccttcacaattgattttcacaattgattgagagatcaatccgtttcggttatcctaccactggagtctgcagaaaggatggcgaccaaggtggtggacctgcgctccgacacggtgaccaagccgtcggaggccatgcgggccgccatggccgcggcggaggtggacgacgacgtgctgggcgccgacccgacggcctgccgcttcgaggcggagatggcgcggatcatgggcaaggaggccgcgctgttcgtcccctcgggcaccatggccaacctcatctccgtcctcgcccactgcgacgccaggggcagcgaggtcatcctcggggacgactcccacatccacgtctacgagcacggcggcatctccaccctcggcggtgtccaccccaggaccgtccccaacaaccccgacggcaccatggacgtcgacaagatcgtcgccgccatccggagccccgacggcgcgctctactaccccaccaccaggctcatctgcttggagaacacccatggaaattctggtgggaagtgtctgactgtagaatacactgacaaagttggtgaagttgcaaaggctcatggactgaagctccatatcgacggagctcgtattttcaatgcttccgtggcacttggagttcctgttgatagacttgtgagagctgctgattcagtttcggtatgcctgtcgaaagggataggtgctcctgttggatcagttattgttggctccgaggccttcataaacaaggctaaaattcttaggaagacgctaggtggtggaatgaggcaggtaggagtcctttgtgctgctgccgaagtcggtgttcgcgacaccgtaggcaagcttgccgatgaccatcggaaggctaaagttttagcagatggactgaagaaattcaaacagttcacagttgatttgacttcagtggagaccaatatggtattctttgatatggcggatccgcgcttaacacctgccaaactgtgccaagccctgaaacagcgcaatgtgcttgcaatgccaacaagctccaagagcgtgagattcgtcgtccactaccaaatttcagacagcgacatccagtatgctttgacatgtatcgaggaagccgtggaggaaatgctggcatgcgacgccaaatcggagcgttgttcgaccaacggcactagctaggccacacttccttaattgcgtgattgctatgcatgatgcactatccagatcgtttgtgaaataattgattgcttgttgtgggcatgtggtcgtgttcttcttcttcttcttcttcttcagtttggggagcatgcaatgcaatcagggatagttgtgaccatacaggt

SEQ ID NO: 1340 - DNA, 1555 bp, Triticum aestivum
gaattcggcacgaggcacacttgattgagagatcattccgttgtcctactcaagcctgcagagccaattggatgctgaccaaggtggtggacctgcgctccgacacggtgaccaagccgtcggaggccatgcgggccgccatggccgcggcggacgtggacgacgacgtgctgggcgccgacccgacggcctgccgcttcgaggcggagatggcgcggatcatgggcaaggaggccgcgctgttcgtcccctcgggcaccatggccaacctcatctccgtcctcgcgcactgcgacgccaggggcagcgaggtcatcctcggccacgactcccacatccacgtctacgagcacggcggcatctccaccctcggcggcgtccaccccaggaccgtccccaacaaccccgacggcaccatggacgtcgacaggatcgtcgccgccatccggagcacggacggggcgctctactaccccaccaccaggctcatctgcttggagaacacccatggaaattctggtgggaagtgtctgactgtagaatacactgacaaggttggtgaagtcgctaaggctcatggcctgaagcttcatatcgacggagctcgtatcttcaatgcttccgtggcacttggagttcctgttgacagacttgtgagagctgctgattcagtttcggtatgcctgtcgaaagggataggtgctcctgttggatcagttatcgttggctccaaggccttcatacacaaggctaaaattcttaggaagacactgggtggtggaatgaggcaggtaggagtcctttgtgctgctgccgaagtcggtgttcgcgacaccgtaggcaagcttgcggatgaccatcggaaggctaaagttttagcagatggactgaagaaaatcaaacagttcacagttgatttgagttcagtggagaccaatatggtattctttgatatggcggatccacgcatatcacctgccaaactgtgccaagccctgaaacaacgcaatgtgcttgcaatgccaacaagctccaagagcgtcagattcgtcgtccactaccaaatttcagatagcgacatccagtatactttaaaatgtatcgaggaagccgtggaggaaatcctggcctgcgacgccaaatcggagcgttgttcgaccaacggcacaagctagctaggccacacttcttgaattactacgtgattgctatgcatgatgcactatccagttcgtttgtgaaataattgattgcctgtggtcgtgtcaatgtcgtgggcatgtggtcgtgttcttctgtgttcttcagcttggggagcatgcaatgcaattagggattgttgtgacgatacaggtggatcaatggtctactttgtttggcgtattgtttgaccgtagtacccctcgtccagctacatctaccatgacagcgtattctcttctgcttgggaacctgttctgcatgttttgctattgcccgaacgatcgatccccctgttgtacgttgatgggttttttcttgggtccaaataaatcaaccttgtgggaattgatcc

SEQ ID NO: 1341 - DNA, 1347 bp, Secale cereale
cacaattgattttcacaattgattgagagctcaatccgtttcagttatcctactggagtgtctgcagaaaggatggcggccaaggtggtggacctgcgctccgacacggtgaccaagccgtcggaggccatgcgggccgccatggccgcggcggaggtggacgacgacgtgctgggcgccgacccgacggcctgccgcttcgaggcggagatggcgcggatcatgggcaaggaggccgcgctgttcgtcccctcgggcaccatggccaacctcatctccgtcctcgcccactgcgacgccaggggcagcgaggtcatcctcggggacgactcccacatccacgtctacgagcacggcggcatctccaccctcggcggcgtccaccccaggaccgtccccaacaaccccgacggcaccatggacgtcgacaggatcgtcgccgccatccggagccctgacggcgcgctctattaccccaccaccaggctcatctgcttggagaacacacacggaaattctggtggcaagtgtctgactgtagaatacactgacaaggttggtgaagttgccaaggctcatggactgaagctccatatcgacggagctcgtattttcaatgcttccgtggcacttggagttcctgttgatagacttgtgagagctgctgattcagtttcggtatgcctgtcgaaagggataggtgctcctgttggatcagttattgttggctccgaggccttcataaacaaggctaaaattcttaggaagacgctaggtggtggaatgaggcaggtaggggttctttgtgctgctgccgaagtcggtgtccgcgacaccgtaggcaagcttgctgatgaccataagaaggccaaagttttagcagatggactgaagaaattcaaacagttcacagttgatttgacttcagtggagaccaatatggtattctttgatatggcggatccgcgcataacacctgccaaactgtgccaagccctgaaacagcgcaatgtgcttgcaatgccagcaagctccaagagcgtgagattcgtcgtccactaccaaatttcagacagcgacatccagtatgctttgacatgtatcgaggaagccgtggaggaaatgctggcatgcgacgccaaaccggagcgttgttcgaccaacggcacttgctagctaggccacacttcctgaattactacgtgattgctatgcatgatgcactatccagatcgtttgtgaaataattgattgcctgttgtgggcatgtggtcgtgttcttcttcttcttcttcttcagtttggggagcatgcagtgtaatcagggatagttgtgacgatacaggt

SEQ ID NO: 1342 - DNA, 1642 bp, Zea mays
tgctgtcagactgcgctcgtggcggcgcgcccagttccactctcccagggcgccgcctgcgcctctcgttctctatataaaacaccgccgccccgcgtccgcgaaggccaaggttctcagcacggcgcgcggcccgcctccccaccggtctcgctctcgcagtccctcgaccgctcgtcccggcagagcagtcgcagcacgatggtgaccaacgtggtggacctccggtcggacacggtcaccaagccgtccgacgccatgcgcgccgccatggccgcggccgacgtcgacgacgacgtcctgggcgctgaccccaccgcgcgccgcttcgaggcggagatggccgcgctcctgggcaaggaggcggcgctgttcgtgccctcgggcaccatggccaacctcgtctccgtcctcgcgcactgcgacgtccgcggcagcgaggtcatcctcggggacgcctcccacatccacgtctacgagaacggcggcatctccaccctcggcggcgtgcaccccaggaccgtgcccaacaaccccgacggcaccatggacctcgccaggatcgtcgacgccatcaggaaccccgacggggcgctgctgtacccgacgaccaggctcatctgcctggagaacacgcatgccaattctggtgggaaatgcttgtctgtagagtacacggacaaggttggcgaaattgccgtgaaccacggcttgaagcttcacatcgatggagctcgtattttcaatgcctctgtggcactgggagttcctgtacatagacttgtaaaagctgccgactcagtttcggtatgcctatctaaagggttaggcgcacccatcggatcagttgttgttggttcagaggccttcatcgacaaggctagaattcttaggaagaccctaggcggtgggatgaggcaggttggagttctttgtgccgctgcttatgttgctgttcgtgacaccgtgggaaagcttgcggatgatcacaggaaggctaaagccttggcagagggcctgaagaaaattaaacagcttacggtggattcgtcttcagtcgagaccaatatggtgttcttcgatatcgtggatccacgcatttcaccgagcaagctatgccaagtcttggaacagcgcaatgttcttgcaatgccagcaagttcaaaaagtgtcaggttcgtcatccattaccagatttcagacagcgatgttcaatatgcattgacatgtgtcgagaaagctgttgaggagctattgaagggcggtacaaagttggagcatttgacgaatggtactgccaaaaactcatattggcactagacatcagcagggtgtcctgcttgtttgttatcaacgctagctgttaaaactcttctctattaatgaaatagggcacaccactcgtgtgcccgtttgctccaaaaaaaaatctagctgttaatttgtagtcacacctttgccggatggctgttgctgtttactcttcactcggatgtgttcgttcttgtgctgtatagcttaccttctcagaattacctggtccgtttccgcttcctggtaagacggatgcaatgaagtattgcaaatgcagaacatacgttgcccagacaatacagtttctttagctatgttgccgcactga

SEQ ID NO: 1343 - DNA, 1517 bp, Triticum aestivum
gcagaagggatggcgaccaaggtggtggacctgcgctcagacacggtgaccaagccgtcggaggccatgcgggccgccatggccgcggcggacgtggacgacgacgtgctgggcgccgacccgacggcctgccgcttcgaggcggagatggcgcggatcatgggcaaggaggccgcgctgttcgtcccctcgggcaccatggccaacctcatctccgtcctcgcgcactgcgacgccaggggcagcgaggtcatcctcggccacgactcccacatccacgtctacgagcacggcggcatctccaccctcggcggcgtccacccccggaccgtccccaacaaccccgacggcaccatggacgtcgacaggatcgtcgccgccatccggagcacggacggggcgctctactaccccaccaccaggctcatctgcttggagaacacccatggaaattcgggtgggaagtgtctgaccgtggaatacactgacaaggttggtgaagttgctaaggctcatggcttgaagcttcatatcgacggagctcgtatcttcaatgcctccgtggcacttggagttcccgttgacagactcgtgagagctgccgattcagtttcgatatgcctgtcgaaagggataggtgctcctgttggatcagttattgttggtaccaaggccttcatacacaaggctaaaattcttaggaagacactgggtggtggaatgaggcaggtaggagtcctttgtgctgctgccgaagtcggtgttcgcgacaccgtaggcaagcttgcggatgaccatcggaaggctaaagttttagcagatggactgaagaaaatcaaacagttcacagttgatttgagttcagtggagaccaatatggtattctttgatatggcggatccacgcatatcacctgccaaactgtgccaagccctgaaacaacgcaatgtgcttgcaatgccaacaagctccaagagcgtcagattcgtcgtccactaccaaatttcagatagcgacatccagtatactttaaaatgtatcgaggaagccgtggaggaaatcctggcctgcgacgccaaatcggagcgttgttcgaccaacggcacaagctagctaggccacacttcttgaattactacgtgattgctatgcatgatgcactatccagttcgtttgtgaaataattgattgcctgtggtcgtgtcaatgtcgtgggcatgtggtcgtgttcttctgtgttcttcagcttggggagcatgcaatgcaattagggattgttgtgacgatacaggtggatcaatggtctactttgtttggcgtattgtttgaccgtagtacccctcgtccagctacatctaccatgacagcgtattctcttctgcttgggaacctgttctgcatgttttgctattgcccgaacgatcgatccacctgttgtacgttgatgggttttttcttgggtcaaaataaatcaacattgtgggaattgatcacatgaccttctgtctggatctttg

SEQ ID NO: 1344 - DNA, 1679 bp, Sorghum bicolor
cggccgccccgcgtccgccaaggccaaggctcccccaccaccgcacgccactcgcctccactcgaccactcccccacctccgccgctacgctcgtccccagtggccggcaggacaggtcggggagccgcctccgttttcatcctccgcatcccgcggcgcggagcaggaggatggtgaccaaggtggtggacctgcggtcggacacggtgaccaagccctccgacgccatgcgcgccgccatggcggccgccgacgtcgacgacgacgtcctgggcgccgacccgaccgcgcgccgcttcgagggcgagatggccgcgctcacgggcaaggacgccgcgctgttcgtgccctcgggcaccatggccaacctcatctccgtcctcgtgcactgcgacgtcaggggcagcgaggtcatcctcggggacaactcccacatccacgtctacgagaacggcggcatctccaccatcggcggcgtgcaccccaggaccgtgcccaacaaccccgacggcaccatggacgtcgataagattcttgccgccattaggaacccggacggggcgctgctgtacccgacgaccaggttgatctgcttggagaacacacatgccaattgtggtgggaaatgtttgtccgtagaatacacagacaaggttggccaaattgccgtgaaccacggcttgaagcttcacattgatggagctcgtattttcaatgcctctgtggcgctgggagttcctgtacatagacttgtaaaagctgccgactcagtttcgatatgcctatctaaagggttaggcgcgcccatcggatcagttattgttggttcaaaggccttcattgacaaggctaaaattcttaggaagaccctaggtggtggaatgagacaggttggagttctttgtgctgctgcttatgttgctgttcgcgacactgtgggaaagcttgcggatgatcacaggaaggcgaaagccttggcagagggcctgaagaaaattaaacagtttacagtggattcatcttcggttgagaccaatatggtgttcttcgatatcgtggatccacgcatttcaccgaacaagctatgccaagtcttggaacagcgcaatgtgcttgcaatgccagcaagttcaaaaagtgtcaggttcgtcgtccattaccaaatttcagatagcgatgttcaatatgcactgacatgtgtcgagaaagctgttgaagagctattgaagggcggtacaaagttggagcacttgacaaatggtactgtcaaaaacgcatattggcactagacgtcagcctggtgccctgcttgtttgtgatcaacgctagctgttaaaactcttctctattaatgaaataggcacactcctcgtttgcccgtttgttaaaaaaaaccgctagctgttaaattgtagccacacctttgctggatagttatagctgttcacccatcactcgcatgcgttcgttcttgtgttgtagtttaccttccgagaatttgcttgatccgtttccgcttcttggtaagagggatgcaacgaaatttgctcgagaagaagacagatgcactgtatgctttgtatgctgtatgcaccgagcaaaaacattgacatcgaaagttaaagacagagcattgccaatgcagaatatatgtgacccagataatactgtttcttgt

SEQ ID NO: 1345 - DNA, 1884 bp, Sorghum bicolor
cccggctgctgctcgggctcgggggcacctagattaagctcgcggctggcgcccgctgatgtgtacgtcgctgggctaggcgagccctccacccttccgggggcgccgcctgcgcctcttgttctcgtccccgccatggccctctataaaaaacacggccgccccgcgtccgccaaggccaaggctcccccaccaccgcacgccactcgcctccactcgaccactcccccacctccgccgctacgctcgtccccagtggccggcaggacaggtcggggagccgcctccgttttcatcctccgcatcccgcggcgcggagcaggaggatggtgaccaaggtggtggacctgcggtcggacacggtgaccaagccctccgacgccatgcgcgccgccatggcggccgccgacgtcgacgacgacgtcctgggcgccgacccgaccgcgcgccgcttcgagggcgagatggccgcgctcacgggcaaggacgccgcgctgttcgtgccctcgggcaccatggccaacctcatctccgtcctcgtgcactgcgacgtcaggggcagcgaggtcatcctcggggacaactcccacatccacgtctacgagaacggcggcatctccaccatcggcggcgtgcaccccaggaccgtgcccaacaaccccgacggcaccatggacgtcgataagattcttgccgccattaggaacccggacggggcgctgctgtacccgacgaccaggttgatctgcttggagaacacacatgccaattgtggtgggaaatgtttgtccgtagaatacacagacaaggttggccaaattgccgtgaaccacggcttgaagcttcacattgatggagctcgtattttcaatgcctctgtggcgctgggagttcctgtacatagacttgtaaaagctgccgactcagtttcgatatgcctatctaaagggttaggcgcgcccatcggatcagttattgttggttcaaaggccttcattgacaaggctaaaattcttaggaagaccctaggtggtggaatgagacaggttggagttctttgtgctgctgcttatgttgctgttcgcgacactgtgggaaagcttgcggatgatcacaggaaggcgaaagccttggcagagggcctgaagaaaattaaacagtttacagtggattcatcttcggttgagaccaatatggtgttcttcgatatcgtggatccacgcatttcaccgaacaagctatgccaagtcttggaacagcgcaatgtgcttgcaatgccagcaagttcaaaaagtgtcaggttcgtcgtccattaccaaatttcagatagcgatgttcaatatgcactgacatgtgtcgagaaagctgttgaagagctattgaagggcggtacaaagttggagcacttgacaaatggtactgtcaaaaacgcatattggcactagacgtcagcctggtgccctgcttgtttgtgatcaacgctagctgttaaaactcttctctattaatgaaataggcacactcctcgtttgcccgtttgttaaaaaaaaccgctagctgttaaattgtagccacacctttgctggatagttatagctgttcacccatcactcgcatgcgttcgttcttgtgttgtagtttaccttccgagaatttgcttgatccgtttccgcttcttggtaagagggatgcaacgaaatttgctcgagaagaagacagatgcactgtatgctttgtatgctgtatgcaccgagcaaaaacattgacatcgaaagttaaagacagagcattgccaatgcagaatatatgtgacccagataatactgtttcttgtgttatagtgccgcccttattacttatagataattgctagagagcaaccgg

SEQ ID NO: 1346 - DNA, 1217 bp, Panicum virgatum
caaggtggtggacctgcggtcggacacggtcaccaagccctccgacgccatgcgctccgccatggcctcggccgacgtcgacgacgacgtcctgggcgccgaccccaccgcgcgccgcttcgaggccgagatggccgcgctcatgggcaaggaggccgcgctgttcgtgccctcgggcaccatggccaacctcgtctccgtcctcgtgcactgcgacgtccggggcagcgaggtcatcctcggcgacgcctcgcacatccacgtctacgagaacggcggcatctccaccatcggcggcgtccaccccaagaccgtgcccaacaaccccgacggcaccatggacatcgacaggatcgtcgccgccatcagggaccgcgccggggcgctgctgtacccgaccaccaggctcatctgcttggagaacacgcatgcaaattgtggtggaaaatgtttgtctgtagaatacactgacaaggttggggaaattgccaagagccatggcctcaagcttcacattgatggagcccgcatttttaacgcctccgtggcacttggagttcctgtagatagactcgtgaaagctgctgattcagtttcggtatgcctatcaaaaggtttaggcgcccccgttggatcagttattgttggttccaaggccttcattgacaaggccaaaattcttaggaagaccctagggggtggaatgaggcagattggtgttctttgtgctgctgcttatgttgccgttcgtgacaacaggggaaagcttgcggatgaccacagaagggcgaaagttttggcagagggactgaagaaaattaaacagttttcagtggattccgcttcggttgaaaccaatatggtattctttgatatcatggatccacgcatatcacctcacagactatgccaagtcttggaacaacgcaatgttcttgcaatgccagcgagttcaaaaagtgtaaggttcgtcctccattaccaaatttcagatagtgacgttcagtatgcattgacatgtgtggagaaagctgttgatgatctactgaagggcggcgctaagtttgagcatttgacaaatggaactacgaagaactcatacgggcactagatcgcttcatgtgtcctgcttgtttgtgatcaacgcttgctattgcagtcactcggtcacacatttcctgaataatcgttgctgttcactctttgctcggatgtgc

SEQ ID NO: 1347 - DNA, 1280 bp, Secale cereale
tcacaattgattttcacaattgattgagagctcaatccgtttcagttatcctaccggagtgtctgcagaaaggatggcggccaaggtggtggacctgcgctccgacacggtgaccaagccgtcggaggccatgcgggccgccatggccgcggcggaggtggacgacgacgtgctgggcgccgacccgacggcccggcgcttcgaggcggagatggcgcggatcatgggcaaggaggccgcgctgttcgtcccctcgggcaccatggccaacctcatctccgtcctcgcccactgcgacgccaggggcagcgaggtcatcctcggcgacgactcccacatccacgtctacgagcacggcggcatctccaccctcggcggcgtccaccccaggaccgtccccaacaaccccgacggcaccatggacgtcgacaggatcgtcgccgccatcaggagccccgacggcgcgctctactaccccaccaccaggctcatctgcttggagaacacccatggaaattcgggtgggaagtgtctgacggtagaatacactgacaagattggggaagttgctaaggctcatggattgaagcttcatatcgacggagctcgtatcttcaatgcttccgtggcacttggagttcctgttgatagacttgtgagagccgcggattcggtttcggtatgcctgtcgaaagggataggtgctcctgttggatcagttattgttggctccgaggccttcataaacaaggctaaaattcttaggaagacgctaggtggtggaatgaggcaggtcggggttctttgtgctgctgccgaagtcggtgtccgcgacaccgtaggcaagcttgccgatgaccatcggaaggctaaagttttagcagatggactgaagaaattcaaacagttcacagttgatttgacttcagtggagaccaatatggtattctttgatatggcggatccgcgcttaacacctgccaaactgtgccaagccctgaaacagcgcaatgtgcttgcaatgccaacaagctccaagagcgtgagattcgtcgtccactaccaaatttcagacagcgacatccagtatgctttgacatgtatcgaggaagcagtggaggaagtcctggcatgcgacgccaaaccggagcgttgttcgaccaacggcacttgctagctaggccacacttcctgaattactacgtgattgctatgcatgatgcactatccagatcgtttgtgaaataattgattgcctgttgtgggcatgtggtcgtgtt

SEQ ID NO: 1348 - DNA, 1313 bp, Triticum aestivum
agagcagaaaggatggcgaccaaggtggtggacctgcgctccgacacggtgaccaagccgtcggaggccatgcgggcggccatggccgcggcggacgtggacgacgacgtgctgggcgccgacccgacggcctgccgcttcgaggcggagatggcgcggatcatgggcaaggaggctgccctgttcgtcccctcgggcaccatggccaacctcatctccgtcctcgcgcactgcgacgccaggggcagcgaggtcatcctcggcgacgactcccacatccacgtctacgagcacggcggcatctccaccctcggcggcgtccaccccaggaccgtccccaacaaccccgacggcaccatggacgtcgacaggatcgtcgccgccatccggagcacggacggggcgctctactaccccaccaccaggctcatctgcttggagaacacccatggaaattctggtgggaagtgtctgactgtagaatacactgacaaggttggggaagttgcaaaggctcatggcctgaagcttcatatcgacggagctcgtatcttcaatgcttccgtggcacttggagttcccgtcgacagactcgtgagagctgcggattcagtttcggtatgcctgtcgaaagggataggtgctcctgttggatcagttattgttggctccaaggccttcatacaaaaggctaaaattcttaggaagacgctaggtggtggaatgaggcaggtaggagtcctttgtgctgctgctgaagtcggtgttcgcgacaccttaggcaagcttgccgatgaccatcggaaggctaaagttttagcagatggactgaagaaaatcaaacatttcacagttgatttgacttcagtggagaccaatatggtgttctttgatatggcggatccgcgcataacacctgccaaactgtgtcaagccctgaaacagcgcagtgtgcttgcaatgccaacaagctccaagagcgtcagattcgtcgtccactaccaaatttcagacggcgacatccagtatactttaaaatgtatcgaggaagccgtggaggaaatgctggcatgcgacgccaaatcggagcgttgttcgaccaacggcactagctagcgcggattcataacggccacacttcctgaattacttgattgctatgcatgatgcactatccagatcgtttgtgaaataatggattgcctgtttgtgcgtgcgcgcggtgtcaatgttgtgggcatgtgggccgtgttcttctgtgttcttcagcttggatggagagcatgcaatgcaattagggatagttgtgaacg

SEQ ID NO: 1349 - DNA, 1569 bp, Triticum aestivum
tagaaagcaacggcccaaccctttctaggtaaggttattattacgtcgcctcgtccagctttccctctcctcttcctctagccgcatctccagtgaagccacagctctccactctcggtctgacccgcgtctcgatcggcgctgcgcagaaagaatggcgaccaaggtggtggacctccgctccgacacggtgaccaagccctcggaggccatgcgcgccgccatggccgcggcggacgtggaggacgacatcctgggctcggacccgaccgcgcgccgcttcgaggcggagatggcccggatcatgggcaaggaggccgcgctgttcgtgccgtcgggcaccatggccaacctcatatccgtcctcgcgcactgcgacacgaggggcagcgaggccatcctcggcgacaactcacacatccacgtctacgagcacggcggcatctccaccctcggcggcgtccaccccaggatcgtcgccaacaacgccgacggcaccatggacatcgacaagatcgttgccgccatcaggagtccggatgggtcactgtactatcccaccaccaggctcatctgcttggagaacacacagggaaattgcggcgggaagtgtctttctgtagaatacaccgataaggttggtgaagttgctaaacccacggcttgaagcttcatatcgacggagctcgtatttcaatgcctccgcagcgcttgggggtcctgttgatagacttgtgagagctgctgattcggtttcggtaggcctagcgaaagggataggtgctcctgttggatcagttattgttggttccaaggccttcatacacaaggctacaattcttaggaagacactaggtggtgggataaggcaggtaggaattctttgtgctgctgccgaagttgcagtccgcgacaccgtcggcaagcttgcggacgatcataggaaggctaaagtcttagcagacgggctgaagaaaatcgaacactttacagttgatttagcttcagtggagaccaatttggtgttctttgatatggcggatgcacgcatatcacctgccaaactgtgtcaagtcctggaacagcgcaatgtgcttgcaacgccaataggctccaagagcgtcagacttgcggtacactaccaaatttcagatggtgacgtccagtatactttgacatgcatcgaggaagccgtgaaggaaatactgactggcgatgcgaaattggagcatctgacgaacagcgctgccacgaattcagaagggcgctagtagctagcttagctaggccacttccctttgccgcccaccttacgtatccatcggtgctgctgtatccagcttgtttgtgatcgtggccggcattggcagtggtaacaacttccaagaatatctattgcctttttatgcatgcgatgtgcgtgtgattatgttgcggagcttgcgactagggatagtaacgatgtatattggataattgcttgcaccattcattatgcctgttgccaatctttatcgtttctgccagtattgtttatttttgaaacaaaggcaaaagttttgcctcatc

SEQ ID NO: 1350 - DNA, 1397 bp, Panicum virgatum
gctaggctctgccgctccctgcagcagagtcgtaggctgcagcagcgccaaaatggcgagcaaggtggtggacctccggtcggacacggtcaccaagccctcgcaggccatgcgggccgccatggccgcggccgacgtcgacgacgacgtcgtgggcgtcgacccgaccgcgcagcgcttccaggcggagatggccgcgctcatgggcaaggaggccgcgctctttgtgccctcgggcaccatgggcaacctcatctccgtcctcgtgcactgcgacgtcaggggcagcgaggccatcctcggcgacaactcgcacatccacgtctacgagaacgggggcatctccaccatcggcggcgtgcaccccaagaccgtgcccaacaactccgacggcaccatggacatcgacaagatcgtcgcggccatcaggcacccggatctgcattacccgaccaccaggctcatctgcctggagaacacacatgggaattctggtggaaaatgtttatctgtagaatacactgacaaggtcggtgaaattgcaacgagccatggcctcaagcttcatattgatggagctcgcatttttaacgcctctgtggcgcttggagtccctgtagatagactcgtgaaagctgctgattcagtttcggtatgcctatctaaagggttaggcgcccccgttgggtcggttattgttggttcgaaggacttcattgagaaggccaaaattcttaggaagaccctaggtggtggcatgaggcaggttggagttctctgtgctgctgctcaagttgccgtccgtgacactgtgggaaagcttgcagatgaccataggaaggctagagctttggcagaggggctgaagaaaattaaacatattacagtcgatccagcttccgttgagaccaatatggtattcttcgatatcgtcgatccaagaatatcacctgacaatctatgccaagtcttggaacagtacaatgtgcttacaatgccagcgagttcaaaaagtatcaggttcgtcctccattaccaaatttcagacagcgacgttcaatacgcagtgacatgtgttgagaaagcttttgaagagctactgaagggtggtacaaacttggagctcttgacaaatggtactacaagaagttcgtacgggcactagatcacttccctttggaccgctccaatgtacaagctcggtgaccagcaatgttttctttaaaccagcaggagcgttgcttaattatttaagaaggggaagcacgtgaaggttgacgatagattctgtttagttatgaagaactgttggtgtttgtgacggtgacctttgctgaataactgatggttaaccgtgaccgcaccttggctgaataaactgctcctgttcactctcg

SEQ ID NO: 1351 - DNA, 1439 bp, Panicum virgatum
cggaaaaccatatcccaatcccaaagacaaagttgtttccaaggatctgaccatacgcccaccccagtgcggcagtgctccagttgagcatccagttcttgagctttggcgacggtatctcatcgctcggctctgccgctcccttcagcagagtcttcgtaggctgcagcagcgccaaaatggcgagcaaggtggtggacctccggtcggacacggtcaccaagccctccgaggctatgcgggccgccatggctgcggccgacgtcgacgacgacgtcgtgggcgtcgacccgaccgcgcggcgcttccaggcggagatggcctcgctcatgggcaaggaggccgcgctcttcgtgccctcgggcaccatgggcaacctcatctccgtcctcgcgcactgcgacgtcaggggcagcgaggccatcctcggcgacaactcgcacatccacgtctacgagaacgggggcatctccaccatcggcggcgtgcaccccaagaccgtgcccaacaaccccgacggcaccatggacatcgacaagatcgtcgccgccatcaggcacccggatctgcattacccgacgaccaggctcatctgcttggagaacacacacgggaattctggtggaaaatgtttatctgcagaatacactgacaaggtcggtgaaattgccaagagccatggcatcaagcttcatattgatggagctcgcatttttaacgcctctgtggcacttggagtccctgtagatagacttgtgaaagctgctgattcagtgtcggtgtgcctatctaaagggttaggcgcccccgttgggtcggttattgttggttcgaaagacttcattgagaaggccaaaattcttaggaagaccctaggtggtggcatgaggcaggttggagttctctgtgctgctgctcaagttgccgtccgtgacactgtgggaaagcttgcagatgaccataggaaggctagagttttggcagagggactgaagaaaattaaacatgttacagtcgatccagcttccgttgagaccaatatggtattcttcgatatcgtcgatccacgaatatcacctgacaatctatgccaagtcttggaacagcacaatgtgtttgcaatgccagcgagttcaaaaagtatcaggttcgtcctccattaccaaatttcagacgccgacgttcgatacgcagtgacatgtgttgagaaagcttttgaagagctattgaagggtggtacaaacttggagcccctgacaaacggtactataagaagttcatacgggcactagatcacttccattcgggggcactagatcacttccctttggaccgccccaatgtacaagctcggtggccagcaatattttctttaaaccagcaggagcactgcttaataattatttaataagaagggaagcacgtgaaggttgacgata

SEQ ID NO: 1352 - DNA, 1176 bp, Secale cereale
cccgcgttcccctgccattcccatccgcctcggctcgggctccatccatttgatccacagactctgctaccgactcgtacgtgttcctgctgaagcgtgagcgcaggcgggatggtgaccaaggtggtggacctccgctccgacacggtcaccaagccatccgaggccatgcgcgccgccatggccgcggcggaggtggacgacgacattctgggcgcggacccgacagcgcagcgcttcgaggcggagatggccaggatcacgggcaaggaggcggccctgttcgtgccgtcgggcaccatgggcaacctgatctccgtcctcacgcactgcgacatcaggggcagcgaggtcatcctcggggacagctcccacatccacatgtgcgagaacgggggcatctccaccatcgggggcgtccaccccagggccgtcagaaacaatactgacggcaccatggatattgacatgatcgttgctgccatcaggcatcatgtcggggcgggggcgctgcattatcccaccaccaggctcatctgcctggagaacacgcatggaagatctggtggaaaatgtctgtccgtagaatacatagacaaggttggcgaagttgctcaaagccatggcttgaagcttcatatcgacggagctcgtatttttaacgcgtccgtggcacttggagttcctgttgatagacttgtgagagctgctgactcagtttcggtatgcctatcgaaaggtttaggtgcgcctgttgggtcagtaattgttggttctaaggccttcatagacaaggctaggattcttaggaagacacttggtggtggaatgaggcaggtaggagttctctgtgctgctgcctatgtcgcagttcgcgacaacgtagccaagcttgccgatgaccacaggaaggccaaagttttagcagaaggactgaagaaaattgaacagtttacagttgatttaacctcagtggagaccaatatggtattctttgatatcgcggatccacgcataacatctgacaaactgtgtcaagtcctggaacggcgcaatgtgattgcaatgccaggaagctccaagagcgtcagacttgtcattcactaccaaatttcagatagtgacgtccagtatactttgacatgtatcgagaaagccgtaggagaaatactaggg

SEQ ID NO: 1353 - DNA, 1388 bp, Saccharum officinarum
aaagcaaaggccgtccaaagtttttgttgcgggacgtgacgtgacaccccgcacacatcaattcacagctggtccgtttcattcatcctgatactctgtcgctgtagcggtgccggtgcagtgctgcagttgggttgcgcagagcaccagccaccaggaaggatggcgaccaacaaggtggtggtggacctgcggtccgacacggtcaccaagccctccgacgccatgcgcgccgccatggccgcggccgaggtcgacgacgacgtgcggggcgcggacccgaccgcgcgccgcttccaggaggcgatggcggcgatcatgggcaaggaggccgcgctcttcgtcccgtcggggaccatgggcaacctcgtctccgtcctcgtgcactgcgacgtccggggcagcgaggccatcctcggcgacggctcgcacatccacctctacgagaacggcggcatctccaccatcggcggcgtgcaccccaagaccgtcagaaacaacgccgacggcaccatggacatcgaccggatcgtcgctgcaatcaggcctccgggcgggggcttgtattacccgaccaccaggctcatctgcttggagaatacacatgggaattctggagggaaatgtttatccgtagaatacactgacaaggtcggggaaattgccaagagtcatggcctgaagcttcatattgatggagctcgcatttttaacgcctctgtggcgcttggagttcctgtggacagacttgtgagagccgcagattcagtttcggtatgcctgtctaaaggtttaggtgcccccgttggatcagttattgttggttcaaaggaattcattgacaaggccaaaattctccgaaagacgctaggtggtggaatgaggcaggttggagttctctgtgctgcagctcatgttgccgttcgtgacactgtgggaaagcttgcggatgaccacagaaaggctaaagctttggcagacggactgaataaaattgaacagttcacagtggattcagcttcagtcgagaccaatatggtattcttggatattgtggattcacgcataccatctgacaagctgtgccaagtcctgggaacgcacaatgtgcttgcaaatccaaggagtccaaaaagtgtcaggcttgtccttcattaccaaatttcagataccgatgttcaatatgccctgacgtgttttaagaaagctgttgaagagctactgatgggcagttctgaattggagcatttggcagatactactaccaagaactcgtacgggcactaggacaccctgatgcatcagctcggtggccttgcttgtctgtaatcaactcgaagatattgtagccagaccaaacctttgctgaataagtgttgcttttcact

SEQ ID NO: 1354 - DNA, 1612 bp, Zea mays
ctactccctcggctggttcgtttggtagcgagcgggtgtcctggacgggggtgactctgagtggtgctgatgccttgtggctttctgtacttttggcctctcgcgtgtaggactttagttgccacgttggtgttccgttctgttctgttggcagcaagtgcaatgagcatcaatgcatcaaccatcgtgctggtacttccaaaagagcgaaaggattgccaattctgaaggagaaagcaaaccatatctgaaatacaaagcgcggacggaccatttgagcatccaattcgtgagctttggcgtctgtgtatttttaatcgggagctgtaggctgtagctagctagagaggtttagagcagcaccaaatggcgagcaaggtggtggacctccggtcagacacggtcaccaagccctccgaggccatgcgggccgccatggccgccgccgacgtcgacgacgacgtcctgggcgcggacccgaccgcgcatcgcttcgaggcggagatggccgcggtcatgggcaaggaagccgcgctgttcgtgccgtcgggcaccatgggcaacctcatctccgtcctcgtgcactgcgacgtcaggggcagcgaggccatcctcggcgacaactcgcacatccacgtctacgagaacggcggcatctccaccatcggcggcgtgcaccccaggaccgtgaagaacaaccccgacggcaccatggatatcgacaagatcgttgccgccatcaggcatcctgatctccattacccgacgaccagattgatctgcttggagaacacacatgggaatactggtggaaagtgtttatctgtagaatacactgacaaggttggtgaaattgccaagagccatggcttgaagcttcatatcgatggagctcgcatcttcaatgcgtctgtggcacttggagttcctgtagatagactcgtgaaagctgctgattcagtttcggtatgcctatcgaaagggttaggcgcacccgtcggatcagtgattgttggttcgaaggccttcattgacaaggccagaattctccggaagaccctaggcggtggaatgagacaggtgggagttctttgtgctgctgctcatgttgccgttcgtgacactgtgggaaagcttgcggatgaccacaggaaggctaaagctttggcagagggactgaagaaaatcgagcagattacagtggattcagcttcggtcgagaccaatatggtattctttgaggtcatggatccaagaatatcacctgacaaactgtgtcaagtcttggaacaggacaacgtgcttgcactgccagccaattcaaaaagtattaggttcgtcatccattaccagatttcagacgctgatgttgggtacgcattggcatgtgtcgagaaagcaatcaaagagctactggaaggcagtactgagttggggcattcgataaacggagctaccaaaagctcgtatgggcactagatcactcggattctgccaacctgatgcatcgacacatggtacccagctgcttgttagctgctctgcttgtctgtgaccaacgcctagctgttgtagtctcgcctttcccgaataattgttgctgttcagtctc

SEQ ID NO: 1355 - DNA, 1516 bp, Pennisetum glaucum
caatttccgagcttcctcgcgcgtggatcggattaaaatcatcgccagtgcggtggagttgcaagcagtaggagcagcaccaagatggcgagcaaggtggtggacctccggtcggacacggtcaccaagccctccgaggccatgcgggccgccatggccgcggccgtcgtcgacgacgacgtcgtgggcgtcgacccgacagcgcaccggttccaggaggagatggccgcgctcatgggcaaggaggccgcgctgttcgtgccctcgggcaccatggccaacctcatcgccgtcctcgtccactgcgacgtccggggcagcgaggtcatcctcggcgacaactcccacatccacgtctacgagaacgggggcatctccaccatcggcggcgtgcaccccaggaccgtcaggaacaaccccgacggcaccatggatgttgacgagatcgtcgcggccatcaggcacccggatctgcattacccgacgacgaggctcatctgcttggagaacacacatgggaattgtggtgggaaatgtttgtcggtggaatacatcgataaggtcggtgaaattgccaagagtcatggcctcaaacttcatattgatggagctcgaattttcaacgcctctgtggcacttggagtccctgtagacagacttgtgaaagctgccgattcagtttcggtatgcctatctaaagggttaggtgcccccgttggatcagttattgttggatcttttgccttcattgacaaggccagaattcttaggaagaccctaggtggtgggatgaggcaggttggagttctctgtgctgctgctgaaattgctgttcgtgacactttgggaaagcttgaagatgaccacagaaaggctaaagctttggcagagggactgaagaaaattaaacatattacagtcgatccggcatctgtcgagactaatatggtgttctttggcatcaccgatctgcgaatatcacctgacaatctatgccaactcttggaacagcacaatgtgcttgcaatgccagcgagttcaaaaagtatcaggtttgtcctccattaccaaatttcagacagcgatgttcaatatgcactgacatgtgtcgagaaagctattgaagagctgctgaagggtggtacaaacttggagcaactggcaaatggtgctacgaaaagttcgtatgggcactagctagatcacttcatttggaccggcctaataatgtataaagctcagcaggagccctgcgtggttgtttacaaaggggagggtggttgtgcggaggtttacgatatagattctgtcacaagttatggatagctgtcgctgtttgtgatcaggggctagctgatcgtaaccacagcatcgctgaacaaactgatgtggtgcccctgcttgtttgtgatcaacaacgctgtacgcaaccacaccttgcgttggctgatgagtatctgatggtgcccatgcttgtttgtgatcaacggtagcacagctaattgtgtaaccacac

SEQ ID NO: 1356 - DNA, 1448 bp, Zea mays
aacagcgcgaaacatctgtcagttttccttcaaaaatggaaaagcgaaggcaaaaccaaagtttgttgtgggagtgggacgtgacaccccgcacacatcagttcatttcagtttcagcaggtcagttttcgtcctgatactctgtcgctgcagcggtgccggtgcagcgctagctgcagttgggttgcggccgcagagcagcagcaggaaggatggcgaccaaggtggtggtggacctgcggtccgacacggtcaccaagccttccgaggccatgcgcgcgtccatggccgcggccgacgtcgacgacgacgtccggggcgcggacccgaccgcgcgccgcttccaggaggagatggcggcgctcatgggcaaggaggccgcgctcttcgtcccgtcggggaccatgggcaacctcgtgtccgtcctcgcgcactgcgacgtccgcggcagcgaggtcatcctcggcgacgactcgcacatccacctctacgagaacggcggcatctccaccctcggcggcgtgcaccctaagaccgtcagaaacaactccgacggcaccatggacatcgacagcatcgtcgctgcaatcaggcctcccggcggtggcctgtattacccgaccaccaggctcatctgcttggagaacacacatgggaattccggagggaagtgtttatccgcagaatacactgaaaaggttggcgaaattgccaagagtcatggcctgaagcttcatatcgatggagctcgcattttcaacgcctctgtggcacttggagttcctgtggacagacttgtgagagctgcagattcagtttcggtatgcatttctaaaggtttaggcgcccccgttggatcagttattgttggctcgaaggccttcatcgacaaggccaaaattctccggaagaccctaggtggtggaatgaggcaggttggagttctctgtgctgctgctcatgttgccgttcgtgacaatgtgggaaagcttgcagatgaccacagaaaggctaaagctttggcagacggactgaataaaatcgaacagttcagagtggattcagcatcagtccagaccaatatggtattcttggacatcgtggattcacgcatatcatctaacaagctgtgccaggttctgggaacgcacaatgtgctcgcaagtccaaggagtccaaaaagtgtcaggcttgtccttcattaccaaatttcagatgatgatgttcaatatgcactgacgtgttttaagaaagctgctgaacagctactaatgggcagtactgaactcgagcatttggctgaacagctactgatgggcactaccaagaactcgtacgggcaatagggcaccctgatgcataagctcggtgtggtcttatctgtaatcagctcgaaatattgtagccgcaccaaacctttgctgaataactgttgcttctcacttgtt

SEQ ID NO: 1357 - DNA, 1242 bp, Triticum aestivum
tcccgttccgcctcgctccccaccctttcatggccggcgcgaccctcgccgccgcgagattccccgcggccgttgcgctcctccgcactcgccgctcccccgtggtcgccgtgccgctcgccccgtccggtctccgccaccaccgccgcagcgtcgccatggccgccggcgccgcgccctcacccattcccgcctccgatccgcttcccaagggttctgatctatttttccggtcagttctctcaaacatgcaaaaagtttatttgagcaggaatccaactgccgaaaagattctggaccttgtccattcttacgatggggaccacatttgttttgatcactttgctttcagaacatttggggttgatggttatggtataaactcacttgctgaattttttactgattttggttacgagtctcgtgaagaactaaggttcccagcgaaaaaactaagagcactatggttttcccctcccaacaatgatggatacaccagagctggtatatatggacctttgccaaggatattcatttctgaacttcttgtagatgagctgagtgctccgagccaggaaattatacggaaatacatcaaaacatcagctaatggaaataaatatgctgttcttgcaagtacatttggagaactgacatgggagaagcccacttattctgatttccaggttttatctagggaaagtgaatatgctggatggactcttgttaatggctatgcactgaaccatgccacagtctccactcatcgcttagagtcagatattagaagtattagtaaattcaacaaatttgtggaggacaacgggttcaagttaaatacagaaggaggaattttgaaagtgagtcctgacggtctcctccagcaaagctcaactgtagctgattcatcattatttacttttgcggatggaatcactgaatctattccacgttcctatattgaatttgctgaacggctgccacttccacagttcagagatttgcaagatgaagaggtcaaggaacaccacaggcgcgatggttttgaggtgggcaacgcagacaagatatttgagagcacttcaaaggatcagcttaccagaagatctgcataagcggcgtactcttgatcgaacattctgcaggcgggccaacgagcctcttggaagtgtgttgaatgcgtgtgttgtgtaatcattgtatggcttgaagtgggttggaaacagatgcttaataaagata

SEQ ID NO: 1358 - DNA, 1487 bp, Triticum aestivum
ttccgttccgtctcgctccccaccctttcatggccggcgcgaccctcgccgccgcgagattccccgcggccgttgcgctcctgcgcactcgccgctcccccgtggtcgccgtgccgctcgccccgtccggtctccgccaccaccgccgcagcgtcgccatggccgccggcgccgcgccctcacccattcccgcctccgatccgcttcccaagggttctgatctatttttccggtcagttctctcaaacatgcaaaaagtttatttgagcaggaatccaactgccgaaaagattctggaccttgtccattcttacgatggggaccacatttgttttgatcactttgctttcagaacatttggggttgatggttatggtatagactcacttgctgaattttttactgattttggttacgagtctcgtgaagaactaaggttcccagcgaaaaaactaagagcactatggttttcccctcccaacaatgatggatacaccagagctggtatatatggacctttgccaaggatattcatttctgaacttcttgtagatgagctgagtgctccgagccaggaaattatacggaaatacatcaaaacatcagctaatggaaataaatatgctgttcttgcaagtacatttggagagctgacatgggagaagcccacttattctgatttccaggttttatctagggaaagtgaatatgctggatggactcttgttaatggctatgcactgaaccatgccacagtctccactcatcgcttagagtcagatatcagaagtattagtaaattcaacaaatttgtggaggacaacgggttcaagttaaatacagaaggaggaattttgaaagtgagtcctgacggtctcctccagcaaagctcaactgtagctgattcatcattatttacttttgcggatggaatcactgaatctattccacgttcctatattgaatttgctgaacggctgccacttccacagttcagagatttgcaagatgaagaggtcaaggaacaccacaggcgcgatggttttgaggtgggcaacgcagacaagatatttgagagcacttcaaaggatcagcttaccagaagatctgcataagcggcgtactcttgatcgaacattctgcaggcgggccaacgagcctcttggaaagtgtgttgaatgcgtgtgttgtgtaatcattgtatgccttgaagtgggttgaaaacagatgctcaataaagatatatttcctaacgatattactctctcatatatcgaattcagccatctctatgtatcattaaacctaaactgatactatctgggaatgcatgaaatagtctaatggagtgaaacatggcatgatggtcagttccttttctaagttgtgtcatcctagttcttacttatttactctttgtgaagacatttttgagaaagttgcgtccctgcaacttttgtcgcaggccaaggcaagtgcatgcatga

SEQ ID NO: 1359 - DNA, 1380 bp, Secale cereale
cacttccgttccgtcccgttccgcctcgctccccgccctttcatggccggcgccaccctcgccgccgcgagattccccgcggccgttgcgcgcctcagcactcgtcgctccccggtggtcgccgtgccgctcgccccgtccggtctccgccaccaccgccgcagcgtcgccatggccgccggcgctgcgccctcacccattcctgcctccgatccgcttcccaagggttctgatctatttttccggtctgttctctcaaacatgcaaaaagtttatttgagcaggaatccaaccgccgaaaagattctggaccttgtccattcttacgatggggaccacatttgttttgatcactttgctttcagaacatttggggttgatggttatggtatagactcacttgctgaattttttactgattttggttacgagtctcgtgaagaactaaggttcccagcaaaaaaactaagagcactatggtttcccctcccaacaatgatggatacaccagaactggtatacatggacccttgccaaggatattcatttctgaacttcttgtagacgagctgagtgctccgagccaggaaattatacgggaatacatcaaaacatcagctaatggaaataaatatgctgttcttgcaagtacatttggagagctgacatgggagaagcccacttattctgatttccaggttttatctagggaaagtgaatatgctggatggactcttgttaatggctatgcactgaaccatgccactgtctccactcatcgcttagagtcagatatcagaagtattagtaagttcaacaaatttgtggaggacaacgggttcaagttaaatacagaaggaggaattttgaaagtgagtcctgacggtctcctccagcaaagctcaactgtagctgattcatcattatttacttttgctgatggaatcactgaatctattccacgttcctatattgaatttgctgaacggctaccacttccacagttcagagatttgcaagatgaagaggtcaaggaacaccacaggcgcgatggttttgaggtaggcaacgcagacaagatatttgagagcacttcaaaggatcagcttacccgaagatctgcataagcagtgtactcttgatcaaacattctgcaggcaggccaacgagcctcttggaagtgtgttgaatgcgtgtgttgtgtaatcattgtatatgccgtatgccttgaagtgcgttgaaaacagatgctcaataaagatacgtatttcctaacggcgttacgctctcgtatctggaattcagctatctctatgtatcattaagcctaaactgatactactatctgggaatgcatgaaatagtctaatggagtgagtc

SEQ ID NO: 1360 - DNA, 1313 bp, Avena sativa
tccgttccacttctgtctcctacccttcatggcccaggcgaccctcgccgccgcgagattccccgcgtccgttgcgcttctccgcacccgccgctcccccgcggtcgccgctcccctctgcacatacgggctccaacgcggcgtcgccatggccgccgcgcactcacccgcgcccgtgccaggctccgatccgcctcccaagggtgctgatctatttttccggtcagttctctcaaacatgcaaaaggtttacttgagcaggaatccaacagcagaaaagattctgggccttgtccgttcttatgatggggacaacatttgctttgatcactttgctttcagaacatttgctcttgatggttatggtataaactcgcttgctgaatttttcactgattttggttacgagtctcgtgaagaactaaggtttcctgcaaaaaaactaagagcactgtggttttcccctcccaagagtgatggatacagcggcactggtgcatatggacctttgccaaggatattcatttctgaacttcttgtagatgagctgagtgctccaagtcaggaaattgtacgcaaatacattaaaagttcagctaaaggaaataaatatgctgttcttgctactacatctggggagctgacatgggagaagcccatttattctgatttccaggctttatctagggaaagtgaatatgctgcatggactcttgctaatggctatgctctgaaccatgccacagtttccacccatcgcttagaatcggatatcagaagtattagtaagttcaacaaatttgtggaggacaatgggttcaagttaaatacagaaggagggattttgaaagtgagtcctgatggtctcctccagcaaagctcgactgtagctgattcagatttatttacttttgctgatggaatcactgaatctattccacgttcctatatcgaatttgcggaacgcctgccactcccacagttcaaagatttgcaagatgaagaggtcaaggaacaccacagacgtgatggttttgaggtaggcaatgcagacaagatatttgagagtacatcaagagatcagcttacccgaaggtctgcatagacggtgactctatatcgaccattctgcaggcgatgtgcctcttggaagcgtgttgagagtgtgtgttgtgtaattactgtatatactacatagcctgaagtgtgttgaaaatcacaggctcaataaagataaatatttcctaatgcctcaagtctggaattcagctttctctatcgtattattttcgtttggcttgtcatggatctcc

SEQ ID NO: 1361 - DNA, 1266 bp, Pseudoroegneria spicata
  misc_feature (1184)..(1184): n is a, c, g, or t
tcccgttccgcctcgctccccaccctttcatggccggcgccaccctcgccgccgcgagattccccgcggccgttgcgctcctccgcactcggcgctccccggttgtcgccgtgccgctcgccccgtccggtctccgccaccaccgcctcagcgtcgccatggccgccgccgccgcgccctcacccattcccgcctccgatccgcttcccaagggttctgatctatttttccggtcagttctctcaaacatgcaaaaggtctatttgagcaggaattcaactgcagaaaagattctggaccttgtccattcttatgatggggacaacatttgttttgatcactttgctttcagaacatttggggttgatggttatggtataaactcactagctgaattttttactgattttggttacgaatctcgtgaagaactaaggtttccagcaaaaaaactaagagcactatggttttcccctcccaacaatgatggatactccagaactggaatatatggacctttgccaaggatattcatttctgaacttcttgtagatgagctgagtgctccgagccaggaaattatacggaaatacatcaaaacatcagctaatggaaataaatatgctgttctagcaagtacatttggggagctgacatgggaaaagcccacttattctgatttccaggttctatctagggaaagtgaatatgctggatggactcttgttaatggctatgcactgaaccatgctacagtttccactcatcgcttagagtcagatatcagaagtattagtaagttcaacaaatttgtggaggacaacgggttcaggttaaatacagaaggaggaattttgaaagtgagtcctgacggtctcctccagcaaagctcaactgtagctgattcatcattatttacttttgctgatggaatcactgaatctattccacgttcctatattgaatttgctgaacggctgccactcccacagttcagagatttgcaagatgaagaggtcaaggaacaccacaggcgcgatggttttgaggtaggcaacgcagacaagatatttgagagcacttcaaaggatcagcttacccgaaggtctgcataggagggtgtacccttgatcgaacattctgcaggcgggccaatgagcctcttggaagtgtgtttgaaagcngtgtgttgtgtaattattgtacacaccatatgacttggagtgtgttgaaaaccagacgctcaataaagatgaatatttccta

SEQ ID NO: 1362 - DNA, 1793 bp, Brachypodium distachyon
tggatatgctcgaagaaaacaaaacccacccgcaacgccaggacacgtcagcccttttttccttccggttccgtcggcgacgtgtcaaagttgcccacttctctcccgccgcaacgtgcagcttacttgtcgtactacagtcccacacccccagttccccacctcccggggcttccacttccgttccgcctctcccttcctcttcttccaccatcttccatggccggcgcgaccctcggcgcagcgaaattccccgccaccgttgcgctgctccgcacccgccgctcccccgcgatcgccgccacggccctcggcccgtctggtctccgccactaccgccgcggcgtcgcgatggccgccgccggcacctcctcctccaccccgtcccgcgtccccgccgtagatgcaattcccaagggtgctgatttatttttcaggtcaattctctcaaacatgcaaaaagtttacttgagcagaaacccaacagcagaaaaaattctggaccttgtccgttcttatgatggggaccacatttgttttgatcactttgctttcagaacatttggggttgatggttatggtataaactcacttgctgaatttttcactgattttggttatgtatctcgcgaagaactaaggtttccagcaaaaaaacttagagcactatggttttcccctcctgccaatgatggatataccagaactggtatatatgggcctttgccaaggatattcatttcggaacttcttgtggacgagctgagtgctcagagccaggaaattatatgcaaatacgttaaaacttctggtagaggaaataaatattctgttcttgcaagtacatatggggagctgacatgggaaaagcccatctattctgatttccaggttttatctagggaaagtgaatatgctgcatggactcttgttaatggctatgcactaaaccatgcaacagtttccactcatcgcttagagtcggatatcagaagtattaataatttcaataaatttgttgaggaaaatgggttcaagttaaacacagaaggagggattttgaaagtgagccctgatggcctccttcagcaaagctcaactgtagctgattcagcattatttacctttgccaatggaatcactgaagctattccccgttcctatattgaatttgctgagcgcctgccactcccacagttcaaggatttgcaagaacaggaggtcaaggaacaccacaggcgcgatggttttgaagtaggcaatgcagacaagatatttgagagcacgtcaaaggatcagcttacccgaaggtttgcatagactgtgtgaattctcgatcggacatgctgcaaaccagccagtgggcctcttggaaatgtgttgaaagcgtgaatttgtgtaattattgtataagctagctagaagcgtgtttaaaatcagactcaataaagacaaacatttcctagtggcattgtgctcccataactggaatctagatgtctcttatcgttttattttcctgttgggtcgtcatggttctttggttcaccaattctaatctaatttattgtctacaaaagtctaaactgatttctggaaatgtataacatagttttatgttctagaatgaaaatgacatgaaggacaaaaatccttttctcagaaaagttgtggtcattctagttcttattcatttactttctgtgatgactgatgagcacatctttgagaaaattatgtccctggaacttctaataccaggtggttggaatgaaccctcttttccaaagaag

SEQ ID NO: 1363 - DNA, 1259 bp, Brachypodium distachyon
ttcttccaccatcttccatggccggcgcgaccctcggcgcagcgaaattccccgccaccgttgcgctgctccgcacccgccgctcccccgcgatcgccgccacggccctcggcccgtctggtctccgccactaccgccgcggcgtcgcgatggccgccgccggcacctcctcctccaccccgtcccgcgtccccgccgtagatgcaattcccaagggtgctgatttatttttcaggtcaattctctcaaacatgcaaaaagtttacttgagcagaaacccaacagcagaaaaaattctggaccttgtccgttcttatgatggggaccacatttgttttgatcactttgctttcagaacatttggggttgatggttatggtataaactcacttgctgaatttttcactgattttggttatgtatctcgcgaagaactaaggtttccagcaaaaaaacttagagcactatggttttcccctcctgccaatgatggatataccagaactggtatatatgggcctttgccaaggatattcatttcggaacttcttgtggacgagctgagtgctcagagccaggaaattatatgcaaatacgttaaaacttctggtagaggaaataaatattctgttcttgcaagtacatatggggagctgacatgggaaaagcccatctattctgatttccaggttttatctagggaaagtgaatatgctgcatggactcttgttaatggctatgcactaaaccatgcaacagtttccactcatcgcttagagtcggatatcagaagtattaataatttcaataaatttgttgaggaaaatgggttcaagttaaacacagaaggagggattttgaaagtgagccctgatggcctccttcagcaaagctcaactgtagctgattcagcattatttacctttgccaatggaatcactgaagctattccccgttcctatattgaatttgctgagcgcctgccactcccacagttcaaggatttgcaagaacaggaggtcaaggaacaccacaggcgcgatggttttgaagtaggcaatgcagacaagatatttgagagcacgtcaaaggatcagcttacccgaaggtttgcatagactgtgtgaattctcgatcggacatgctgcaaaccagccagtgggcctcttggaaatgtgttgaaagcgtgaatttgtgtaattattgtataagctagctagaagcgtgtttaaaatcagactcaataaagacaaacattt

SEQ ID NO: 1364 - DNA, 1210 bp, Festuca arundinacea
  misc_feature (28)..(28): n is a, c, g, or t
  misc_feature (30)..(30): n is a, c, g, or t
  misc_feature (76)..(76): n is a, c, g, or t
  misc_feature (82)..(82): n is a, c, g, or t
  misc_feature (91)..(91): n is a, c, g, or t
  misc_feature (126)..(126): n is a, c, g, or t
  misc_feature (143)..(143): n is a, c, g, or t
  misc_feature (152)..(152): n is a, c, g, or t
  misc_feature (159)..(160): n is a, c, g, or t
  misc_feature (176)..(177): n is a, c, g, or t
  misc_feature (183)..(183): n is a, c, g, or t
  misc_feature (185)..(185): n is a, c, g, or t
  misc_feature (189)..(189): n is a, c, g, or t
  misc_feature (193)..(193): n is a, c, g, or t
  misc_feature (217)..(217): n is a, c, g, or t
  misc_feature (259)..(259): n is a, c, g, or t
  misc_feature (277)..(277): n is a, c, g, or t
  misc_feature (314)..(314): n is a, c, g, or t
  misc_feature (328)..(328): n is a, c, g, or t
  misc_feature (729)..(729): n is a, c, g, or t
  misc_feature (1146)..(1146): n is a, c, g, or t
ggcacgaggccgctctatctcccgaccntncatggcccaggcgaccctcgccgccgcgagattccccgcggccgtngcgctnctccgcacncgccgctcaccggcgatcgccgcgcccctctgccngtccggactccgccacngccgccgcngcttcgnnatggccgccgcgcccnngcccgngnccgngccngcctccgatccgcctcccaagggngctgatttatttttccggtcagttctctcaaagatgcaaaangtttacttgagcaggaanccaacagcagaaaagattctgggccttgtccattctnatgatggggacaanatttgctttgatcactttgctttcagaacatttggggttgatggttatggtataaactcacttgctgattttttcactgattttggttacgagcctcgggaagaactaaggtttcctgcaaaaaaactgagagcactatggttttctcctcccaagagtgatggatacactggaactggcatatatggacctttgccaaggatattcatttccgaacttcttgtagatgagctgagtgctccaagccaggaaattatatgcaaatacattaaaacttcagctaaaggaaataaatatgctgtccttgctagtacatctggggagctgacatgggagaagcccatttattctgatttccaggctttatctagggaaagtgaatatgctgcatgggctcttgntaatggctatgctctgaaccatgccacagtttctacccatcgcttagaatcggatatcagaagtattagtaagttcaacaaatttgcggaggacaatgggttcaagttaaatacagaaggagggatcttgaaagtgagtcctgatggtctccttcagcaaagctcaactgtagctgattcagcattattttcttttgctgatggaatcactgaatctattccacgctcctatattgaatttgctgaacgcctgccactcccacagttcaaagatttgcaagataaagaggtcaaggaacaccacagacgcgatggttttgaggtaggcaatgcagacaagatatttgagagcacgtcaagggatcagcttacccgaaggtctgcttagacggtgactctcgatcgaccattctgcangcgatgtgcctcttggaagtgtgtattgaaagtctgttgtgtaattactgtatgtactatattg

SEQ ID NO: 1365 - DNA, 2998 bp, Brachypodium distachyon
tctactgcccgagcttagcgcagctttagctggaggcgcatctcccccatccatccccgcccgcactcccacgccgccgcagcagatctccggtccctatactccggcgcgccgccatggactacgagcgcatcgagaagccgtcgttccccacccagggaggagggttctcgccgaagcggctgcgggcgatgttgctgggggtggagaagcggcgcaaggggccgccgccgccgccggaagcgggcgccggggctggggacgacgacggcggcgacagggacgaggacgtggaggaggaggagtacggcgccgtgcccatggcctccgtcagatccgacgcccgcaagagtgaaaactgtggcatgtgttctcatgtaggagggggaggaggcggcgtgtgcgaggaatacaaggacgtggatgtggtgagcaccatgtcaggatcttcgtcatcgctggagacagggggcggacaccggccacgggattgccactccatgggctcaaggttcagggttcccgaagaggactcgtgtgactccgagagcgtggcctccaacttcgagttccacaaggagcgagggacctccgctcggtcggcgcccgtggttccaccgttctcaaaggccctgccgtcaaagtgggacgatgcacagaaatggatcgccagcccgacgacgaaccgtcctggtaggaccagtggagccttgccaaggaagatggagaaagctggatttggtggcgggagactgccggcgacgaaggtcgtgctggataccatggaagaaatagatactaagaggatcgacccgagccaggataagagggaaattgggtggcagaaagcggcaaactgggccacgccggatccatatccagaagtggaggcttgcacaaagactgcaattgctgattcagctgttactcttagctgtgattcgtctaccacgcttcagagtgccactgcttgcatacctcccccaccaacagtccggtcagtatcgatgagggatatgggtactgaaatgactccgattgcaagccaagaaccatcccggacaggaacaccggtgagagcaacaagtccggattgctctcagccaactactccacgaaggacattagggacaaacgcagctggtgctgttatcagccgtggtgaatgcagcaatgtagaattaagcgaacaggagctgcaaatgaagaccaggagagagataatgcttcttggcacccagctaggtaaaaccagcatcgcagcatgggcaagtaagaaggaagaggaaaaggatgcatcactttcgctcaagacagtgtcgttggaccaatcgatacagaacacaactgaaatccgcgcagccgcatgggaggaggcagagaaggctaagtacttagcaaggtttaaacgagaagagatcaagatccatgcatgggaagatcaccaaaaagccaaaattgaagccgaaatgagaaaaatcgaggttgaggtggagaggatgcgagctcgtgcgcaggacaagctgatgagcaagctcgcatcggcgaggcacgccgcggacgagcagcgagccaccgcggaaacaaagagagaccatgccgccgcgaggaccgcggagcaggcagagcacatcaggcgaaccggcaggatgccgccctcccttggctgctggaactggtgctcgtaaccgccggataaaccagcatgtgttagggactgaaatgaatctggcattgtagaatattctctcttttgattgggttcagtagatatatgtggcacgagaacagatcacctgtaagttgtaactgtatatgtaagatgcgagcttgtcgccgtgtgtttcttggatgcttcagtcgcaattcagatctctgttcagattcatacgcagatctgggatggtaactaagtagaataaaatagacatatactctaccaacatttgagtgtttactcctggagattgtaaacatcaagcagagagatcaaacagattatggaaccaaagatccttccagatgatcaaagaatatcacatgaagatgcaagccattttctgcaacaaggttttccatacatttgattgatcataacaaggtttggaggagataatgtgaagatcaaatagcagtacataatcaccaacaatagcactatcagttaagccagcaaccagctgctattagcaggcaacatcttgaccatgatactggaaacatatggagttgggtagagggatggattggatcggcaatgctactcgaacttcttgatgagggagaggtcgttgagcatcttgtcgatgcgttcgtcgacgtcgaacctgccgccggggacgagggaggggacgagcgccttggcctcgtcggcggtgtcggggcagaggttgccgagggtgcagagctcgaactcgtggaggccgtagcggctgagcgtctcgcggacctggcgcacggcgtcggggttcttgtagcggctgaagcgcttcacgtagcccagcgacttctcgaacacctgcgacatctgcgacgacgggtcccccccgccgtccgacatctgctgcagctgctcgtacctgtgctccaggatgatcgccacctcgcagttcatcaggctcttcgccttcaggaactctgcagcaacagcagcagatgagtttctagggtttagctggatcccctcgggatgttctgtggcgaaaccctagggatgattgattggcgcgcgcgtgagggggagtagatggtgataccttcgccgatcttgagctccgcggcgttctcctcctcctcgccggacatggctgcggctgctgcggagggccggcggagtcgatttgattcggcgtttgacggagaggaagtcggttggagcttggggaagagaagaggaaggcggaggctaaataatgggccaggcctggacgctcccagaaaagcaatttgtatgtgggctggggccgaaatggccgtctagctaaaccattatttttcg

SEQ ID NO: 1366 - DNA, 1437 bp, Secale cereale
gactcccatcactcccccatcccctcgcactcccacgcccgccgccgccgccgccgccgcagatctccgccctccggcgcgccgccatggactacgagcgcatcgagaagccgtcgttccccacgcagggcgggggcttctcgccgaagcggctgcgcgcgatgctgctgggcgtggagaggcggcgcaaggacgccgccggcgccggggacgacgacggggaggagcaggaggaggaggagtacggcgcggtgcccatggcctccgtcagatccgacgacgactcgcgcagagggggtggcatgtgcgaagaattcaaggacgtggatgtggtgagcaccatgtcgggatcttcgtcctcgctggacaccgggggcggcaccggtcgcgggactcccactccatgggctcgaggttcagggtgcccgaggaggactcgtgcgattccgagagcgtggcgtccaacttcgagttccacaaggagcgagggcctccgcccggtccgcgccaactgcggtggtcgcgccgttctccaagcccccgccgtcaaagtgggatgatgcccagaaatggatcgccagcccgacgacgaaccgtcccggtagggctggtggagctttcccgaggaagatggagaaaactggctttggtggagggaggctgccggctacaaaggttgtgctggaggccatggaggaaatagacaccaagaggatcgatccgagccaagagaagagggagattgggtggcagaaagcggcgaactgggccacgccggagccctatccagaagtggagccttgcgcaaagtctgcacctgctgcagaaagtactataattgattcagctgttactttgagctgtgattcatctacaacgcttcagagtgccactgcatgcatacctcccccaccaacagtccggtcagtatcgatgagggatatgggtactgaaatgaccccaattgcaagccaggaaccatcccggacaggaacacctgtcagagcaacaagcccggattgctctcggccaactactccacgaaggacattgggtatcaatgcagctggccctgttatcaaccgcggtgaatgtagcattgcagatttgagcgaagaagagttgcaaatgaagactaggagagagataatgcttcttggcacccagctaggtaaaaccagcatcgcggcatgggcaagtaagaaggaagaggagaaagacgcatcactttctctcaagacagtgtcgtcagaccaatctgtacaaaatgcaactgaagtccgtgcagctgcatgggaggaggcagagaaggccaaatacttagcaaggtttaaacgagaagagatcaagatccatgcatgggaagatcaccagaaagccaaaatcgaagcagaaatgagaaaaattgaggtcgaggtggagaggatgcgagcccgt

SEQ ID NO: 1367 - DNA, 2005 bp, Oryza sativa
tagcttttaactgctcgtctcatcactctccacctctctccctctctctctcttcctcgcgctcccacgccacgcagcagccgcagatctccacccgcctccggcgagcccgccgccgccgccgccgccatggagtacgagcgcatcgagaagccgttccccacccagggcggtgggttctcgccgaagcggctgcgcgcgatgttgctgggggtggagaagcggcggaaggggcaggaggaggaggaggagggggacgccggggaggtggacgacgagtacggcgcggtgcccaagtcctctgtcagatccgacgccgactccgatgcgcgcagaggaggtagcatgtgcgaagaatacaaggatgtagatgtggtgagcaccatctcagaatcttcatcctcgttggagacagggagtgggcaccgatcgcgtgacacccactccatgggttcacgagtaagggtgcctgaggaggactcctgtgactctgagagtgtggcttcaaactttgagttccataaggagcgaggggcctctgctcggtctgtgacggcggcaatcgttcctccattctcaaagcctgcaccatcaaagtgggacgatgcccagaaatggatcgccagcccgacaacaaaccgtcctggtagggctggtggagtgccacagaggaagatggaaaaaactagctttggtggcgggaggctgccggctacgaaggttgtgttggaggccacagaggagatagatactaagagggttgatccaagccaagagaaaagggaaattgggtggcaaaaagcggtgaattgggccccacctgatccatatccagaagttgagacttgtgcaaagtctgcacttgctgaagaaattacagtagctgattcagctgttacttttagtcgccatgattcatctgccacgcttcagagcgcgacaacatgcatacctcccccaccaacagtccgatcagtgtcaatgagagacatgggtacagaaatgacccctattgcgagccaggagccatcccgaacaggaacaccggtgagagcaacgagtccagattgttctcgcccaactactccacgaaaaacaataggccccaatgcaatcggtgctgttattggccatggtgaatgtagcaacgtggaattaagtgaacaagaattgcaaatgaagactaggagggagataatgctcctcggcactcagcttggtaaaaccaacattgctgcatgggcaagcaacaaggaagaggaaaaagatgcatcactttcgcttaaaggagtgcccatggaccaatctacacagaaggtaacagaaattcgtgcagcagcgtgggaggaggcagagaaggctaaatatttagcaagatttaaacgagaagagattaagatccaagcatgggaagatcatcagagagcaaaaatcgaagctgaaatgagaaaaattgaggtcgacgtggaaaggatgcgagcccgtgcgcaggacaagctgatgagccagctcgcatcggcgagacacactgccgacgagaagcgggccgcggcggagctgaaacggagccgtgcggctgcaaagacggcggagcaggcagaccacatcaggagaaccggcaggatgccgtcctccattggctgctggaactggtgctcgtagtagcgtagctaagctcaagcaactgaagcaagcaaaaagctctcctcactatgtctcgcaagacttgaagcgccatcatctgtttttaccgtgatcttgtagaatattgtcttttgattggtttcagtagatataagtcagaagaagacgagtcacttgtaagtaactatggagcagtatataagatgcaagcttcttgcctttttctgtgctgtgtgcttgttatcttgtacttggatgtcaatctgtcacagtgagctacaagcagctccaccatgctgaggaggtgttgaggctcaattcggattcccggatcaccagtgcagtacagagtatatgtgtg

SEQ ID NO: 1368 - DNA, 673 bp, Triticum aestivum
ttagcggccgcgaattcgcccttcgactggagcacgaggacactgacatggactgaaggagtagaaaagcatccgcaacggccatggccttcgccgccatccacgcccgcctcgccgtcttcccccctcgcctcagcgccgccgcgtcgtctctccgctccgcacctccccgcgcccgtctcccgcagctcaggacttcagccggataccgctgcctccgtagcccgcggtgccgccggccgtgtcgcgctcgcgccagctgcatctccatcaccgcgtcgctcgacctcgccgaggacaacgtccggcaggccatcgtcgacgctaaagccgagctggcccagctgttcgacacgtcggtcggcataacaggacaagttgatctggcggagctggacgggccgttcgtgaagctccgactgaagggaaagttctggcacacccgcgccaccgtcgccgcgcggataggcaactacctcaagaaccgtataccggagattttggaagtggagatcgaagatgaggaccagctcgacgacagccccgcggcttactgagattactgaagacctgaactgaagttgttgaaggacctaatacatataccagaacagattattctagcactttcttcgctagcatgggtaaagaacatgcgagtcattgctgaggg

SEQ ID NO: 1369 - DNA, 2132 bp, Triticum aestivum
cgctcctaatccccacccacccggatcgcccgctcgcgcgttaagtggccaagctcctctgcgcgcgggcggcttcgccgagggagccatcggccctccgcggatctgattgggccgcgcgcgatctgggcatcgaggggatgcggggggaggaggggcggaggtggaggcgatgagcggcgccgcctcgctggggctgcgcacggggagctgcggcaccctgcccgcgccgggcgccggcgccgccgtccccgtcgggaggaaggccaggggctggggcctgcgcgccggcgccgacgccggcggcggggacaaggagcgcctgcagctgccgcaccgcgcgctgcgcctcgtcggccgccgcggggccggactgctcctgctgctcgccgtcgcctccgccgcgctcttctgctccctcttcgccgtcgtcaaagatgacaacacttcttcaattatcattgctagcaactacgaagtcaccaatgccatccagaattctgtataccccagcacaacaaggcctctgatgatgtccaatgaccacaacaaattcgagcatccaaatcggcttcatctttcacctggaaacttcacaaatcatccttgtgaaggtttcgcagttcctcctatcctgtttgataagaaacgcactgggcctcgaccatgccctgtttgctatgtctcggtagatcaggcatttgctctgatgcctctacaagcttcgccatctcctgtccttgaaaacttagattatgccttggaagacagcgtcacagcaaatttctcaaatccgggctctgcatttggagggcatctatctctggagcagagaaataaatcttttgacattaccaattcgatgactgtccactgtggatttgttagaggaaagaaacctggccaaggtaccggatttgacatcagtgatgatgatctgctagaaatggagcaatgccgtgagcttgttgtagcttctgccattttcgggaactatgatatgattcaacatccaaggaatgtcagtgaactgtcaaaggcaaatgcgtgtttttatatgtttgtagacgaagaaacaatggcttatgtcaagaattccagctcactgtacaaagataataaagttggcttatggaggctagtggttgtccggaacctcccttatgaagatccaaggcgcacggggaagattcccaagcttctgctccataggctatttccaaatgtaagattttcagtttggatagacgcaaagcttcagcttgttgtggatccttatttactgcttgagaggtttctgtggagaaagaattctagttttgcgatatctcggcactacagacgttttgatgtgtatgaagaagcagaagctaataaagctgctggaaagtatgacaatgcatcaatcgatgaacaaatagatttttacagaaatgagggcctaacacattattctcccgccaagcttcctatcacaagtgacgtcccggaaggctgtgtgatcatcagagaacacgtccccatctcgaacctcttcacatgtctttggttcaatgaagttgaccgtttcaccgccagggatcaaatcagcttcagcaccgtccgggacaaaataagggctaaagtcggctggatgccccagatgttcctggactgcgaaaggcgcaactttgttgtccaggcataccacagggagctgctagagcagatgatcgcgtccggcaggaacacgcctcccatcgcggtcgaaccatcgcggaaaatcagaccaggtagcagcaggagagctcccccgtcgaagaagcctgtcgtgaggcggaaaaaggagaagaaatcgagctcgcggaggcgggtcgcgaagccggttacctgggcgatggatgctgtgtgacggaggttcaccgggatggacggacggactcctgtcactcgatagttgggtgtgaccgtatgtatggcagctggtgccactaggtggggagagggagagagagaaggaatggaggattgtaattttttgccggccacgaaatggaatttgttgatagccaattcttcattgttgttgtaaataacagcggaaagcagtatcattcaattgagcccggcctgttttgggtcgagttattaca

SEQ ID NO: 1370 - DNA, 1719 bp, Secale cereale
ttatcattgctagcaactacgaagtcacgaatgccatccagaattctgtataccccagcacaacaaggcctcttatgatgtccaatgacgagaacaaattcgagcatccaaatcagcttcatctttcacctgataactttacaactcatccttgtgaaggtttcgcagttcagcctatcctgtttgataagaaacgaactgggcctcgaccatgccctgtttgctatgtctcggtggatcaggcatttgctctgatgcctctacaagcttcgccatctcctgtccttgaaaacttagattatgccttggaagacagcatcacagcaaatttctcaaatccgggctctgcatttggagggcatctatctctggagcagagaaataaatcttttgacattaccaattcgatgactgtccactgtggatttgttagaggaaagaaacctggccgaggtaccggatttgacatcagtgatgatgatctgctagaatggagcaatgccgtgagcttgttgtagcttccgccatttttcgggactatgatatgattcaacatccaaggaatgtcagtgaactgtcaaaggcaaatgcgtgtttttatatgtttgtagacgaagaaacaatggcttatgtcaagaattccagctcactgtacaaagataataaagttggcttatggaggctagtggttgtccgaaacctcccttatgaagatccaaggcgcacggggaagattcccaagcttctgctccataggctattccaaatgtaagattttcagtttggatagacgcaaagcttcagcttgttgtggatccttatttactgcttgagaggtttctgtggagaaagaattctagttttgcgatatctcggcactacagacgttttgatgtgtatgaagaagcagaagctaataaggctgctggaaagtatgacaatgcatcaatcgatgaacaaatagatttttacagaaatgagggcctaacacattattctcccgccaagcttcctattacaagtgacgtcccggaaggctgtgtgatcatcagagaacacgtccccatctcgaacctcttcacatgtctttggttcaatgaagttgaccgtttcaccgccagggatcaaatcagcttcagcaccgtccgggacaaaataaaggctaaagtcggctggatgccccagatgttcctggactgcgaaaggcgcaactttgttgttcaggcataccacagggagctactagagcagatgatcgcgtccggcaggaacacacctccgatcgccgtcgagccatcgcggaaaatcaggccgggcagcagcaggagagctcccccgtcgaagaagcctgtcatgaagcggaaaaggagaagaaatcgagctcgcggcggcgggtcccgaagccggttacatgggcgatggatgctgtgtgacgggaggttcaccggggatggacggacggactcccgtcacttgatagctgggtatggccatatggcaagaggtgccactagggggtgggtgggggaagagagagatgaagggaggattgtaatttttgccggacacgaaatgaaatttgttcatagtcgattattcattgttgttgtaaataacagcggaaaagcagtatcattcaattgagcccggcctgttttgtttctggtcagagggcaaaagaaatgtgggcataatgcgatttgttctgtgtagtagtgt

SEQ ID NO: 1371 - DNA, 1546 bp, Secale cereale
atgacaatacttcttcaattatcattgctagcaactacgaagtcacgaatgccatccagaattctgtataccccagcacaacaaggcctcttatgatgtccaatgaccagaacaaattcgagcatccaaatcggcttcatctttcacctgataactttacaactcatccttgtgaaggtttcgcagttcagcctatcctgtttgataagaaacgaactgggcctcgaccatgccctgtttgctatgtctcggtggatcaggcatttgctctgatgcctctacaagcttcgctatctcctgtgcttgaaaacttagattatgccttggaagacagcgtcactgcaaatttctcaaatccgggctctgcatttggagggcatctatctctggagcagagaaataaatcttttgacattaccaattcgatgactgtccactgtggatttgttagaggaaagaaacctggacgaggtaccggatttgacatcagtgatgatgatctgctagaaatggagcaatgccgtgagcttgttgtagcttccgccattttcgggaactatgatatgattcaacatccaaggaatgtcagtgaactgtcaaaggcaaatgcgtgtttttatatgtttgtagacgaagaaacaatggcttatgtcaagaattccagctcactgtacaaagataataaagttggcttatggaggctagtggttgtccgaaacctcccttatgaagatccaaggcgcacggggaagattcccaagcttctgctccataggctatttccaaatgtaagattttcagtttggatagacgcaaagcttcagcttgttgtggatccttatttactgcttgagaggtttctgtggagaaagaattctagttttgcgatatctcggcactacagacgttttgatgtgtatgaagaggcagaagctaataaggctgctggaaagtatgacaatgcatcaatcgatgagcaaatagatttttacagaaatgagggtctaacacattattctcccgccaagcttcctatcacaagtgacgtcccggaaggctgtgtgatcatcagagaacacgtccccatctcgaacctcttcacatgtctttggttcaatgaagttgaccgtttcaccgccagggatcaaatcagcttcagcaccgtccgggacaaaataaaggctaaagtcggctggatgccccagatgttcctggactgcgaaaggcgcaactttgttgttcaggcataccacagggagctactagagcagatgatcgcgtccggcaggaacgcacctccaatcgccgtcgagccatcgcggaaaatcaggccgggcagcagcaggagagctcccccgtcgaagaagcctgtcatgaagcggaaaaaggagaagaaatcgagctcgcggcggcgggtcccgaagccggttacatgggcgatggatgctgtgtgacgggaggttcaccggggatggacggacggactcccgtcacttgatagctgggtatggccatatggcaagaggtgccactagggggtggggtg

SEQ ID NO: 1372 - DNA, 1399 bp, Triticum aestivum
tcggcacgagggcatttgctctgatgcctctacaagcttcgccatctcctgttcttgaaaacttagattatgccttggaagacagcgtcacagcaaatttctcaaatccgggctctgcatttggagggcttctatctctggagcagagaaataaatcttttgacattaccaattcgatgactgtccactgtggatttgttagaggaaagaaacctggccaaggtaccggatttgacatcagtgatgatgatctgctagaaatggagcaatgccgtgagcttgttgtagcttctgccattttcgggaactatgatatgattcaacatccaaggaatgtcagtgaactgtcaaaggcatatgcgtgtttttatatgtttgtagacgaagaaacaatggcttatgtcaagaattccagctcactgtacaaagataataaagttggcttatggaggctagtggttgtccggaacctcccttatgaagatccaaggcgcacggggaagattcccaagcttctgctccataggctatttccaaatgtaagattttcagtttggatagacgcaaagcttcagcttgttgtggatccttatttactgcttgagaggtttctgtggagaaagaattctagttttgcgatatctcggcactacagacgttttgatgtgtatgaagaagcagaagctaataaagctgctggaaagtatgacaatgcatcaatcgatgaacaaatagatttctacagaaatgagggcctaacacattattctcccgccaagcttcctatcacaagtgacgtcccggaaggctgtgtgatcatcagagaacacgtccccatctcgaacctcttcacatgtctttggttcaatgaagttgagcgcttcaccgccagggatcaaatcagcttcagcaccgtccgggacaaaataagggctaaagtcggctggatgccccagatgttcctggactgcgaaaggcgcaactttgttgtccaggcataccacagggagctgctagagcaaatgatcgcgtccggcaggaacacgcctcccatcgcggtcgaaccatcgcggaaaatcagaccaggtagcagcaggagagctcccccgtcgaagaagcctgtcgtgaggcggaaaaaggagaagaaatcgagctcgcggaggcgggccgtgaagccggttacctgggcgatggatgctgtgtgacggaggttcaccgggatggacggacggactcctgtcactcgatagttgggtgtgaccgtatgtatggcagctggtgccactaggtggggagagggagagagagaaggaatggaggattgtaattttttgccggccacgaaatggaatttgttgatagccaattcttcattgttgttgtaaataacagcggaaag

SEQ ID NO: 1373 - DNA, 2476 bp, Brachypodium distachyon
ctgggaaggaacaaggaagcagacgaggtcgaggaggagaccagagagcaccaccgccagtgggtggcgggggcagtagaaaggaaggaaggaacagtccgtcaatctccaagcgcgttctggtctcgtcgtcttgcccacgccacgcccacgcgcgaggatttcacatgcttcgctagcggacgcggggcacctacctcgggctcgggtgctcccattccggaccggcaaatcccctcgccgcgctcctcctaatccccacccacccacccggatcgctactgctgcgctcccatcgcgcgcctccctcgcccgcgggttaattggcccctcctgcgcggcgggctcggctcaccccccgatccggttcctctgcggcgggggatctcgcgggctcggattggcggcgtgatctggcggcgattgggatgagggtggtggggcggaggaggcgatgagcggcgcggcgtcgctggggctgcgcaccgggagctgcggctccctggcggccggcggcgggaggaaggccggggccagggggtggggctggcgcggggagaaggagcgcctgcagctgctccaccgcgcgctgcgcctcgtcggtcgccgcggggcaggcctgctgctgctgctcgccgtcgcctccgccgccctcttctgctccctcttcgccgtcgccaaagatgacaatacttcttcaattatcattgctagtaactatgaagtcacgaatgctatacaaaattctgtgtaccccagcacaacaaggcctctgatgagttcccaggaccaatactctgctagtggtgttaacgagactgagcatccgaatcagctgcttcttccatttgcgaactttacaaatcatccttgtgaaggtttcgcagttcctcctactctgtttgataagaaacgcactggaccacgaccatgccctgtttgctatgtctccgttgatcaggcatttgctctgatgcctctacaagcttcccaatctcctgtccttgagatcttaaattatgttgctgaagatagcacgactgcaaatttctcaaatcggggctctgcatttggagggtatctatccctggagcagagaaataaatcttttgacattaccaattcaatgactgttcactgtggttttgttagaggaaagaaacctggccaaggtactggattcgacatcaacaatgatgatctgctagagatggagcaatgccgtgggctagttgtagcttctgctattttcgggaattatgatatgattcaacatccaaggaatgtcagtgaactagcgaaggaaaatgcatgtttctatatgtttgtggatgaagaaacgaatgcttatgtcaagaattctagttcactgtacagagataataaaattggcatatggaggctagtagtcgttcaaaacctcccttataaagatccacggcgtacggggaagattccgaagcttctgctccatagactttttccaaatgtgagatattcaatttggatagacgcaaagcttcaacttgttgtggatccctatttattacttgagaggtttctttggagaaagaatgctacttttgcgatatctcggcactacagacgttttgatgtgtttgaagaagctgaagctaataaagctgccggaaagtatgacaattcatcaattgatgaacaaatagatttttacagaaatgagggccttacacattattctacagccaagcttcctatcacaagtgacgtccctgaaggatgcgtgatcatcagagaacacgtccccatctctaatctcttcacatgcctttggttcaatgaagttgaccgttttactgccagggatcagattagtttcagcaccgtccgggacaaaataagggctaaagttggctggatgccccaaatgttcctagactgtgaaaggcgcaatttcgttgtccaggcataccacagggagctgctagagcagatgatagcatctggtaggaatgtgcctccgatcgctggcgaaccatccgggaaacttaggctgggtagcaggaaggctcctccgtcgaagaagcctctattgaagcgaaaaaagcggaggcgtgtacagaaaccaattgccctgactatagatgccatgtgatgcactgggcagtcagtcggatataaggcgtagagcgttcacttgctgggatggatgccagatgattcagtgttcacttgctgggatgggatggatgccagctgattccgctgggggaggcacaggcttgtaattttttccgccgggacttgttcatagttaattcttcattgttgttgtaaataacaccgcaaaagcagagtcattcaattttgttcattgagcccagccttcttttctttctactagcaagcctttgaaataagcactacaagtaacgtgctcctgctgggctcagcctggcgtctgggctttgcacggttgcagcacaagcagatgggc

SEQ ID NO: 1374 - DNA, 2742 bp, Brachypodium distachyon
cggccattcatcacttgtttgtgccgctcccacgtccagtccagaagaacgctctcgcttttgcaccaagcctccacacgtgctccgccctcgcccccataatcccatctggcagcggcaaatggcaccgtcacgccgatccaccaagtacacacaccagcaatagttttctatccatcccaaccgccggcaggtgagatccgggcccccgcccgtcgccgctcaaagcttcgcgtcggtgatcgccccgcctctaaccgcagccactgggaaggaacaaggaagcagacgaggtcgaggaggagaccagagagcaccaccgccagtgggtggcgggggcagtagaaaggaaggaaggaacagtccgtcaatctccaagcgcgttctggtctcgtcgtcttgcccacgccacgcccacgcgcgaggatttcacatgcttcgctagcggacgcggggcacctacctcgggctcgggtgctcccattccggaccggcaaatcccctcgccgcgctcctcctaatccccacccacccacccggatcgctactgctgcgctcccatcgcgcgcctccctcgcccgcgggttaattggcccctcctgcgcggcgggctcggctcaccccccgatccggttcctctgcggcgggggatctcgcgggctcggattggcggcgtgatctggcggcgattgggatgagggtggtggggcggaggaggcgatgagcggcgcggcgtcgctggggctgcgcaccgggagctgcggctccctggcggccggcggcgggaggaaggccggggccagggggtggggctggcgcggggagaaggagcgcctgcagctgctccaccgcgcgctgcgcctcgtcggtcgccgcggggcaggcctgctgctgctgctcgccgtcgcctccgccgccctcttctgctccctcttcgccgtcgccaaagatgacaatacttcttcaattatcattgctagtaactatgaagtcacgaatgctatacaaaattctgtgtaccccagcacaacaaggcctctgatgagttcccaggaccaatactctgctagtggtgttaacgagactgagcatccgaatcagctgcttcttccatttgcgaactttacaaatcatccttgtgaaggtttcgcagttcctcctactctgtttgataagaaacgcactggaccacgaccatgccctgtttgctatgtctccgttgatcaggcatttgctctgatgcctctacaagcttcccaatctcctgtccttgagatcttaaattatgttgctgaagatagcacgactgcaaatttctcaaatcggggctctgcatttggagggtatctatccctggagcagagaaataaatcttttgacattaccaattcaatgactgttcactgtggttttgttagaggaaagaaacctggccaaggtactggattcgacatcaacaatgatgatctgctagagatggagcaatgccgtgggctagttgtagcttctgctattttcgggaattatgatatgattcaacatccaaggaatgtcagtgaactagcgaaggaaaatgcatgtttctatatgtttgtggatgaagaaacgaatgcttatgtcaagaattctagttcactgtacagagataataaaattggcatatggaggctagtagtcgttcaaaacctcccttataaagatccacggcgtacggggaagattccgaagcttctgctccatagactttttccaaatgtgagatattcaatttggatagacgcaaagcttcaacttgttgtggatccctatttattacttgagaggtttctttggagaaagaatgctacttttgcgatatctcggcactacagacgttttgatgtgtttgaagaagctgaagctaataaagctgccggaaagtatgacaattcatcaattgatgaacaaatagatttttacagaaatgagggccttacacattattctacagccaagcttcctatcacaagtgacgtccctgaaggatgcgtgatcatcagagaacacgtccccatctctaatctcttcacatgcctttggttcaatgaagttgaccgttttactgccagggatcagattagtttcagcaccgtccgggacaaaataagggctaaagttggctggatgccccaaatgttcctagactgtgaaaggcgcaatttcgttgtccaggcataccacagggagctgctagagcagatgatagcatctggtaggaatgtgcctccgatcgctggcgaaccatccgggaaacttaggctgggtagcaggaaggctcctccgtcgaagaagcctctattgaagcgaaaaaagcggaggcgtgtacagaaaccaattgccctgactatagatgccatgtgatgcactgggcagtcagtcggatataaggcgtagagcgttcacttgctgggatggatgccagatgattcagtgttcacttgctgggatgggatggatgccagctgattccgctgggggaggcacaggcttgtaattttttccgccgggacttgttcatagttaattcttcattgttgttgtaaataacaccgcaaaagcagagtcattcaattttgttcattgagcccagccttcttttctttctactagcaagcctttgaaataagcactacaagtaacgtgctcctgctgggctcagcctggcgtctgggctttgcacggttgcagcacaagcagatgggc

SEQ ID NO: 1375 - DNA, 2406 bp, Setaria italica
gacgaaggccgcgagggaaccagtgcgagcgcccgcgccgcgcgcagcaggagctaggaaggaaccgcccccgagccgcagcgcgtccgtcgtcgtctcgcctgggacgcgcaaaaatcacatccgcgtcacatgctcgctcggccggcgcaccaccacctaccctcctctcctcccgccccactccgctccgctgcgctccattccgaaccggcaaatcgcgtcgccgccgcgccgcgcttctaacccccacccaactctgcctctgatccccacccacgcgagcgccccgtccgtccaggtccagcccccggcgtgttaagtagcaatccgcctcggtttcctcccacccccctctgatccggttcccacaacgcccgcggctcctcctcgccgacgccgacgccgctgtcgccgaatccctcgctagaggcgcggatctcgcggcccaggcacccggccgatccggcgattgggatgagagcgggcggccggcgatgagcggctcggcggcggggctggggctgcggtccgggagctacggctccctcgcggccgccgtcggcggcagcggcggcggcgcgaggaaggcgggcgggagggggtgggcactgcgcggggagaaggagcggctgcaactgctgcaccgcgcgctgcggctggtcggccgccgcagggccggcgtgctgctgctgctcgccgtcgcgtccgccgccgtgttctgctccctcttcgccgtcgtcaaagatgacagtagttcaattagcattgtgaataattatgaagtcccaaatgccatacagaagtcagtgtatcccagcacaacccgacctctaaagatgtccggagaccaatactcaagtgttgtcaacaaaatcgagcttccaaatcgacttcatctttcatatgcaaatttcacacatccttgtgaaggtttctcagttcctcctcccctggttgataagaaacgcactggaccccgaccatgccctgtttgctatgtctctgtagatcaggcatttgcactgatgcctctacaggcttcaccatcacctgtcctaaagaacctaaactatatatctgaagatggcatcgttgcaaatttatcaagtcagggctctgaatttggaggacatccatccctggagcagagaaataaatctttcgacattagtgaatcaatgactgtccactgcggctttgtcagaggaaagaagcctggccaaggtactggattcgacatcaaggatgatgacctggtagagatggagcaatgccgtgaactagttgtagcttctgctattttcggaaattatgacatgattcaacatccgaggaacatcagtgaattttcaaaggcaaatgcatgcttttacatgtttgtagatgaagaaacagaagcttatgtgaagaattctagttctttgtacaataataataaagttggactttggaggttagtggttgtccgaaacctcccttatgaagacccaaggcgtacgggaaagattccgaaacttctgctccataggctttttccaaatgtgagattttcagtttggatagatgcaaaacttgagcttgttgccgatccatatctcctgcttgagaggttcctgtggcggaagaaagcaacttttgcaatatctcggcattacaaacgctttgatgtgtttgaagaagcagaagctaataaagctgcgggaaagtatgacaacgcgtcagttgattaccaaatagagttttacagaaacgagggcctatcacattattctcctgcaaagtttcccatcacgagtgatgtccctgaaggttgtgtgatcatcagagaacacatccccatcacgaacctcttcacatgcctatggttcaatgaagttgaccgcttcacctccagggatcagataagtttcagcactgtccgggacaaaatcagggccagagttggctggatgcctgaaatgttcctggactgtgaaaggcgcaacttcgtcgttcaggcgtaccacagggagctactggagcaaatgattgcgtccggtaggaggcccccctcaacgaccgacgcaccaccgtctcgaaaacttcggccaggcagcaggaaagctcccccgtcgaagaagccctccgtgaagcggaaaaaggagaagaaatcgagctcgcggaggcgtgttcccaagcccccggtcgccggggggatgggtgctatgtgactcaagttttttggcggagcctggactcccacacttatacaagcgtataacggaacacaagctgattcggttaggggctggggcttgtaatcgtgccccggcgaaagttgtccatagttattcttcattgttgttgtacataacagcgcaaatcaatattcaattctgttcattgagattgtgtccagttgtt

SEQ ID NO: 1376 - DNA, 1943 bp, Zea mays
gcgtcggcgatgaccgactcggcggcctcgctgggcctgcggtccgagagctacggctccctcgcggccgccgtcggcggcgagaggaaggccggcgccgccgccgcctgccgcccgctgcgcggggagaaggaccgcctgcagctgctgcaccgcgcgctgcggctgggcggtcgccgcagggccggcgtcctgctgctgctcgccgtcgtgtccgccgctgtcttctcctctctcttcgccgtcgtcaaagatgacagcaattcaatcagtatcgtaaataattatgaagtaccaaatgccatacagaagtcagtgtatcccagcacaacacggcctctaatgatgtctggaaaccaatactccaccagtgttgtcaacaaaatcgagcttccaaatcggcttcatcttacgtatgcaaacttcacacatccttgcgaaggtttctcagtccctcctcccctggttgataagaaacgcactggaccccgaccatgccctgtttgctatgtttctgtggatcaggcatttgccttgatgcccctacaagcttcaccatcacctgtcgtaaagaacttaaactatgtatcagaagatggtgttactgcaaatttatcaaatctaggatctggatttggagggcatccatctctggagcagagaaacaaatctttcaacattaatgagtcaatgactgtccactgtggctttgttagaggaaagaagcctggccaaggtactggattcgatatcaaggatgatgatctgctagagatggagcaatgccgtgagctagtcgtagcttctgctatttttggaaattatgatatgattcagcatccgaggaacatcagtgaattttcaaaggcaaatgcatgtttctatatgtttgtagatgaagaaacagaggcttatgtcaagaattctagttctttgtacaataataataaagttggactgtggaggctggtggttgtccgaaacctcccttatgaagatccaaggcgtacgggaaagattccaaaacttctgctccataggctttttccaaacgtgaaattttcagtttggatagatgcaaagcttcagcttgttgcggatccctatctcctgcttgagaggttcctgtggaggaagaataccacttttgcaatctctcggcattacaaacgctttgatgtgttcgaagaagcagaagctaacaaagctgctggaaagtattacaacgcatccatcgattaccaaatagagttttacagaaatgagggcctaacacattattctcctgccaagcttcccatcacaagtgatgtccctgaaggctgtgtgatcatcagagaacacatccccatcacgaacctcttcacgtgcttatggttcaatgaagttgatcgcttcacctccagggaccaaataagtttcagcaccgtccgggacaaaatcagggctagagttggctggatgcccgagatgttcatggactgcgagaggcgcaactttgtcgttcaggcgtaccacagagagctactggagcagatgattgcatcaggtaggatgcccccttcgggggctgtggtggtgaccgacgcagcaccatctcggaaagtccgggcaggtagcaggaaggctactccgtcgaagaagccctccgtgaagcggaaaaaagagaagaaatcgagctcgcgacggcgtctcccgaaacccgtcgccggtggtttgggtgctatgtgacctaagttttcgtcgagtagcagagtcttgatactcccacagtcacacacttatacagcgtgtaccggaatacaaacaatgttccattacttaggtctggggcttgtaatcgtgccccggcgaaatttgttcatattactcttcatcgttgttgtacataacatctccaaaccaatattcaattttgttcattgatgttatgttcagttatt

SEQ ID NO: 1377 - DNA, 2852 bp, Sorghum bicolor
gtgctgtctcacctgccatgccatggcattggcatggcaagcactcctcgccatcgcaccgacggaacggaccggaccccgccgtcctcccctcccttctgcctgcgacgcgatcgccaagtgccaaatggaaatggcaccaaccaaccaaggccattttttattggcaaatcactggcaagcagccaagcaccgcggccgacccaccctcgcccgggctcggtcgctctcgctcacggatcagggctgggcggggcgaggaggggcggtacgtcgtcgtcgtctcgctgacgtccggcgtccgcgtttatttattaaccgtccggcgtccgcctaggcgtctagcgggggtcagtgtcaggcgcggcgcagtcagcccagtcgcccgtggcggaggagaggaagcagacgaggagccgaggaaccgccccccaagcgcgagcgcggtcgtccgtctcggccgagcctggcactggccagcacgcgcaaaatcgcatcgcatcacgagctccctcgctcggccggcgcggcgcaccacctaccctcccgcccggctccgctgcccgcccgctcgctcgctctccgattccgaacaggcaaaaccgcgtcgccgccagccccgccccgccccgcccccgccgcgccgcgcttctaacccccacccaactctacttctgcctccgatcccacgcgccccgcgcgttaagtatccatccgcctcggctcgctcccctcacccatctgaatatctgatctggttcccacccgcgggcgccgcgccgcaccgcatcgccgccgccgaatctcgtgcgcgcggcgcgggatctcgcgggcccggggccccaggatccggcgattgggatgagagtggggcgcaggcggcgatgaccggctcggcggcctcgctgggcctgcggtccgggagctacggttccctcgcggccgctgtcgtcgtcggcagcggcggcgggaggaaggcgggcgccggcgccgcctgccgcccgctgcgcggggagaaggagcgcctgcagctgctgcaccgcgcgctgcggctggtcggccgacgcagggccggcgtgctcctgctgctcgccgtcgcgtccgcggctgtcttctgctccctcttcgccgtcgtcaaagatgacagtaattcaattagtattgtaaataattacgaagtcccaaatgccatacagaagtcagtgtatcccagcacaacacggcctctaatgatgtccggaaaccaatactccaccagtgtcgtcaacaaaatcgagcttccaaatcggcttcatctttcatatgcaaactttacacatccttgtgaaggtttctcagttcctcctcccctggttgataagaaacgcactggaccccgaccatgccctgtttgctatgtttctgtggatcaggcatttgccttgatgcccctacaagcttcaccatcacctgtcctaaagaacttaaactatgtatcagaagatggtattactgcaaatttatcaaatcagggatctggatttggagggcatccatctctggagcagagaaacgattctttcaacattaatgaatcaatgaccgtccactgcggctttgtcagaggaaagaagcctggacaaggtactggattcgatatcaaggatgatgatctgctagagatggagcaatgccgtgagctagtcgtagcttctgctatttttggaaattatgatatgattcaacatccgaggaacatcagtgaattttcaaaggcaaatgcatgtttctatatgtttgtcgatgaagaaacagaggcttatgtcaagaattctagttctatgtacaataataataaagttggactgtggaggctggtggttgtccgaaacctcccttatgaagacccaaggcgtacgggaaagattccaaaacttctgctccataggctttttccaaatgtgagattttcagtttggatagatgcaaaacttgagcttgttgcggatccctatctcctgcttgagaggttcctgtggaggaagaataccacttttgcaatctctcggcattacaaacgctttgatgtgtttgaagaagcagaagctaacaaagccgctggaaagtatgacaactcgtcaattgattaccagatagagttttacagaaatgaaggcctaacacattattctactgctaagcttcccatcacaagtgatgtccctgaaggctgtgtgatcatcagagaacacatccccatcacgaacctcttcacatgtctgtggttcaatgaagttgaccgcttcacctccagggaccaaataagtttcagcaccgtccgggacaaaatcagggctagagttggctggatgcccgaaatgttcatggactgcgagaggcgcaactttgtcgttcaggcgtaccaccgggagctactggagcagatgattgcgtccggtaggatgcccccttcggcggtggcggcgaccgacgcaccaccatctcggaaagtccgggcaggtagcaggaaagctcctccgtccaagaagccgtccgtgaagcggaaaaaggagaagaaatcgagcttgcgacggcggctcccgaaacccgtcgccgggggcttgggtgcgatgtgacagtaagttttcctctgtagcagtctggatactcccacacagtcacacttatacagcgtgtaccggaatacaaacattgttccattagggctggggcttgtaatcgtgcccccgcaaaatttgttcatagtttattcttcaacattgttgtacataacagcgccagatcaatattcaattttgttcattgatattatgctcagttccattgatgttatgttcagttatttctgctcg

SEQ ID NO: 1378 - DNA, 1953 bp, Hordeum vulgare
cccgcggcggccgccgtccccgccgggaggaaggccaggggctggggcctgcgcgccggcgccgccgccggggacaaggagcgcctgcagctgctgcaccgcgcgctgcgcctcgtcggccgccgcggggccggcctgctcctgctgctcgccgtcgcctccgccgcgctcttctgctccctattcgccgtcgtcaaagatgacaatacttcttcaattatcattgctagcaactacgaagtcacgaatgccatccagaattctgtataccccagcacaacaaggcctctgatgatgtccaatgaccacaacaaattcgagcatccaaatcggcttcatctttcaccttcaaactttacaaatcatccttgtgaaggtttcgcggttcctcctatcctgtttgataagaaacgcactgggcctcgaccatgccctgtttgctatgtgtcggtagatcaggcatttgctctgatgcctctacaagcttctccatctcctgtccttgaaaacttaaaatacgccttggaagacagcgtcactgcaaatttctcaaatccgggctctgcatttggagggcatctatctctggagcagagaaataaatcttttgacattaccgattcgatgactgtccactgtggatttgttagaggaaagaaacctggccaaggtaccggatttgacatcagtgatgatgatctgctagaaatggagcaatgccgtgagcttgttgtagcttccgccattttcgggaattatgatatgattcaacatccaaggaatgtcagtgaactgtcaaaggcaaatgcgtgtttttatatgtttgtagatgaagaaacaatggcttatgtcaagaattccagctcactgtacaaagataataaagttggcttatggaggctagtggttgtccgaaacctcccttatgaagatccaaggcgcacggggaagattcccaagcttctgctccataggctatttccaaatgtaagattttcagtttggatagacgcaaagcttcagcttgttgtggatccttatttactgcttgagaggtttctgtggagaaaggattctagttttgcgatatctcggcactacagacgttttgatgtgtacgaagaagcagaagctaataaagctgctggaaagtatgacaatgcatcaatcgatgaacagatagatttttacagaaatgagggcctaacacattattctcccgccaagcttcctatcacaagtgacgtcccggaaggctgtgtgatcatcagagaacacgtccccatctcgaacctcttcacatgtctttggttcaatgaagttgaccgtttcaccgccagggatcaaatcagcttcagcaccgtccgggacaaaataaggtctaaagtcggctggatgccccagatgttcctggactgcgagaggcgcaactttgttgtccaggcataccacagggagctgctagagcagatgatcgcgtccggcaggaacacgcctccgaccgccgtcgagccatcgcggaaaatcaggccgggtggcagcaggagagctcccccgtcgaagaagcctgtcgtgaagcggaaaaaggagaagaaatcgagctcgcggaggcgggtcccgaagccggttacgtgggccatggatgctgtgtgactgacggaggttcacagggatggacggactcctgtcactctatcgatagttgggcgtggtcgtgtcgcagctggtgccgctaggggagggagggaaagaaagggggaatggaggattgtaattttttgccggccacgaaatagaatttgttcatagtcaattcttgattgttgttgtaaataacagcggaaagcagtatcattcaattgagcccggcccttttttctgtttctgattggaaagccaagaaacaaaatgcgcgcactgtacaatctttctgtgcagtggtaaaaaaatgta

SEQ ID NO: 1379 - DNA, 2528 bp, Oryza sativa
cgaggccaggcgactcgtcagccgcgaggaagacgacgacgaggccaccgcgtcgccgtctcgtcagtgagtcgtcacgcgcgctcgcgcgcaggaatctcacatgctgctgctgccgctgctgctgctggtgtggtggtaggttccagctccgtgaaccggcaaaaaaaatcctccccgtctcgccgcccgccgcgcccgcgccgcgcttctaacccccacccacccacccaccgcccgcgcgcgcgcgcgcgtcggtgctccacctgcatcctctaatccccgcgtgggcggcgccttgtctgatctggttgccagccacagctcgcgggatctcgcgtgtttcggtggaggggattgcggcgccgtgtgattcggcgattgggatgagagaggggaggcggcggctgcggcggtggcgatgagtggctcggcggcgacgctggggatgcggtgcgggagctacggctccctcgcgtcggccggcggcgggaggaagggcgggggcagggggtgggggtggcgaggcggcggggagaaggagcggctgcagctgctccaccgcgcgctgcggctggtgggccgccggagggccggggtgctgctgctgctcgccgctgcctccgccgccgtcttctgctccatcttcgccgtcgtcaaagatgataatgcttcaatgatcattgcaaataactatgaagtcgcaaataccatacagaactctgtgtatcccagcatgacaaggcctctaatgacgtccagcgaccaattctctgctagtagcgtcaacaaaactgaacttccaaatcgacttcgtctttcatttgcaaactttacacatcatccttgtgaaggtttctcagttgcccctcccctggttgatccgaaacgcactggaccacgaccatgtgatgtttgctacgtgcctgtagaccaggcgttcgctcttatgcctccacaaccttcaccatctcctgtccttaagaacttaagttatgtatttgaagacaacatcactgcaaatttctcaaatcagggctctgtatttggtgggcatccatctctggagcagagaaataaatcttttgacattagtgagtctatgactgtccactgtggctttgttagaggaaagaaacctggccaaggttctggatttgatatcaatgatgatgatctgttagagatggagaaatgccgtgagctggttgtagcttctgctatttttgggaattatgatatgattcaacatccaaggaatgccagcgaattttcaaaggcaaatgcatgtttttatatgtttgtagatgaagaaacagaggcttatgtaaaaaattctagctcattgtacagaaacaacaaagttggcttatggaggctagtggtcgttcgaaatctcccatacgaagatccaaggcgtacggggaagattcctaagcttctgctccataggctttttccaaatgtgagattttcagtttggatagatgcaaagcttaagctcgttgtggacccttatctactgcttgagaggtttttgtggaggaagaatgctacttttgctatctctcggcactacaaacgctttgatgtatttgaagaagcagaagctaataaagctgctggcaagtatgacaatgcatcaattgattaccaaatagagttttaccgaaatgagggcctaacatattatgcacctgctaagcttcctattacaagtgatgtccctgaaggttgtgtcatcatcagagagcacattcccatcacgaatctcttcacatgcctttggttcaatgaagttgaccgtttcacctccagggatcaaattagtttcagcaccgtccgggacaaaataagggctagagttggctggatgcctgaaatgttcctggactgcgaaagacgcaacttcgttattcagggataccacagggagctactagagcaaatgattgcatccggttggaagccccctccaacggccagtgaaccatctcgaaaactcagattaggtagcaggaaagctcctccatcaaagaagtcttccatgaagcggaaaagagtgaagaaatcgagctcgcggaggcgtctccccaaaccaatcactaggatgactgatactactacctggcaaaagttgggcgcatgatgatccagggctctttcctctttgttgacacaattcactttgctggagggcgagctcattctattaggacacatacttgtagttttttttccctccgacgagatttgttcatagtttattcttgattgttggtgtaaataacagcgaaagcaatataatcaaatattttcgatgagcagccattttttctttgtaacaacagctgctaccacaaggtgaccaactaagctaaagggttatgttatttctcaagctggtgccaaatctcttggtgatttgtctagacagaagaaatagcaactaagagatgtgctgatttattctgttactcacttgggatgtcaagttggcaattgcatatgctactattgtaaagatg

SEQ ID NO: 1380 - DNA, 2095 bp, Zea mays
cctccgatcccaccctcccagcccagcgcgtcaagtaccccgcctcggttcgctccccgtgtgatctggttcccacccgcggccatcgcatcgccgccgccgccgccgccgccgcagaacctcgcgctcccggcgcgggatctcgcgggccccggccccacggtccggcgatcgggatgacagcggcgcgccggcgatgaccggctcggcggcctcgctgggcctgcggtccgggagctacggctccctcgcggccgccgccgtcgtcggcagcggcgggaggaaggccggcgccaccgcctgccgcacgctgcgcgtggagaaggagcgcctgcaccgcgcgctgcggctggtcggacgccgcaggaccggcgtcctgctgctgctcgccgtcgcgtccgccgctctcttctgctccctcttcgccgtcgtcaaagatgacgccaattcaactagtattgtaaataattacgaagtcccaaatgccatacagaagtcagtgtatcccagcagaacacgacctctaatgatgtctggaaaccaagagtccaccagtgttgtcaacaaaattgattttccaaatcggcttcatctttcatttgcaaacttcacacatccttgtgaaggtttctcagttcctcctcccctggttgataagaaacgcactggaccccggccatgccctgtttgctatgtttccgtggaccaggcatttgccttgatgcccctacaagcttcaccatcacctgtcctaaaggacttaaactatgtatcagaagatggtgttactgcaaatttatcaaatcagggatctggatttggagggcatccatccctggatcagagaaacgattctttcaacattaatgagtcaatgactgtccactgcggctttgtcagaggaaagaagcctggccaaggtactggattcgatatcaaggatgacgatctgctagagatggagcaatgccacgatctagtcgtagcttctgctatttttggaaattatgatatgattcagcatccgaggaacatcagtgatttttcaaaggcaaatgcatgcttttatatgtttgtagatgaagaaacagaggcttatgtcaagaattctagttctctgtacaacaataataaagttggactgtggaggctggtggttgtccgaaacctcccttatgaagacccaaggcgtacgggaaagattccaaaacttctgctccataggctttttccaaatgtgagattttcagtttggatagatgcaaaacttgagcttgttgtggatccctatctcctgcttgagaggttcctttggaggaagaataccacttttgcaatctctcggcattacaaacgctttgatgtgtttgaagaagcagaagcgaacaaagctgctggaaagtacgacaacgcgtcaatcgattaccaaatagagttctacagaaacgagggcctaacgcattattcttctgctaagcttcccatcacaagcgatgtccccgaaggctgtgtgatcatcagagagcacatccccatcacgaacctgttcacgtgcgtatggttcaatgaggttgatcgcttcacctccagggaccagatcagtttcagcacggtccgggacaaaatcagggctagagttggctggatgcctgagatgttcatggactgcgaaaggcgcaactttgtcgttcaggtataccacagggagctactggagcagatgattgcatctggtaggatgccccctttggcggcggctgtgacgcacgcgaatgtccgggtaggtagcaggaaagctcctccgacaaagaagccctccgtgaaacggaaaagggagaaaaaatcgagctcgcgacggcgtctcccgaaacccatcgcccaggggttggatgccaatgtgacgcaagtttttttctcagtagcagagtctggatagtcccacacaggaacattgttccattaggtctggggcctgtaatcgtgccccggcgagatttgttcatagctattcttcatcattgttgtacataacagcggcaacccaacattcaattttctccattcatattatcttcggttccattgatattatgtt

SEQ ID NO: 1381 - DNA, 1482 bp, Cenchrus ciliaris
ttcacacatccttgtgaaggtttctcagttcctcctcccctggttgataagaaacgcactggaccccgaccgtgccctgtttgctatgtctctgtagaacaggcattcgcactgatgcctctacaggcttcaccatcacctgtcctaaagaacctaaactatatatctgaagacgacatcgttgcaaactcatctagtcaaggctctagatttggaggacatccttctctggagcaaaggaataaatctttcgacattggtgaatcaatgaatgtccactgcggctttgtcagaggaaagaagcctggccaaggtactggatttgatatcaaggatgatgacctgctagagatggaggaatgtcgtgaactatttttagcttctgctattttcggaaattatgacatgattcaacatccgaggaacatcagcgaattttcgaaggcaaatgcgtgcttttacatgttcgtagatgaagaaacagaagcttatgtcaagaattctagttctttgtacaataataataaaattggactatggaggttagtggttgtccgaaacctcccttatgaagacccaaggcgtacgggaaagattccgaaacttctgcttcataggctttttccaaatgtgagattttcagtttggatagatgcaaaacttgagcttgttgctgatccctatctcctgcttgagaggttcctgtggaggaagaatgtcacttttgcgatctctcggcattacaaacgctttgatgtgtttgaagaagcggaagctaataaagccgcgggaaagtatgacaacgcatcgattgattaccagatagagttttacagaaacgagggcctatcacattattctcctgctaagtttcccatcacgagtgatgtccctgaaggttgtgtgatcatcagagaacacatccccatcacgaatctcttcacatgcctatggttcaatgaagttgaccgcttcacctccagggatcagataagtttcagcactgtccgggacaaaatcagggccagagttggctggatgcccgaaatgttcctggactgtgaaaggcgcaacttcgtcgttcaggcgtaccacagggagctactggagcaaatgattgcatccggtaggaggcccccctcaacgaccgacgcaccaccgtctagaaaactccggccaggcagcaggaaagcacccccgtcaaagaagccctcggttaagaggaaaaaggagaagaaatcgagctcgcggaggcgtgttcccaagcccccgctggtcgccgggggaatgggtgctatgtgacgcaagttttttcggcggagtctggactcccacacttatacaagcgtgtaactgaatacgagctgattcgtttagggctggggcttgtaattgtgccccggcgaaagttgtccatagttattcttcattgttgttgtacataacagcgcaaatcaatattcaattctgttcactgaggta

SEQ ID NO: 1382 - DNA, 1668 bp, Hordeum vulgare
gaattaccgagcttcttttttcaggcgagccgaggttgcttcttctccacaagccttccttcggccacgtagtacggcagctggtaccccgatgtccgtcgcgtccgcttccgcggccgccctccggtcctcgtccggccgccgctgcggcgtcgggactggcctcaacggaggcaacaagtttctgatgatgcagaggagggacctattgaccaagggggtagcgctctccgtctcctcctcgctgctcgcctcctccacctcctccgacggcgccgctgctcaagcattggagaggctgccgttcaaggcggacgggtacagcttctggacgtggaggggccgcaggatacactacgtggagcaagggtccggccagcccatcgtgctcatccacggcttcggcgcgtcggcgttccattggaggtacaacatcccggagctggccaagaagtacaaggtgtacgccgtggacctgctgggctttggctggagcgagaaggcgctggtggagtacgacgccaccatctggatggagcaggtctccgacttcctcagggaggtcgtccagtcgccatccgtcgtcgtcggcaacagcttaggtggcttcacgacgttgttcgcggcgacggaggtgccggagctggtccggggcgtcgtgctgctcaactccgccggccagttcggagaccccaacgcaccacccaaggctgaagaggcggcggaggaggaggtgagcgcggtgacgaggctcatcgtgaagccgctcaaggaggcgttccagcgggtcgtgctcgggttcctcttctggcaggccaagcagccggccagggtcgagaaagtcctcaaaagcgtgtacaaagatccgagcaacgtggacgagtacctgataagctcgatcacggcgccgacggccgacccgaacgccggcgaggtgtactacaggctcatgtcgcggttcatggcgaaccagagccggtacacgcttgacaagctgctggggaagctgacgtgcccgctgctgctgttgtggggggacctggacccgtgggtcggcccggccaaggcggcgcggatccacgagttctacgccaactccaccgtcgtcaacctgcaggccgggcactgcccgcacgacgaggcgccggagcagttcaacgcggcgctgctccagtggctcgcgtcactggaggaggaggccggcgacaagccggccgagcccagcctccaggtcgtctgattcttgtgcttgcaccaccaaccggacggaacatagcgaggatcgtgaggatgtatactacagtactagcttaaatctgagcgtttagcttgtagcgatattagggacagagtaaatcgagaagtgtaagtactcattctgttacatttgaaggttaatttggggcaaacatgtagatgagccgcaagtgtggcttaacaactagagacatggtgttcatacttcatagggatgcaagtttgtaggttgacgcagattggcaggaataggttgacgcagattggccattcggtagtccaaccaacgcacacaacgttcatgcctgcgagacacaacctagaaagggtcatcgacttgcatgaaacgttgcacgaaatacatacaaagaaacttgatggggttatctttaaagtgaattttgaaaaggc

SEQ ID NO: 1383 - DNA, 1403 bp, Hordeum vulgare
gggaattaccgagcttcttttttcaggcgagccgaggttgcttcttctccacaagccttccttcggccacgtagtacggcagctggtaccccgatgtccgtcgcgtccgcttccgcggccgccctccggtcctcgtccggccgccgctgcggcgtcgggactggcctcaacggaggcaacaagtttctgatgatgcagaggagggacctattgaccaagggggtagcgctctccgtctcctcctcgctgctcgcctcctccacctcctccgacggcgccgctgctcaagcattggagaggctgccgttcaaggcggacgggtacagcttctggacgtggaggggccgcaggatacactacgtggagcaagggtccggccagcccatcgtgctcatccacggcttcggcgcgtcggcgttccattggaggtacaacatcccggagctggccaagaagtacaaggtgtacgccgtggacctgctgggctttggctggagcgagaaggcgctggtggagtacgacgccaccatctggatggagcaggtctccgacttcctcagggaggtcgtccagtcgccatccgtcgtcgtcggcaacagcttaggtggcttcacgacgttgttcgcggcgacggaggtgccggagctggtccggggcgtcgtgctgctcaactccgccggccagttcggagaccccaacgcaccacccaaggctgaagaggcggcggaggaggaggtgagcgcggtgacgaggctcatcgtgaagccgctcaaggaggcgttccagcgggtcgtgctcgggttcctcttctggcaggccaagcagccggccagggtcgagaaagtcctcaaaagcgtgtacaaagatccgagcaacgtggacgagtacctgataagctcgatcacggcgccgacggccgacccgaacgccggcgaggtgtactacaggctcatgtcgcggttcatggcgaaccagagccggtacacgcttgacaagctgctggggaagctgacgtgcccgctgctgctgttgtggggggacctggacccgtgggtcggcccggccaaggcggcgcggatccacgagttctacgccaactccaccgtcgtcaacctgcaggccgggcactgcccgcacgacgaggcgccggagcagttcaacgcggcgctgctccagtggctcgcgtcactggaggaggaggccggcgacaagccggccgagcccagcctccaggtcgtctgattcttgtgcttgcaccaccaaccggacggaacatagcgaggatcgtgaggatgtatactacagtactagcttaaatctgagcgtttagcttgtagcgatattagggacagagtaaatcgagaagtgtaagtactcattctgttacatttgaaggttaattt

SEQ ID NO: 1384 - DNA, 1510 bp, Leymus cinereus x Leymus triticoides
  misc_feature (1478)..(1479): n is a, c, g, or t
agcttcttttttcaggcgaaccgagaggttgcttcttctccacgagccttccttcggccacgtacggcggcttctacccgatgtccgtcgcgtccgcatcggccgccgccctccggtcctcgtccggccgccgctgcggcgtcggaactggcctcaacgggggcaacaagtttctgatgatgcagaggagggacctcgtgaccaagggggtcgcgctctccgtctgctcctcgctgctcgcctcctcctcctccaacggtgccgctgctcaagcattggagaggttgccgttcaaggcggatgggtacagcttctggacgtggaggggccgcaggatacactacgtggagcaagggtccgggcagcccatcgtgctcatccacggttttggcgcgtcggctttccattggaggtacaacatcccggagctggccaagaagtacaaggtgtacgccgtggacctgctgggcttcggctggagcgagaaggcgctggtggagtacgacgccaccatctggatggagcaggtctccgacttccttagggaggtcgtccagtcgccatccgtcgtcgtcggcaacagcttaggtggcttcacgacgctgttcgcggcgacggaggtgccggagctgatccggggcgtcgtgctgctcaactccgccggccagttcggggaccccaacgcgtcgcccaaggctgaagaggcggtggaggaggaggtgagcgcggtgacgaggctcatcgtgaggccgctcaaggaggtgttccagcgggtcgtgctcgggttcctcttctggcaggccaagcagccggccagggtcgagaaagtcctcaaaagcgtgtacaaagatccgagcaacgtggacgagtacctgatcggctcgatcacggcgccgacggccgacccgaacgccggggaggtgtactacaggctcatgtcgcggttcatggcgaaccagagccggtacacgctggacaagctgctggggaagctgacgtgcccgctgctgctgctgtggggggacctggacccgtgggtcggcccggccaaggcggcgcggatccacgagttctatgccaactccaccgtcgtcaacctgcaggccgggcactgccctcacgacgaggcgccggagcagttcaacgcggcgctgctccagtggctcgcgtcactggaggaggaggccgtcgacaagccggccgagcccagcctccaggtcgtgtgattcttgtgcctgtaccccaatctgacagagggcgttcaagtgaagaagattgtgtgcttacgggacctggcgaggatcgtgaagatgtatacttagtacgtaccagcttacaagtggcgtttagcttgtagcaatatttgctacgtagatagggacagagtaaattgagaagtgtaagggcatctccaactaggaccctcaacgcccgcaaccgtccgtgtattgccatccaacgcggtcctgtatcggtcnntggaccggtccggacgtgttttttcccctca

SEQ ID NO: 1385 - DNA, 1504 bp, Triticum aestivum
gaatcacccagcttcttttttcaggccaaccgaggttgcttcttctccacgacccttccttcggccacgtacggcggcttctaccccgatgtccgtcgcgtccgcacctgccgccgccctccggtcctcgtccggccgccgctgcggcgtcggaaccggcctcaacggaggcaacaagtttctgatgatgcagaggagggacctcgtcaccaagggggtcgcgctctccgtctgctcctcgctgctcacctcctcccccaacggcgccgctgctcaagcattggagaggctgccgttcaaggcggacgggtacagcttctggacgtggaggggccgcaagatacactacgtggagcaagggtccgggcagcccatcgtgctcatccacggcttcggcgcgtcggcgttccactggaggtacaacatcccggagctggccaagaagtacaaggtgtacgccgtggacctgctgggcttcggctggagcgagaaggcgctggtgcagtacgacgccaccatctggatggagcaggtctccgacttcctcagggaggtcgtccagtcgccatccgtcgtcgtcggcaacagcttaggtggcttcacgacgctgttcgcggcgacggaggtgccggagctggtccggggcgtcgtgctgctcaactccggcggccagttcgcggaccccaacgcgccgcccaaggctgaagaggcggcggcggcggaggaggaggtgagcgcggtgacgaggctcatcgtgaggccgctcaaggaggccttccagcgggtcgtgctcgggttcctcttctggcaggccaagcagccggccagggtcgagaaagtcctcaaaagcgtgtacaaagatccgagcaacgtggacgagtacctgatcagctcgatcacggcgccgacggccgacccgaacgccggcgaggtgtactacaggctcatgtcgcggttcgtggcgaaccagagccagtacacgctggacaagctgctggggaagctgacgtgcccgctgctgctgctgtggggggacctggacccgtgggtcggcccgtccaaggcggcaaggatccacgagttctacgccaactccaccgtcgtcaacctgcaggccggccactgcccgcacgacgaggcgccggagcagttcaacgcggcgctgctccagtggctcgcgtcgctggaggaggaggccggcgacaagccggccgagcccagcctccaggtcgtgtgattcttgtacctgtaccccaatccgacagagggcgttccagtgaagaagatcgtgtgcttacgggacctgccgaggatcgtgaagatgtatacccggtactagcttacaagtggcatttagcttgtagcaatacttgctacgtagataggaacagagtaaattgagaagtgtaagagcatctctagccgatatctaaaaggctatagagaagtacaaaatttattttactcctctaacctacacctagctgaattcctaaaaaaaaaa

SEQ ID NO: 1386 - DNA, 1627 bp, Triticum aestivum
ccgggctctgccacggctgcccgattgcccgccacccacacaccaacgccggcgcaaacctacaagtaaaactctctccgcccgtcaccacggatcacccagcttcttttttcaggcgatccgaggttgcttcgtctccacgacccttccttcggccacgtacggaggcttctaccccgatgtccgtcgcgtccgcatctgccgccgccctccggtcctcgtccggccgccgctgcggcgtcggaaccggcctcaacggaggcaacaagtttctgatgatgcagaggagggacctcgtcaccaagggggtcgcgctctccgtctgctcctcgctgctcgcctcctccacttccaacggcgccgctgcacaagcattggagaggctgccgttcaaggcggacgggtacagcttctggacgtggaggggccgcaagatacactacgtggagcaagggtccgggcagcccatcgtgctcatccacggcttcggcgcgtcggcgttccactggaggtacaacatcccggagctggccaagaagtacaaggtgtacgccgtggacctgctgggcttcggctggagcgagaaggcgctggtgcagtacgacgccaccatctggatggagcaggtctccgacttcctcagggaggtcgtccagtcgccatccgtcgtcgtcggcaacagcttaggtggcttcacgacgctgttcgcggcgacggaggtgccggagctggtccggggcgtcgtgctgctcaactccgccggccagttcgcggaccccaacgcgccgcccaaggctgaagaggcggcggcggcggaggaggaggtgagcgcgctgacgaggctcatcgtgaagccgctcaaggaggccttccagcgggtcgtgctcgggttcctcttctggcaggccaagcagccggccagggtcgagaaagtcctcaaaagcgtgtacaaagatccgagcaacgtggacgagtacctgatcagctcgatcacggcgccgacggccgacccgaacgccggcgaggtgtactacaggctcatgtcgcggttcgtggcgaaccagagccagtacacgctggacaagctgctggggaagctgacgtgcccgctgctgctgctgtggggggacctggacccgtgggtcggcccgtccaaggcggcaaggatccacgagttctacgccaactccaccgtcgtcaacctgcaggccggccactgcccgcacgacgaggcgccggagcagttcaacgcggcgctgctccagtggctcgcgtcgctggaggaggaggccggcgacaagccggccgagcccagcctccaggtcgtgtgattcttgtacctgtaccccaatccgacagagggcgttccagtgaagaagatcgtgtgcttacgggacctgccgaggatcgtgaagatgtatacccggtactagcttacaagtggcatttagcttgtagcaatacttgctacgtagataggaacagagtaaattgagaagtgtaagagcatctctagccgatatctaaaaggctatagagaagtacaaaatttattttactcctctaacctacacctagctgaattcctaaattttatagtggagtaaaaaatttactccgcctccta

SEQ ID NO: 1387 - DNA, 1616 bp, Secale cereale
cctcacggccgaagaagttaagcgcatcgcgtcgatcaatccctccctttcgaacatttggccatggcgctgccacggctgcgccgattgccggccacccacacaccaacaccggcgcaaacctacaagtaaaactctctccgcttgtccccacgaattaccgagcttcttttttcaggcgagccgaggttgcttcttctccacaagccttccttcggccacgtacagcagctgctaccctgatgtccgtcgcgtccgcttccgcggccgccctccggtcctcgtccggccgccgctgcggcgtcggaactggcctcaacggaggcaacaagttcctgatgatgcagaggagggacctcgtgaccaagggggtcacgttcaccgtctgctcctcgctgctcgcctcctccacctcctccgacgtcgccgctgctcaagcattggagaggctgccgttcaaggcggatgggtacaacttctggacgtggaggggccgccggatacactacgtcgagcaagggtccgggcagcccatcgtgctcatccatggcttcggcgcgtcggcttaccattggaggtacaacatcccggagctggccaagaagtacaaggtgtacgccgtggacctgctgggcttcggatggagcgagaaggcgctggtggagtacgacgccaccatctggatggagcaggtctccgacttcctcagggaggtcgtccagtcgccgtccgtcgtcgtcggcaacagcttaggtggcttcacgacgctgttcgcggcgacggaggtgccggagctggtccggggcgtggtgctgctcaactccgccggccagttcggggaccccaacgcggcgcccaaggctgaagaggcggcggcggaggaggaggtgagcgcggtgacgaggctcatcgtgaggccgctcaaggaggcgttccagcgggtcgtgctcgggttcctcttctggcaggccaggcagccggccagggtcgagaaagtcctcaaaagcgtgtacaaagatccgagcaacgtggacgactacctgatcagctcgatcacggcgccgacggccgacccgaacgccggcgaggtgtaccgcaggctcatgtcgcggttcatggcgaaccagagccagtacacgctggacaagctgctggggaagctgacgtgcccgctgctgctgctgtggggggacctggacccgtgggtcggcccggccaaggcggcgcggatccacgagttctacaccaactccaccgtcgtcaacctgcaggccgggcactgcccgcacgacgaggcgccggagcagttcaacgcggcgctgctccagtggctcgcgtcactggaggaggaggccggcgacaagccggccgagcccagcctccaggtcgtgtgattcttgtacctgtaccccaatctgacagaaggcgttcaagtgaagaagattgtgtgcttacgggacgaccgagaaaatgtgtactcagtagtactagcttacaagtggcgtttagcttgcagcaatacttgctacgtagatagggacagagtaaattgagaagtgtaagagcatctctagcctatctctagaaaggctataaatgacttttattttacccct

SEQ ID NO: 1388 - DNA, 1491 bp, Avena sativa
agcatttcctctcccgagcctgcatctttttccaggcgactaggcgagccgagctttgcttcttctccacaaccacaaggccttgggccacgtacggcagctgctcttccccgatgtccgtcgcgtccgcgtcggcggcaaccctctggtcttcgtccggccgccgctctggcgaactcaacggaggcaataggtttctgatgatgcagaggagggacgtggtgaccaaggggatcgcgctcaccgtctgctcctcgctgctcgcctcttcctcgcccaacggcgccgccgatgctcaagcattggagaggctgccgttcaaggcggacgggtacagcttctggacgtggaggggccgcaggatacactacgtcgagcaagggtccggccagcccatcgtgctcatccacggcttcggcgcctccgccttccactggaggtacaacatcccggagctggccaagaagtacaaggtgtacgccgtggacctgctggggttcgggtggagcgagaaggcgctggtggagtacgacgccaccatctggatggagcaggtctccgacttcctcagggaggtcgttcaatcgccatctgtcctcgtaggcaacagcttaggtggcttcacgacattgttcacggcgacggaggtgccggagctggtccggggcatcgtgctggtcaactccgccggccagttcggggaccccaacgcgccgcccaaggctgaacaggccgaggaggaggtgagcgcgctgacgaggctcatcctgaagccgatcaaggaggccttccagcgggtcgtgctcgggttcgtcttctggcagtccaagcagccggccagggtcgagaaagtcttgaaaagcgtgtacaaggatccgaccaatgtcgatgactacctgatcagctccatcactgcgccgacggccgaccccaacgccggcgaggtctactacaggctgatgtcgcgcttcgtggcgaaccagacccagtacacgctggacaagctgctggggaaactgtcgtgcccgctgctgctgctgtggggggacctggacccgtgggtcggcccggccaaggccgcgcggatccacgagttctacgcaaactccaccgtcgtaaacctgcaggccgggcactgcccgcacgacgaggcgccggagcaggtcaacgccgcgctgctccagtggctcgcgtcactggaggaggagaccggcgacaaaccgccggccgagcccagcctccaggccgtgtgattcttgccagttggcacccccgatcggactagtgaggatcgtgaagatgtacttataattattagtagcgtactagtggaatttagcctgttgcaatatttggtacagtacgtagatagggacagatgaaactaagaatgtatctaaattattccgctgaatttgaaagtgaatctggggccaacttgcccaagaacagccacatgtggcgtaacagagagaggcgatggcgctcgct

SEQ ID NO: 1389 - DNA, 1571 bp, Avena sativa
tttcttcttccgagcctgcatctttttccaggcgactaggcgagccgagctttgcttcttctccacaaccacaaggccttgggccacgtacggcagctgctctcccccgatgtccgtcgcgtcggcgtccgcggcaaccctacggtcttcgtccggccgccgctccggcgaactcaacggaggcaataagtttctgatgatgcagaggagggatgtcgtgaccaaggggatcgcgctcaccgtctgctcctccctgctcgccaattcctcgcccaacggcgccgccgatgctcaagcagcattggagaggctgccgttcaaggcggacgggtacagcttctggacgtggaggggccgcaggatacactacgtcgagcaagggtccggccagcccatcgtgctcatccacggcttcggcgcatccgccttccactggaggtacaacatcccggagctggccaagaagtacaaggtgtacgccgtggacctgctggggttcgggtggagcgagaaggcgctggtggagtacgacgccaccatctggatggagcaggtctccgacttcctcagggaggtcgttcagtcgccatccgtcctcgtaggcaacagcttaggtggcttcacgacattgttcacggcgacggaggtgccggagctggtccggggcatcgtgctggtcaactccgccggccagttcggggaccccaacgcgccgcccaaggctgaagaggccaaggaggaggcgagcgcggtgacgaggctcatcctgaagccgatcaaggaggccttccagcggctcgtgctggcgttcgtcttctggcagtccaagcagccggccagggtcgagaaagtcttgaaaagcgtgtacaaggatccgaccaatgtcgatgactacctgatcagctccatcactgcgccgacggccgaccccaacgccggtgaggtctactacaggctgatgtcgaggttcgtggcgaaccagacccagtacacgctggacaagctgctggggaagctgtcgtgcccgctgctgctgctgtggggggacctggacccgtgggtcggcccggccaaggccgcgcggatccacgagttctacgcaaactccaccgtcgtcaacctgcaggcagggcactgcccgcacgacgaggcgccggagcaggtcaacgccgcgctgctccagtggctcgcgtcactcgaggaggagaccggcgacaaaccgccggccgagcccagcctccaggccgtgtgattcttgccagttggcacccccgaccggaccagtgaggatcctgaagatgtacttttagcttactatagtggaatttagcctgttgcaatatttggtacagtacatagatagggacagatgaaactaagaatgtatctaaattattccgctgaatctgaaagtgaatctggggccaacttgcccaagaaacagccacatgtggcgtaacagagagaggcgatggcgctcgctcccacgacccacctacgtccgtgccggtctatcagtacttggatcaaagtaatgtgccatgttttttaagttacaaaaaaaaactaag

SEQ ID NO: 1390 - DNA, 1189 bp, Leymus cinereus x Leymus triticoides
  misc_feature (412)..(412): n is a, c, g, or t
  misc_feature (562)..(562): n is a, c, g, or t
  misc_feature (1102)..(1102): n is a, c, g, or t
agcagaaatggcggcttcctgcacgctcaccgtccctggccccttggccgccgcctcctcctcctccacttcagcccgtcgctacaggcgatttggggtggtggccatggccagcgtggggcagaaggtgtacgcgcccggcgtagccgtctccgagggcaacggcggcctaccgaagatcagcctcaaatccccgcacgggagtgaggctgagatttacctatttggagcatgcgtcacgtcttggaaggttcccaatggaaaggacctgctctttgtcagaccagatgctgtgttcaacggccagaaacccatcagtggtggaattccacattgtttcccccagtttggccccggccccatgcagcagcatggatttgccaggaatgtgaattggtctattactgattcngaagtcacggaaggagatccagctgtaactttggaactaaaagacgactcgtacagccgttcaatgtgggattttagtttccaagctttatacaaggttgcgctgcactctacaagcctgtcaacgaccctgaaaataacaaatacagangataaacctttctcattcaactcagccctccacacttatttcagtgcttccattgctggtgtttcagtgaaaggtctcaaaggtagcaagactctcaataaggatcctgaccctaaaaatcccctggagggcaaagaagaaagggacgaggtgacctttccaggatttgtggactgtgtttaccttggtgcaccgagtgagcttaccctggacaatggattgggtgacaaaattgtaatctcaaacacaaactggtcagatgcagtgttgtggaatcctcatttgcagatggaggcatgctacaaagattttgtttgtgttgaaaatgccaagattgaaacagtacaactgggtccaaaacaatcttgggtggcagagcagaaaattgaacttatctgaagctaatgggttgagaacagtacagtgcgccgcgagtatgttgtcaaagggcccttttacgtgtctggcaatgtaaacatgtgccattccccaatgtacttcaacttgtgccctcacatcagatgtacatcttaactattntatgtttataagtaaataagtacgtaattcagttcttatatgttctgctcatagttaaatcagatacagctaacatttttccaaaaa

SEQ ID NO: 1391 - DNA, 1301 bp, Triticum aestivum
aaatggcggcttcctgcacgctcaccgtccccgcccccttcgccgccgcctcctcctcctcctccacttcagcccgtcgctacaggcgattcggggtggttgccatggcgagcgcggggcagaaggtgtacgctcccggcgtggccgtctccgagggcaacggcggcctgcccaagatcagcctcaaatccccgcacgggagtgaggctgagatttatctgtttggagcatgcgtcacgtcttggaaggttcccaatggaaaggatctgctctttgtcagaccagatgctgtgttcaacggccagaaacccatcagcggtggaattccacattgttttccccagtttggccccggccccatgcagcagcatggattcgcaaggaatgtgaattggtctattactgattcagaagtcacagaaggagatccaactgtaactttggaactaaaagacgactcgtacagccgttcaatgtgggattttagtttccaagctttatacaaggttgtgctgcactctacaagcctgtcaacgaccctgaaaataataaatacagacgataaacctttctcattcaactcagccctccacacttatttcagtgcttccattgctggtgtttcagtgaaaggtctcaaaggtagcaagactctcaataaggatcctgaccctaaaaatcctctggagggcaaagaagaaagggacgaggtgacctttccaggatttgtggactgtgtttaccttggcgcaccgagtgagcttaccctcgacaatggattgggtgacaaaattgtaatctcaaacacaaactggtcagatgcagtgttgtggaatcctcatttgcagatggaggcatgctacaaagattttgtttgtgttgaaaatgcaaagattgaaacagtacaactgggtccaaaagaatcttgggtggcagagcagaaaattgaacttatctgaagctaatgggttgagaacagtacagtgcggcgagtatgttgtcaaaggacctttttatgtgtctgccaatgtaaacatgtgccattccccaatgtacttcaacttatgccctcacatgagatgtacatcttataactattttatgttttatgagtaaataagtatttcagttcttatttcccttctctgggttggtcggctatcttgtatgttctgctgatagttgaatgagacagagttaacatttttccatgtatgatgtatctagctctagacaatatattctgaatgtattgttgctctttttacagtagagaaacaagcaagggctgctcaaatttg

SEQ ID NO: 1392 - DNA, 1173 bp, Leymus cinereus x Leymus triticoides
  misc_feature (109)..(109): n is a, c, g, or t
  misc_feature (211)..(211): n is a, c, g, or t
  misc_feature (1071)..(1071): n is a, c, g, or t
gcaccaccgaagtctcggcctctccgagggccaagcagaaatggcggcttcctgcacgctcaccctccctgcccccttcgccgccgcctcctcctcctcctccacttcngcccgtcgccacaggcgattcggggtggttgccatggccagcgtggggcagaaggtgtacgcgcccggcgtcgccgtctccgagggcaacggcggcctaccnaagatcagcctcaaatccccgcacgggagtgaggctgagatttatctatttggagcatgcgtcacgtcttggaaggttcccaatggaaaggacctactctttgtcagaccagatgctgtgttcaacggccagaaacccatcagcggtggaattccacattgtttcccccagtttggccccggtcccatgcagcagcatggattcgccaggaatgtgaattggtctattactgattcagaagtcacagaaggagatccaactgtaactttggaactaaaagacgactcgtacagccgttcaatgtgggattttagtttccaagctttatacaaggttgtgctgcactctacaagcctgtcaacgaccctgaaaataataaatacagacgataaacctttctcattcaactcagccctccacacttatttcagtgcttccattgctggtgtttcagtgaaaggtctcaaaggtagcaagactctcaataaggatcctgaccctaaaaatcctctggagggcaaagaagaaagggaagaggtaacctttccaggatttgtcgactgcgtttaccttggcgcaccgagtgagcttaccctggacaatgggttgggtgacaaaattgtaatctcaaacacaaactggtcagatgcagtgttgtggaatcctcatttgcagatggaggcatgctacaaagattttgtttgtgttgaaaatgcaaagattgaaacagtacaactgggtccaaaacaatcttgggtggcagagcagaaaattgaacttatctgaagctaatgggttgagaacagtacagtgcgccgcgagtatttgtcgaaggacctttttacgtatctggaaatgtnaacatgtgtccttccccaatgtacttctacttatggcctcacatcagatggacatcttaactattttatgtcttataagtaaataaataattcagttcttat

SEQ ID NO: 1393 - DNA, 1153 bp, Pseudoroegneria spicata
gcagaaatggcggcttcctgcacgctcaccgtccccgcccccttcgccgccgcctcatcctcctcccccacttcagcccgccgctacaggcgattcggggtggttgccatggccagcgtggggcagaaggtgtacgcgcccggcgtggccgtctccgagggcgacggcggcctacccaagatcagcctcaaatccccgcacgggagtgaggctgagatttatctatttggagcatgcgtcacgtcttggaaggttcccaatggaaaggacctgctctttgtcagaccagatgcagtgttcaacggccagaaacccatcagcggtggaattccacattgtttcccccagtttggccccggccccatgcagcagcatggattcgcaaggaatgtgaactggtctattactgattcagaagtcacagaaggagatccaactgtaactttggaactaaaagacgactcgtacagccgttcaatgtgggattttagtttccaagctttatacaaggttgtgctgcactctacaagcctgtcaacgaccctgaaaataataaatacagacgataaacctttctcattcaactcagccctccacacttatttcagtgcttcaattgctggtgtttcagtgaaaggtctcaaaggtagcaagaccctcaataaggatcctgaccctaaaaatcctctggagggcaaagaagaaagggacgaggtgaccttcccaggatttgtggactgtgtttaccttggtgcaccgagtgagcttaccctggacaatggattgggtgacaaaattgtaatctcaaatacaaactggtcagatgcagtgttgtggaatcctcatttgcagatggaggcatgctacaaggattttgtttgtgttgaaaatgcaaagattgaaacagtacaactgggtccaaaagaatcttgggtggcagagcagaaaattgaacttatctgaagctaatgggttgaaaacagtacagtgcggcgagtatgtttgtcaaagggcccttttacgtgtgtggcaatgtaaacatgtgccattccccaatgtacttcaacttatggcctcacatcagatgtacatcttaactattttatgttttataagtaaataaataattcagttcttatttccaaaaaaaaaa

SEQ ID NO: 1394 - DNA, 1396 bp, Secale cereale
agaaatggcggcttcctgcacgctcaccgtccctgcccccttcgccgccgcctcctcctcctcctccacttcagcccgccgctacaggcgattcggggtggtcgccatggccagcgcggggcagaaggtgtacgcgcccggcgtggccgtctccgagggcaacggcggcctgcccaagatcagcctcaaatccccacacgggagtgaggctgagatttatctgtttggagcatgcgtcacatcttggaaggttcccaatggaaaggacctgctctttgtcagaccagatgctgtgttcaacggccagaaacccatcagcggtggaattccacattgtttcccccagtttggccccggcaccatgcagcagcatggatttgccaggaatgtgaattggtctattactgattcagaagtcacagaaggagatccaactgtaactttggaactaaaagacgaccaatacagccgttcaatgtgggattttagtttccaagctttatacaaggttgcgctgcactctacaagcctttcaacgaccctgaaaataataaatacagacgataaacctttctcgttcaactcagccctccacacctatttcagtgcttccattgctggtgtttcagtgaaaggtctcaaaggtagcaagactctcaataaggatcctgaccctaaaaatcctctggagggcaaagaagaaagggacgaggtgacctttccaggattcgtggactgtgtttaccttggcgcaccgagtgagcttaccctggacaatggattgggtgacaaaattgtaatctcaaacacaaactggtcagatgcagtgttgtggaatcctcatttacagatggaggcatgctacaaagattttgtttgtgttgaaaatgcaaagattgaaacagtacaactgggtccaaaagaatcttgggtggcagagcagaaaattgaacttgtctgaagctaatgggttgagaacagtacactgcggcgagtatgttgtcaaagagcctttttacgtgtctggcagtgtaaacatgtgtcattccccggtgtacttcaacttatgccctcacatcagatgtacatcttataactattttatgtttttataagtaaataagtaattcagttcttgtttccctctctgggttggtcggctatcttgtatgttctgctcatagttgagtgagacagggttaatatttttccatgtaagatgtatctaactctagacaatctattatgaatgtattgttgccctttttacggtaaacaaaaaaaaaaaaaaagaaaaaaaaaaagtactactagcgttagagtacctactcgctttctggtaacgagttcgaccaagggacacgtaacaacgggggtattaaggggcggtcagggg

SEQ ID NO: 1395 - DNA, 1184 bp, Secale cereale
gccaagcagaaatggcggcttcctgcacgctcaccgtccctgcccccttcgccgccgcctcctcctcctcctccacttcagcccgccgctacaggcgattcggggtggtcgccatggccagcgcggggcagaaggtgtacgcgcccggcgtggccgtctccgagggcaacggcggcctgcccaagatcagcctcaaatccccgcacgggagtgaggctgagatttatctgtttggagcatgcgtcacatcttggaaggttcccaatggaaaggacctgctctttgtcagaccagatgctgtgttcaacggccagaaacccatcagcggtggaattccacattgtttcccccagtttggccccggcaccatgcagcagcatggatttgccaggaatgtgaattggtctattactgattcagaagtcacagaaggagatccaactgtaactttggaactaaaagacgaccaatacagccgttcaatgtgggattttagtttccaagctttatacaaggttgcgctgcactctacaagcctttcaacgaccctgaaaataataaatacagacgataaacctttctcgttcaactcagccctccacacctatttcactgcttccattgctggtgtttcagtgaaaggtctcaaaggtagcaagactctcaataaggatcctgaccctaaaaatcctctggagggcaaagaagaaagggacgaggtgacctttccaggatttgtggactgtgtttaccttggtgcgccgagtgagcttaccctggacaatggattgggtgacaaaattgtaatttcaaacacaaactggtcagatgcagtgttgtggaatcctcatttgcagatggaggcatgctacaaagattttgtttgtgttgaaaatgcaaagattgaaacagtacaactgggtccaaaagaatcttgggtggcagagcagaaaattgaacttgtctgaagctaatgggttgagaacagtacactgcggcgagtatgttgtcaaagggcctttttacgtgtctggcagtgtaaacatgtgtcattccccggtgtacttcaacttatgccctcacatcagatgtacatcttataactattttatgtttttataagtaaataagtaattcagttattgtttcccttctctcggttggtcggctatcttgtatgttct

SEQ ID NO: 1396 - DNA, 1135 bp, Avena sativa
agaacaccgaagtctcagcctctccgagaggccaagcagaaatggcggcttcctgcacgctcaccgtccctgctcccttcgctgcctcctcctcctcctccagttcagctcgccgctccaggcggtttggggtggtggccatggccagcgtggggcagaaggtgtacgcgcccggcgtggcggtctctgagggaaacggcgggctgccgaagatcagcctcaagtccccgcaggggagtgaggctgagatttatctatttggaggatgcgtcacttcttggaaggtcccaagtggaaaggacctgctctttgtcagaccagatgctgtgttcaatggtcagaaacccatcagcggtggaattccacattgtttcccccagtttggccctggcgccattcagcagcatggatttgcaaggaacgtgaattggtctttcactgattcagaagtcaccgaaggagatccggctgtaaccttggaactaaaagacaattcctacagccgttcaatgtgggattttagtttccaagctttatacaaggttgtgctgcactctacaagcctgtcaacaaccctgacaataacaaataccgatgataaacctttctcgttcaactcagcactccatacttatttcagtgcttccatcgctggcgtttcagtgaaaggtcttaaaggtagtaagactctcaataaggatcccgatcctaaaaatcctattgaaggcaaagaagaaagggacgaggtaacctttccaggatttgtcgactgcgtttaccttggcgcaccgagtgagcttaccctggacaatggattgggtgacaaaattgtcatctcaaatacaaactggtcagatgcagtgttgtggaatcctcacttgcagatggaagcatgctacaaagattttgtctgtgtcgaaaatgcaaagattgaaacagtacaactgggtcctaaagaatcttgggtggcaaagcagaaaattgaactaatctgaagctaatcagtgcaaaagaatacgatgcggcgaaagggcctttttttactttctggcaatgtgaacatatgccacacccaatgtacttggttcaacttatgccatcacatcagatgtttataagtaaatcaataaattta

SEQ ID NO: 1397 - DNA, 1350 bp, Triticum aestivum
caaatggcggcttcctgcacgctcaccgtccccgcccccttcgccgccgcctcctcctcctcctccacagcccgtcggtacaggcgattcggggtggttgccatggccagcgtggggcagaaggtgtacgcgcccggcgtggccgtctccgacggcaacggcggcctgcccaagatcagcctcaaatccccgcacgggagtgaggctgagatttatctatttggagcatgtgtcacatcttggaaggttcccagtggaaaggacctgctctttgtcagaccagatgccgtgttcaatggccagaaacccatcagcggtggaattccacattgtttcccccagtttggccccggtcccatgcagcagcatggatttgccaggaatgtgaattggtctattactgattcagaagtcacagaaggagatccaactgtaactttggaactaaaagacgactcgtacagccgttcaatgtgggattttagtttccaagctttatacaaggttgtgctgcactctacaagcctgtcaacgaccctgaaaataataaatacagacgataaacctttctcgttcaactcagccctccacacttatttcagtgcttccatcgctggtgtttcagtgaaaggtctcaaaggtagcaagactctcaataaggatcctgatcctaaaaatcctctggagggcaaagaagaaagggacgaggtgacctttccaggatttgtggactgtgtttaccttggcgcaccgactgagcttacactggacaatggattgggtgacaaaattgtaatctcaaacacaaactggtcagatgcagtgttgtggaatcctcatttgcagatggaggcatgctacaaagactttgtttgtgttgaaaatgcaaagattgaaacagtacaactgggtccaaaagaatcttgggtggcagagcagaaaattgaacttgtctgaagctaatgggttgagaacagtacagtgcggcgacgtcaaagggcccttttacgtgtctggcagtgtaaacatgtgtcattccccggtgtacttcaacttatgccctcacatcagatgtacatcttataactattttatgttttataagtaaataagtaattcagttcttatttcctttctctgtggtggtcggctatcttgtaagtatgttctgctcatagttgaatgagacagggttaacatttttccatgtaagatgtatctagctgtagacaatatattctgagtgtattgttgctctttttacggtagagaaacaagcaagggctgctcaaatttgggataaatcagatttgttcatagtaatctccctgattcaaagaacagtaatca

SEQ ID NO: 1398 - DNA, 1372 bp, Hordeum vulgare
gccactctaaaaccaaacagagaaccaccgaagtctcagcctctccgagaggccaagcagaaatggcggcttcctgcacgctcaccgtccctggccccttcgccgccgcctcctccacttcagcccgtcgccacaggcgattcggggtggttgccatggccagcgcggggcagaaggtgtacgcgaccggcgtggccgtctccgagggcaacggcggcctgcccaagatcagcctcaaatccccgcacgggagtgaggctgagatttatctatttggagcatgcgttacgtcttggaaggttcccagtggaaaggacctgctctttgtcagaccagatgctgtgttcaacggccagaaacccatcagcggtggaattccacattgtttcccccagtttggccccggccctatgcagcagcatggatttgcgaggaatgtgaattggtctattactgattcagaagtcacagaaggagatccaactgtaactttggaactaaaagatgactcgtacagccgtgcaatgtgggattttagtttccaagctttatacaaggttgccctgcactctacaagcctgtcaacgaccctgacaataataaatacagacgacaaacctttctcattcaactcagccctccacacttatttcagtgcttccattgccggtgtatcagtgaaaggtctcaaaggtagcaagactctcaataaggatcctgaccctaagaatcctctggagggcaaagaagaaagggacgaggtgacctttccaggatttgtggactgtgtttaccttggcgcaccgagtgagcttaccctggacaatggattgggtgacaaaattgtgatatcaaacacaaactggtcagatgcagtgttgtggaatcctcatttgcagatggaggcatgctacaaagattttgtttgtgttgaaaatgcaaagattgaaacagtacagctgggtccaaaagaatcttgggtggcagagcagaaaattgaacttgtctgaagctaatgagttgagaacagtacagtgcgtcgcgagtatattatcaaaggacagagatcagtcgcgagtatattatcaaaggacagagatcaggtgaccgtgtgccttgcggccttttacgtgtttggcaatgtaaacatgtgtcattccccagtatacttcaacttatgctctcacatcagatgtacatcttaactatcttatgtttatgagtaaataaataatttagttcttatttcccttctctgggttggctggctatcttgtatgttctgctcatagatgaatgagacacagttaacatttttccatgtatgatgtatctatctctagacaatatattctggatgtattgttgcttt

SEQ ID NO: 1399 - DNA, 1308 bp, Hordeum vulgare
ggcggcttcctgcacgctcaccgtccctggccccttcgccgccgcctcctccacttcagcccgtcgccacaggcgattcggggtggttgccatggccagcgcggggcagaaggtgtacgcgaccggcgtggccgtctccgagggcaacggcggcctgcccaagatcagcctcaaatccccgcacgggagtgaggctgagatttatctatttggagcatgcgttacgtcttggaaggttcccagtggaaaggacctgctctttgtcagaccagatgctgtgttcaacggccagaaacccatcagcggtggaattccacattgtttcccccagtttggccccggccctatgcagcagcatggatttgcgaggaatgtgaattggtctattactgattcagaagtcacagaaggagatccaactgtaactttggaactaaaagatgactcgtacagccgtgcaatgtgggattttagtttccaagctttatacaaggttgccctgcactctacaagcctgtcaacgaccctgacaataataaatacagacgacaaacctttctcattcaactcagccctccacacttatttcagtgcttccattgccggtgtatcagtgaaaggtctcaaaggtagcaagactctcaataaggatcctgaccctaagaatcctctggagggcaaagaagaaagggacgaggtgacctttccaggatttgtggactgtgtttaccttggcgcaccgagtgagcttaccctggacaatggattgggtgacaaaattgtgatatcaaacacaaactggtcagatgcagtgttgtggaatcctcatttgcagatggaggcatgctacaaagattttgtttgtgttgaaaatgcaaagattgaaacagtacagctgggtccaaaagaatcttgggtggcagagcagaaaattgaacttgtctgaagctaatgagttgagaacagtacagtgcgtcgcgagtatattatcaaaggacagagatcagtcgcgagtatattatcaaaggacagagatcaggtgaccgtgtgccttgcggccttttacgtgtttggcaatgtaaacatgtgtcattccccagtatacttcaacttatgctctcacatcagatgtacatcttaactatcttatgtttatgagtaaataaataatttagttcttatttcccttctctgggttggctggctatcttgtatgttctgctcatagatgaatgagacacagttaacatttttccatgtatgatgtatctatctctagacaatatattctggatgtattgttgcttt

SEQ ID NO: 1400 - DNA, 1444 bp, Festuca arundinacea
  misc_feature (790)..(790): n is a, c, g, or t
ggcacgagggaacaccgaagtctcagcctctccgagaggccaagcagaaatggcggcttcctgcatgttcgccgtctctgctcccttcgccgcctcctcctcctccaattcagctcgccgctccaggcgattcggggtggtggccatggccagcgtggggcagaaggtgtacgcgccgggcgtggcggtatcagagggaaacggcgggctgccgaagatcagcctcaaatctccgcaggggagtgaggctgagatttatctctttggaggatgcgtcacttcttggaaggttcccagtggaaaggacctgctctttgtcagaccagatgctgtgttcaacggtcagaaacccatcagcggtggaattccacattgtttcccccagtttgggcctggcgcaattcagcagcacggatttgcaaggaatgtgaattggtctatcactgattcagaagtcaccgaaggagatccagctgtaaccttggaactaaaagacgactcatacagccgttcaatgtgggattttagtttccatgctttatacaaggttacattgcattctacaagcctgtcaacaaccctgacaataattaatactgacgataaacctttttcgttcaactcagcactccatacttatttcagtgcttccattgctggcgtttcagtgaaaggtcttaaaggtagtaagactctcaataaggatcctgaccctaaaaatcctctggagggtaaagaagaaagggaagaggtgacctttccaggatttgtcgactgtgtttaccttggngcaccgagtgagcttaccctggacaatggattgggtgacaaaattgtcatctcaaatacgaattggtcagatgcagtgttgtggaatcctcacttgcagatggaagcatgttacaaagattttgtctgtgtcgaaaatgcaaagattgaaacagtacaactgggtcctaaagaatcttgggtggcagagcagaaaattgagttaatctgaagctaatcagtggaaaagaatacacggagaaagggccttttttttactttctggcaatgtgaacatatgccacccacaatgtgcttagcatgtactcccaaaatcatgacccaagaagcgcacgcccaggataacgacgcctttaaccagggattagcaagcctctaagccccgctcacctgcagaagctcgaggaggaggctgcctcgccgcggcgcgcggggctgggtcccaggtgtcgctgatgtcaggtccaagaaggcgggtgctactgctcctccgccgccgcgtcctcaccttatcctcctccgctgccgctgtagcctcgtggagacctcgcgcagcacgatggagcaaggaggtgacaggcagggtggagcgtcgtctagtggcggcgagcaaggccacggcggcgccgcccatctccgtcgaagcgctttgtcc

SEQ ID NO: 1401 - DNA, 1282 bp, Oryza sativa
caagacgcctgccactctaaactaggcaaaacacctccgaagtctcagctcagcttctcccctcctcaaccaagcagaaatggcggcttcttgcgcgctcaccctcccctccgccatctccgtctctgtctccgtctcctccaattcacctcgacggttcaggcgctctaggagggtggtggccatggccagcgtggggcagaaggtgtacgcgcccggcgtggcggtctccgagggcaatggcgggctgccaaagatcgacctcaagtccccgcatgggagtgaggctgaaatttatctatttggagcctgcgtaacatcttggaaagtccccagtggaaaagacctcctatttgtcagaccagatgcggtgttcaacggccagaaacccatcagtggtggaatcccacattgcttcccccaattcggtcctggtaccatgcagcagcatggatttgcaaggaacatgaattggtctatcactgattcagaagctaatgaaggagatccagctgtaactttggaactaaaagatgactcttatagccgttcaatgtgggattttagcttccaagctctgtataaggttgcattgcactctacaagcctgtcaacaacactgaaaataacaaatacagacgataagcctttttcatttaactcggcactccacagctatttcagtgcttcaatttctggtgtttcagtgaaaggtctcaaaggttgtaagaccctaaataaggatcccgatcccaaaaaccctttggaggggaaagaagagagggaagaggtgacttttccaggatttgtcgattgcatttaccttggtgcaccgagtgagctcaccctggacaatggattgggtgacaaaattgtgatatcaaatgcgaattggtcagatgcagtgctgtggaatcctcacttgcagatggaggcttgttacaaagattttgtctgtgttgaaaatgcaaagattgaaacattacaactggggccgaaccaatcttgggtggcagagcagaaaattgaactgatatgaattatgaagctaaactgggcaaaacaatagagtacaacaattatgttgcaaaaatgaacttctctttttctttacatcatgaaatgcaaatgtcatagcccctaatgtatcatctagtaggtggcataagtcatatttttgaaattgttttatgtaataaataagtaaataaataaattcagttctcccattatttcatcctctcctttttattaatgagcggcctgctaagttttaagtttc

SEQ ID NO: 1402 - DNA, 1209 bp, Oryza sativa
aggcaaaacacctccgaagtctcagctcagcttctcccctcctcaaccaagcagaaatggcggcttcttgcgcgctcaccctcccctccgccatctccgtctctgtctccgtctcctccaattcacctcgacggttcaggcgctctaggagggtggtggccatggccagcgtggggcagaaggtgtacgcgcccggcgtggcggtctccgagggcaatggcgggctgccaaagatcgacctcaagtccccgcatgggagtgaggctgaaatttatctatttggagcctgcgtaacatcttggaaagtccccagtggaaaagacctcctatttgtcagaccagatgcggtgttcaacggccagaaacccatcagtggtggaatcccacattgcttcccccaattcggtcctggtaccatgcagcagcatggatttgcaaggaacatgaattggtctatcactgattcagaagctaatgaaggagatccagctgtaactttggaactaaaagatgactcttatagccgttcaatgtgggattttagcttccaagctctgtataaggttgcattgcactctacaagcctgtcaacaacactgaaaataacaaatacagacgataagcctttttcatttaactcggcactccacagctatttcagtgcttcaatttctggtgtttcagtgaaaggtctcaaaggttgtaagaccctaaataaggatcccgatcccaaaaaccctttggaggggaaagaagagagggaagaggtgacttttccaggatttgtcgattgcatttaccttggtgcaccgagtgagctcaccctggacaatggattgggtgacaaaattgtgatatcaaatgcgaattggtcagatgcagtgctgtggaatcctcacttgcagatggaggcttgttacaaagattttgtctgtgttgaaaatgcaaagattgaaacattacaactggggccgaaccaatcttgggtggcagagcagaaaattgaactgatatgaattatgaagctaaactgggcaaaacaatagagtacaacaattatgttgcaaaaatgaacttctctttttctttacatcatgaaatgcaaatgtcatagcccctaatgtatcatctagtaggtggcataagtcatatttttgaaattgttttatgtaataaataagtaaataaataaattcagttctcccatta

SEQ ID NO: 1403 - DNA, 1358 bp, Zea mays
ggtgcacacataaaacatcacagcacgcatcactatagctcagaagatccggtccattttccagctctaaaactaaggcatagcggtaaacaccaccgaagtctcagcttctccgaggaaggggagcaattgttgaagcagccacttcaccttggggccatacagaaatggcggcttcttgcgcctccacactccctccactttccttcgtttcctcctccagttcaccccgccgattcaggcgctctggtgtggtggccatggccagcgttgggcagaaggtgtatgcgcccggtgtggcggtgtcggagggcaatggcgggctgccgaaaatcgacctcaaatccccgcacgggagcgaggctgagatttatctgtttggagcgtgtgttacttctttcaaagtccctaatggcaaggacctgctctttgttcgaccagatgctgtgtttaatggacagaaacccatcagcggtggaattccacattgtttcccccagtttggcccaggtcccatgcagcagcatgggtttgcacggaatgtgaattggtctatcacagattcagaagtcacagaaggagatccagctgtaactttggaactgaaagatgacacttatagccgttctatgtgggatttcagcttccatgcactgtacaaggtttccctgcactctaaaagcttgtcaacaactctagcaataataaatacagatgacaagcctttctcattcaactcagccctccacacttatttcagtgcttccataactggcgtttctgtgaaaggtctaaaaggttgcaagactctcaataaggaccctgacccgaaaaatcctttggagggcaaagaagagagggaagaggtgacttttccaggattcgtcgactgcgtctaccttggtgcaccaagtgaactcatcctggacaatggattgggtgacaaaattgccattgcaaattcaaattggtcagatgcagtcttgtggaatcctcacttgcagatggaggcctgctacaaagattttgtctgtgtggaaaacgccaagattgaaatggtacaactggagccaaaacaatcttgggtggcagaacagaaaattgaactagtctgatgataatgtcttgcagcaactgcatcaagtagagtgagacgcaaatggcgctcccccagtgtcattcttcatggcacatgtcatcacaataactatacatgtgatgttttctgttaaaaagaataaatgatgcaaatcatgaatttttttctagcagtctgatgtgtactgaattgcaaatgtacaatttgaactgcatggatctgttgaaataaagggagtgcccatttgatctttgacata

SEQ ID NO: 1404 - DNA, 1362 bp, Sorghum bicolor
ggtagcacacataaaagagcacgcagacttgaagctcagaagatccggtgcattttccaactctaaactaggcaaacaccagcgaagtctcagcttctccgaggaagggggcgcaattgctcaagcagcagcttcacttggggccaaacagaaatggcggcttcttgcgcctccaccctcccttcgctctccttcgtttcctcctcttccagttcatcccgccgattcaggcgctctggtgtggtggccatggccagcgttgggcagaaggtgtatgcgcccggtgtggcggtgtcggagggcaatggcgggctccagaaaatcgacctcaaatccccgcacgggagcgaggctgagatttatctgtttggagcatgtgttacttctttcaaagtccctaatggcaaggacctgctctttgttcgaccagatgctgtgtttaacgggcagaaacccatcagtggtggaattccacattgtttcccccagtttggcccaggtcctatgcagcagcatggatttgcacggaatgtgaattggtctatcacagattcagaagtcatggaaggagatccaactgtaactttggaactgaaagatgactcttatagtcgttctatgtgggatttcagcttccatgcactgtacaaggtttccctgcactctacaagcttgtcaacaactctagaaataataaatacggatgtcaagcctttctcattcaactcagcactccacacttatttctctgcttccatagctggtgtttctgtgaaaggtctaaaaggttgcaaaactctcaataaggatcctgacccgaaaaatcctttggagggcaaagaagagagggaagaggtgacttttccaggattcgttgactgcatctaccttggtgcaccaagtgagctcatcctggacaatggattgggtgacaaaattgccatcgcaaattcaaattggtcagatgcagtcttgtggaatcctcacttgcagatggaggcctgctacaaagattttgtctgtgtggaaaacgccaagattgaaatggtacaactggagccaaaacaatcttgggtggcagaacagaaaattgaactagtctgaagaccttgcagcaattgcatcaagtagagtgagatgcaaatggtgctcccccaatgtaactcttcatggcagtgtcatcacaatagctatacatgtgatgttttctgctaataaaaagaataaatgatgcaaatcatggtttttttgccgcagtctcttgatgtgtactgaattgcaaatgtataatttgaactgcatggactctgttgaaatggaagggagtgcccattttgattttcgacatacggagtatctgat

SEQ ID NO: 1405 - DNA, 1378 bp, Sorghum bicolor
atggtagcacacataaaagagcacgcagacttgaagctcagaagatccggtgcattttccaactctaaactaggcaaacaccagcgaagtctcagcttctccgaggaagggggcgcaattgctcaagcagcagcttcacttggggccaaacagaaatggcggcttcttgcgcctccaccctcccttcgctctccttcgtttcctcctcttccagttcatcccgccgattcaggcgctctggtgtggtggccatggccagcgttgggcagaaggtgtatgcgcccggtgtggcggtgtcggagggcaatggcgggctccagaaaatcgacctcaaatccccgcacgggagcgaggctgagatttatctgtttggagcatgtgttacttctttcaaagtccctaatggcaaggacctgctctttgttcgaccagatgctgtgtttaacgggcagaaacccatcagtggtggaattccacattgtttcccccagtttggcccaggtcctatgcagcagcatggatttgcacggaatgtgaattggtctatcacagattcagaagtcatggaaggagatccaactgtaactttggaactgaaagatgactcttatagtcgttctatgtgggatttcagcttccatgcactgtacaaggtttccctgcactctacaagcttgtcaacaactctagaaataataaatacggatgtcaagcctttctcattcaactcagcactccacacttatttctctgcttccatagctggtgtttctgtgaaaggtctaaaaggttgcaaaactctcaataaggatcctgacccgaaaaatcctttggagggcaaagaagagagggaagaggtgacttttccaggattcgttgactgcatctaccttggtgcaccaagtgagctcatcctggacaatggattgggtgacaaaattgccatcgcaaattcaaattggtcagatgcagtcttgtggaatcctcacttgcagatggaggcctgctacaaagattttgtctgtgtggaaaacgccaagattgaaatggtacaactggagccaaaacaatcttgggtggcagaacagaaaattgaactagtctgaagaccttgcagcaattgcatcaagtagagtgagatgcaaatggtgctcccccaatgtaactcttcatggcagtgtcatcacaatagctatacatgtgatgttttctgctaataaaaagaataaatgatgcaaatcatggtttttttgccgcagtctcttgatgtgtactgaattgcaaatgtataatttgaactgcatggactctgttgaaatggaagggagtgcccattttgattttcgacatacggagtatctgatatcttttgcttctg

SEQ ID NO: 1406 - DNA, 1321 bp, Panicum virgatum
ggcaaaaacaccaccggagtctcagctgctccgaggaaggggcgcacgcacaggcatcgcatctccagctttggggccagacaaatggcggcttcctgcgcctccaccctcccttcactctccttcgtctcctcctcctcttccaattcacctcggcggttcaggcgctctagggtggtggccatggccagcgtggggcagaaggtctacgcgcccggcgtggcggtgtcggagggcaatggcggactgccgaaaatcgacctcaaatccccgcatggaagcgaggctgagatctatctgtttggagcatgcgttacatctttcaaagtccctaatggcaaggacttgctctttgttcgaccagatgcagtgttcaatgggcagaaacccataagtggcggaattccacattgtttcccccagtttggcccaggtcccatgcagcagcatgggtttgcacggaatgtgaattggtccatcgcagattcagaagtcaccgaaggagatccggctgtaactttggaacttaaagatgactcttatagccgttctatgtgggattttagcttccaagcattgtacaaggtttccctgcactctacaagcttgtcaacaactctaaaaataacaaatatggatgacaagcctttctcattcaactcagcactccacacttacttccgtgcttccatagctggcgtttctgtgaaaggtctgaaaggttgtaagactctcaataaagatcttgacccgaaaaatcctttggagggcaaagaagagagggaggaggtgacttttccaggatttgttgactgcatctaccttggtgcaccgagtcagctcatcctggacaatggattgggtgacaaaattgccatatcaaattcaagttggtcagatgcagtgttgtggaatcctcaccagcagatggaggcctgttacaaagattttgtctgtgtggaaaacgcaaagattgaaacagtacaactggagccgaaacaatcttgggtggcagagcagaaaattgaactagtctgaagataatgccttgctgcaactgcatcaagcagtgagataattcttcatggcacatgtcatcacaatagctgtgcacccaaattatccaatgtttcatgtaaaagggaataagtgatgctgatcaggatgttttttttttggcagtatgatgtttactgcgttgcaaatgtacaattcaaactacacggactctgttgaaatggaagcgagtgcccatattaatctttgataaatcatctgctactgaaatatgttatctatttggtggctaagcattgtgctt

SEQ ID NO: 1407 - DNA, 1858 bp, Setaria italica
ctccgtagaagatcctgtgcattttccactctaaactaggcaaaaacaccaccgaagtctcagcttctccgaggaaggggcgcacaggcatcttcacctttggggccaaacagaaatggcggcttcttgcgcctccacgctcccttcactctccttcgtctccaactcctattgcaattcacctcggcggttcaggcgctctgcagtggtggccatggccagcgtggggcagaaggtgtacgcgcccggcgtggcggtgtcggagggcaatggcgggctccagaaaatcgatctcaaatccccgcacggaagcgagactgagatctatctgttcggagcatgcgttacttctttcaaagtccctaatggcaaggacctgctgtttgttcgaccagatgcagtgttcaatgggcagaaacccatcagtggaggaattccacattgtttcccccagtttggcccaggtcccatgcagcagcatgggtttgcacggaatgtgaattggtctatcacagattcagaagtcaccgaaggagatccagctgtaactttggaactgaaagatgactcttatagccgttctatgtgggattttagcttccaagcattatataaggtttccctgcactctacaagcttgtcaacaactctaaaaataacaaatacggatgacaagcctttctcattcaactcagcactccacacttatttccgtgcttccataactggcgtttctgtgaaaggtctgaaaggttgcaagactctcaataaggatcctgacccgaaaaatcctttggagggcaaagaagagagggaagaggtgacctttccaggattcgttgactgcatctaccttggtgcaccaagtgagctcatcctggacaatggattgggtgacaaaattgccatctcaaattcaaattggtcagatgcagtgttgtggaatcctcacttgcagatggaggcctgctacaaagattttgtctgtgtggaaaacgcaaagattgaaacagtacaactggagccgaaacaatcctgggtggcagagcagaaacttgaactactctgaagataatatcttgctgcaactgcatcaagcagtatgagatgcaaatggcattcccccaatgaaattcttcatgcatatgtcatcacaatagctatacatctgatgttttctgttaaaagaataaatgatgcaaatcatgatgttttctggcagtatgatgattactgcgttgcaaatgcacaattcgaactacacgggctccgttgaaatggaagggagtgcccattttgatctttgacacgccttctgccactgaaacatgtttttttttctgtttgctggttaagcattgtgattaatcatgtgattttgtcgatgaggcatggaaaccaatatggtgtgtcaggcctatttctgaaaagcaacgaggaaccgtccatgtgcgttaaagttgagttcttgcttttgtgttgctgttgtcgatgaacaaaagatattatgtgtacaatgctaagcatacaatatttattgagcaaaaatatggtacatcccggccctcatacaactaaaattacagttgtgaaaatatggcaaccaaactgaaggaggaaaggaaaagatgaactaatttacaaaggataggcatgacaaaattacagttcagcgggttcagtcacttaggccataaacccgttttgctgaatcaagtgtgttgctgagaagcattgcaatcgtcactggtccaactccaccaggaaccggagttatagcagaggccaccttcacagcttcttcaaagcagacatctccggttaggcgataaccataatcactggttggatcctgaaa

SEQ ID NO: 1408 - DNA, 1214 bp, Saccharum officinarum
aggaagggggcgcaattgctcaagcagcaacttcacttggggccaaacagaaatggcggcttcttgcgcctccaccctcccttcgcttcccttcgtttcctcctcttccagttcatcccaccgattcaggcgctctggtgtggtagccatggccagcgttgggcagaaggtgtatgcgcccggtgtggcggtgtcggagggcaatggcgggctgcagaaaattgacctcaaatccccgcacgggagcgaggctgagatttatctgtttggagcatgtgttacttctttcaaagtccctaatggcaaggacctgctctttgttcgaccagatgctgtgtttaatgggcagaaacccatcagtggtggaattccacattgtttcccccagtttggcccaggtcccatgcagcagcatgggtttgcacggaatgtgaattggtctatcacagattcagaactcacggaaggagatccagctgtaactttggaactgaaagatgactcttatagccgttctatgtgggatttcagcttccatgcactgtacaaggtttccctgcactctacaagcttgtcaacaactctagaaataataaatacggatgtcaagcctttctcattcaactcagcactccacacttatttctctgcttccataactggcgtttctgtgaaaggtctaaaaggttgcaagactctcaataaggatcctgacccgaaaaatcctttggagggcaaagaagagagggaagaggtgacttttccaggattcattgactgcatctaccttggtgcaccaagtgagctcatcctggacaatggattgggtgacaaaattgccatcacaaattcaaattggtcagatgcagtcttgtggaatcctcacttgcagatggaggcctgctacaaagattttgtctgtgtggaaaacgccaagattgaaacggtacaattggagccaaaacaatcttgggtggcagaacagaaaattgaactagtctgaagataatttcttgcagcaattgcatcaagtagagtgagatgcacatggtgctcccccaatgtaattcttcattggacgtgtcatcacaatacctatacatgtgagttccttgttaaaaagaataaatgatgcaaaatcatgttttttcctcgagtctgatgtatactgaattgcaatgtacactttgaaactggtggactctgttgaaaat

SEQ ID NO: 1409 - DNA, 1248 bp, Pennisetum glaucum
gcccggcgtagcagtatcggagggcaggggggcacaggcatcttcacctttggggccaaacagaaatggcggcttcctgcgcctccaccgtcccttcactctccttcgtctccacctactcttccaattcacctcggcggttcaggcgctccgcggtggtggccatggctagcgtggggcagaaggtgtacgcgcccggcgtagcagtatcggagggcaatggcgggctgcagaaagttgatctcaaatccccgcacggaagcgaggccgagatctatctgttcggagcatgcgttacttctttcaaagtccctaatggcaaggacctgctgtttgttcgaccagatgcagtgttcaatgggcagaaacccatcagtggcggaattccacattgtttcccccagtttggcccaggtcccatgcagcagcatgggtttgcacggaatgtgaattggtctatcacagattcagaagtcaccgaaggagatccagctgtaactttggaactgaaagatgactcttatagccgttcaatgtgggattttaccttccaagcattatataaggtttccctgcactctacaagcttgtcaacaactctaaaaataacaaatacagatgacaagcctttctcattcaattcagcactccacacatatttccgtgcttccataactggcgtttctgtgaaaggtctgagaggttgcaagactctcaataaggatcctgacccgaacaatcctttggagggcaaagaagaaagggaagaggtgacctttccaggattcgttgactgcatctaccttggtgcaccaactgagctcatcctggacaatggtttgggtgacaaaattgtcatctcaaattcaagttggtcagatgcagtgttgtggaatcctcacttacagatggaggcttgttacaaagattttgtctgcgtggaaaacgcaaagattgaaacagtacaactggagccgaaacaatcctgggtagcagagcagaaaattgaactactctgaagataatcaagcagtatgagatgcaaatggcgttcccccaatgcaattcttcatggcatatgtcatcagtcatcacaatagctgtacatctgatgctttctgttaaaagaataaatgatgcaaatcatgatgttttctggcagtatgatgaatatgattactgtgttgcaaatgcacaattacaatttgaactacacaggctcagggacacttgaaatggaagggagtg

SEQ ID NO: 1410 - DNA, 918 bp, Triticum aestivum
tcttccgagaggccaagcagaaatggcggcttcctgcacgctcaccgtccccgcccccttcgccgccgcctcctcctcctcctccacttcagcccgtcggtacaggcgattcggggtggttgccatggccagcgtggggcagaaggtgtacgcgcccggcgtggccgtctccgacggcaacggcggcctgcccaagatcagcctcaaatccccgcacgggagtgaggctgagatttatctatttggagcatgcgtcacatcttggaaggttcccagtggaaaggacctgctctttgtcagaccagatgctgtgttcaacggccagaaacccatcagcggtggaattccacattgttcccccagtttggccccggtcccatgcagcagcatggattcgcaaggaatgtgaattggtctattactgattcagaagtcacagaaggagatccaactgtaactttggaactaaaagacgactcgtacagccgttcaatgtgggattttagtttccaagctttatacaaggttgtgctgcactctacaagcctgtcaacgaccctgaaaataataaatacagacgataaacctttctcgttcaactcagccctccacacttatttcagtgcttccatcgctggtgtttcagtgaaaggtctcaaaggtagcaagactctcaataaggatcctgatcctaaaaatcctctggagggcaaagaagaaagggacgaggtgacctttccaggatttgtggactgtgtttaccttggcgcaccgactgagcttaccctggacaatggattgggtgacaaaattgtaatctcaaacacaaactggtcagatgcagtgttgtggaatcctcatttgcagatggaggcatgctacaaagactttgtttgtgttgaaaatgcaaagattgaa

SEQ ID NO: 1411 - DNA, 1233 bp, Secale cereale
  misc_feature (39)..(39): n is a, c, g, or t
  misc_feature (212)..(212): n is a, c, g, or t
  misc_feature (444)..(444): n is a, c, g, or t
  misc_feature (448)..(448): n is a, c, g, or t
  misc_feature (664)..(664): n is a, c, g, or t
  misc_feature (740)..(740): n is a, c, g, or t
  misc_feature (746)..(746): n is a, c, g, or t
  misc_feature (1109)..(1109): n is a, c, g, or t
  misc_feature (1112)..(1112): n is a, c, g, or t
  misc_feature (1118)..(1118): n is a, c, g, or t
  misc_feature (1120)..(1120): n is a, c, g, or t
  misc_feature (1131)..(1131): n is a, c, g, or t
  misc_feature (1196)..(1196): n is a, c, g, or t
  misc_feature (1198)..(1198): n is a, c, g, or t
accgaagtctcagcctctccgagaggccaagcagaaatngcggcttcctgcacgctcaccgtccctgcccccttcgccgccgcctcctcctcctcctccacttcagcccgccgctacaggcgattcggggtggtcgccatggccagcgcggggcagaaggtgtacgcgcccggcgtggccgtctccgagggcaacggcggcctgcccaagancagcctcaaatccccgcacgggagtgaggctgagatttatctgtttggagcatgcgtcacatcttggaaggttcccaatggaaaggacctgctctttgtcagaccagatgctgtgttcaacggccagaaacccatcagcggtggaattccacattgtttcccccagtttggccccggcaccatgcagcagcatggatttgccaggaatgtgaattggtctattactgattcncccntcacagaaggagatccaactgtaactttggaactaaaagacgaccaatacagccgttcaatgtgggattttagtttccaagctttatacaaggttgcgctgcactctacaagcctttcaacgaccctgaaaataataaatacagacgataaacctttctcgttcaactcagccctccacacctatttcactgcttccattgctggtgtttcagtgnaaggtctcaaaggtagcaagactctcaataaggatcctgaccctaaaaatcctctggagggcaaagaagaaagggngggggngacctttccaggatttgtggactgtgtttaccttggtgcgccgagtgagcttaccctggacaatggattgggtgacaaaattgtaatttcaaacacaaactggtcagatgcagtgttgtggaatcctcatttgcagatggaggcatgctacaaagattttgtttgtgttgaaaatgcaaagattgaaacagtacaactgggtccaaaagaatcttgggtggcagagcagaaaattgaacttgtctgaagctaatgggttgagaacagtacagtgcggcgaatatgttgtcaaagggcctttttacgtgtctggcagtgtaaacatgtgtcattccccggtgtacttcaacttatgccctcacntcngatgtncntcttataactnttttatgtttttataagtaaataagtaattcagttcttatttcccttctctgggttggccggctntnttgtatgttcgcattttagttgaatgagatatttt

SEQ ID NO: 1412 - DNA, 1121 bp, Panicum virgatum
ttccaattcacctcggcggttcaggcgctctagggtggtggccatggccagcgtggggcagaaggtgtacgcgcccggcatggcggtgtcggagggcaatggcggactgccaaaaatcaatctcaaatccccgcatggaagcgaggctgagatctatctgttcggagcatgtgttacttctttcaaagtccctaatggcaaggacctactctttgttcgaccagatgcagtgttcaataggcagaaacccatcagtggcggaattccacattgtttcccccagtttggcccaggtcccatgcagcagcatgggtttgcacggaatgtgaattggtccatcgcagattcagaagtcaccgaaggagatccagctgtaattttggaacttaaagatgactcttatagtcgttctatgtgggattttagctttcaagcattgtacaaggtttccctgcactctaaaagcttgtcaacaactctaaaaataacaaatatggatgacaagcctttctcattcaactcagcactccacacttatttccgtgcttccataactggcgtttctgtgaaaggtctgaaaggttgtaagactctcaataaggatcctgacccgaaaaatcctttggagggcaaagaagagagggaggaggtgacttttccaggatttgttgactgcatctaccttggtgcaccgggtgagctcatcctggacaatggattgggtgacaaaattgccatctcaaattcaagttggtcagatgcagtgttgtggaatcctcacttgcagatggaggcctgttacaaagattttgtttgtgtcgaaaacgcaaagattgaaacagtacaactggagccgaaacaattttgggtggcagagcagaaaattgaactgatttgaagataatgccttgctgcaactgcatcaagcagtgagatacaaatggcattccccccaatggaatttttcatggcacatgtcatcacaatagttgtgcacccaagttatccaatatttcctgtaaaaaggaataagtgatgcaaatcaggatgcttttttggcagtatgatgtttactgcgttgcaaatgtacaattcaaactacacggactctgttgaaatgg

SEQ ID NO: 1413 - DNA, 1166 bp, Secale cereale
gcgagcgtggggcagatggtgtacgcgcccggcgtggccgtctccgagggcaacggcggcctgcccaagatcagcctcaaatccccgcacgggagtgaggctgagatttatctgtttggagcatgcgtcacatcttggaaggttcccaatggaaaggacctgctctttgtcagaccagatgctgtgttcaacggccagaaacccatcagcggtggaattccacattgtttcccccagtttggccccggcaccatgcagcagcatggatttgccaggaatgtgaattggtctattactgattcagaagtcgcagaaggggatccaactgtaactttggaactaaaagacgactcatacagccgttcaatgtgggattttagtttccaagctttatacaaggttgcgctgcactctacaagcctttcaacgaccctgaaaataataaatacagacgataaacctttctcgttcaactcagccctccacacctatttcagtgcttccattgctggtgtttcagtgaaaggtctcaaaggtagcaagactctcaataaggatcctgaccctaaaaatcctctggagggcaaagaagaaagggacgaggtgacctttccaggatttgtggactgtgtttaccttggcgcaccgagtgagcttaccctggacaatggattgggtgacaaaattgtaatctcaaacacaaactggtcagatgcagtgttgtggaatcctcatttgcagatggaggcatgctacaaagattttgttgtgttgaaaatgcaaagattgaaacagtacaactgggtccaaaagaatcttgggtggcagagcagaaaattgaacttgtctgaagctaatgggttgagaacagtacagtgcggagagtatgttgtcaaagggcccttttagtgtctggcagtgtaaacatgtatcattccccggtgtacttcaacttatgccctcacatcagatgtacatcttataactatttatgttttataagtaaataagtaattcagttcttatttcccttctctgggttggtcggctaatgttctgctcatagttgagtgagacagggttaatatttttccatgtaagatgtatctaactctagacaatctattatgaatgtattgttgccctttttacggtagagaaaagtc

SEQ ID NO: 1414 - DNA, 1148 bp, Secale cereale
agcgcggggcagaaggtgtacgcgcccggcgtggccgtctccgagggcaacggcggcctgcccaagatcagcctcaaatccccgcacgggagtgaggctgagatttatctgtttggagcatgcgtcacatcttggaaggttcccaatggaaaggacctgctctttgtcagaccagatgctgtgttcaacggccagaaacccatcagcggtggaattccacattgtttcccccagtttggccccggcaccatgcagcagcatggatttgccaggaatgtgaattggtctattactgattcagaagtcacagaaggagatccaactgtaactttggaactaaaagacgaccaatacagccgttcaatgtgggattttagtttccaagctttatacaaggttgcgctgcactctacaagcctttcaacgaccctgaaaataataaatacagacgataaacctttctcgttcaactcagccctccacacctatttcagtgcttccattgctggtgtttcagtgaaaggtctcaaaggtagcaagactctcaataaggatcctgaccctaaaaatcctctggagggcaaagaagaaagggacgaggtgacctttccaggatttgtggactgtgtttaccttggtgcgccgagtgagcttaccctggacaatggattgggtgacaaaattgtaatttcaaacacaaactggtcagatgcagtgttgtggaatcctcatttgcagatggaggcatgctacaaagattttgtttgtgttgaaaatgcaaagattgaaacagtacaactgggtccaaaagaatcttgggtggcagagcagaaaattgaacttgtctgaagctaatgggttgagaacagtagagtgcggcgaatatgttgtcaaagggcctttttacgcgcctggcagtgtaaacacgtgtcattccccggtgtacttcaacttatgccctcacatcagatgtacaccctataactattatatgtttttataagtaaataagtaattcagttcttgtttcccttctctgggttggtcggctatcttgtatgttctgctcatagttgaatgagacacggttaagatttttccatgtaagatgtatctagctctagacaatatattctgaatgtattgtt

SEQ ID NO: 1415 - DNA, 900 bp, Lolium multiflorum
gttcaccatcgccgctcccttcgcctcctcctcctcctccagttcagctcgccgctccaggcgattcggggtggtggccatggccagcgtggggcagaaggtgtacgcgccgggcgtggcggtatcagagggaaacggcgggctgccgaagatcagcctcaaatctccgcaggggagtgaggccgagatttatctctttggaggatgcgtcacttcttggaaggtccccagtggaaaggacctgctctttgtcagaccagatgctgtgttcaacggtcagaaacccatcagcggtggaattccacattgtttcccccagtttgggcctggcgcaattcagcagcacggatttgcaaggaatgtgaattggtctatcactgattcagaagtcaccgaaggagatccagctgtaaccttggaactaaaagacgactcatacagccgttcaatgtgggattttagtttccatgctttatacaaggttacattgcactctacaagcctgtcaacaaccctgacaataattaataccgacgataaacctttttcgttcaactcagcactccatacttatttcagtgcttccattgctggcgtttcagtgaaaggtcttaaaggtagtaagactctcaataaggatcctgaccctaaaaatcctctggagggcaaagaagaaagggaagaggtgacctttccaggatttgtagactgcgtttaccttggcgcaccgagtgagcttaccctggacaatggattgggtgacaaaattgtcatctcaaatacaaattggtcagatgcagtgttgtggaatcctcacttgcagatggaagcatgttacaaagattttgtctgtgttgaaaatgcaaagattgaaacagtacctgcccgggcggccgctcg

SEQ ID NO: 1416 - DNA, 993 bp, Triticum aestivum
cgccaacagcaacagcccagctaagctcagctcgcccaccaccagacgtaccacgtacagagctagcagcaccatccatggccgcggaggagcccaagaaggtggaggtggaggcggcgccggagccggaggccgcaccgccagccgtccctgccgcggagcccgaggcccccgccaaggacgtcaccgaggagaaggccgtcatccccgcgcccgcgccggccgccgaggaggagaagccgcccgccgatgactccaaggccctcgtcgtcgtcgagaaggttgcagatgaacctgttgctgagaaacccacagatgagaaggctgcacacggcggctcaaatgacagagacctcgctcttgcaagggtggaaagtgagaagaggaactctttaattaaagcatgggaggagaatgagaagacgaaggctgagaacaaggctactaaaaaggtgtccgctattctctcatgggagaacaccaagaaagcaaacatagaagctcaactgaagaagattgaggagcaattggaaaagaagaaggcggaatacgccgagaagatgaagaacaaggctgcaatgatccacaaggaggccgaagagaagagagcgatggtcgaggcaaagaaaggggaggagctcctcaaggccgaggagatggccgccaagtaccgcgccaccggccactctcccaagaaagtcatgggatgcttcggggcctgaagtaaaaacgttcctagttcacaaatggagcaagagtgaatgaagtgttcatccgtggttgcttgcttgcttccttctttctttcatccctcccaagtgtgtagtgtgccttgtgtgtaaagtctgccgtctctgtatatacacattgctcccaggacaggtgctcggttgtgtacatctttgatgcttgacaagcaacattcttatgtgtagttaagaaagtcacatttgttattactgttgacgttaaagcagtcgttttttggtctca

SEQ ID NO: 1417 - DNA, 1075 bp, Triticum aestivum
tctctgctcttattagtacgcccccaccctggccctctcccacagtcccacgacaccaacagctgcgccaacagcaacagcccagctaagctcagctcgcccaccaccagacgtaccacgtacagagctagcagcaccatccatggccgcggaggagcccaagaaggtggaggtggaggcggcgccggagccggaggccgcaccgccagccgtccctgccgcggagcccgaggcccccgccaaggacgtcaccgaggagaaggccgtcatccccgcgcccgcgccggccgccgaggaggagaagccgcccgccgatgactccaaggccctcgtcgtcgtcgagaaggttgcagatgaacctgttgctgagaaacccacagatgagaaggctgcacacggcggctcaaatgacagagacctcgctcttgcaagggtggaaagtgagaagaggaactctttaattaaagcatgggaggagaatgagaagacaaaggctgagaacaaggctactaaaaaggtatctgctattctctcatgggagaacaccaagaaagcaaacatagaagctcaactgaagaagattgaggagcaattggaaaagaagaaggcggaatacgcagagaagatgaagaacaaggctgcaatgatccacaaggaggccgaagagaagagagcgatggtcgaggcaaagaaaggggaggaactcctcaaggccgaggagatggccgccaagtaccgcgccaccggccactctcccaagaaagtcatgggatgcttcggggcctgaagcaaaaacgttcctagttcgcaaatggagcaagagtgaatgaagtgttcatccgtggttgcttgcttgcttccttgtttctttcatccctcccaagtgtgtagtgtgccttgtgtgtaaagtctgccgtctctgtatatacacattgctcccaggacaggtgctcggttgtgtacatctttgatgcttgacaagcaacattcttatgtgtagttaagaaagccacatttgttattattgttgacattaaagcagtcgttttttggtctaaaaaaaaaaaaaaaacga

SEQ ID NO: 1418 - DNA, 1005 bp, Pseudoroegneria spicata
ccacagctgcgccaacagcaacagctcagctaagccaggcccaagttcagctcggaccagacgtactacgtgcagagctagcagcaccatccatggccgcggaggagcccaagaaggtggaggtggaggcggcgccggagccggaggcggcaccagccgtccctgccgcggagcccgaggcccccgccaaggacgtcacggaggagaaggccgtcatccccgcgcccgcgccggccgccgaggaggagaagccgcccgccgatgactccaaggccctcgtcgtcgtcgagaaggttgcagatgaacctgttgctgagaaacccacagatgagaaggctgcacacggcggttcaaatgacagagacctcgctcttgcaagggtggaaagtgagaaaaggaactctttaattaaagcatgggaggagaatgagaagacgaaggctgagaacaaggccgctaaaaaggcatccgctattctctcatgggaaaacaccaagaaagcaaacatagaagctcaactgaagaagattgaggagcaattggaaaagaagaaggcggaatacgccgagaagatgaagaacaaggccgcaatgatccacaaggaagccgaagagaagagagcgatggtcgaggcaaagaaaggtgaggagctcctcaaggccgaggagatggccgccaagtaccgcgccaccggccactctcccaagaaagtcatgggatgcttcggggcctgaagtaaaaacgttcctggttcacaaatggagcaagagtgaatgaagtgttcatcagtggttgcttgcttgcttccttctttctttcatccctcccaagtgtgtagtgtgccttgtgtgtaaagtctgccgtttctgtatatacacattgctctcaggacaggtgctcggttgtgtacatcttttgatgcttgacaagcaacattcttatgtgtagttaagaaagtcgcatttgttattactgttgacatttaagcagtcgttttttggtcca

SEQ ID NO: 1419 - DNA, 1077 bp, Secale cereale
ccctcgccctctcccgcagtcccacgacaccaacagctgcgccaacagcaacagctcagctaagccaggcccaagctcagctcgcccaccaccagacgtaccacgtacagagagagctagtagcaccatccatggccgcggaggagcccaagaaggtggaggtggaggcggcgccggagccggaggccgcgccagtggccgtcccggccgcggagcccgaggcccctgccaaggacgtcaccgaggagaaggccgtcatccccgcgcccccgcccgccgccgaggacgagaagacgcccgtcgatgactccaaggccctcgtcgccgtcgagaaggttgcagatgaacctgttgctgagaaacccacagacgagaaggctgcacacggcggctcaaatgacagagacctcgctcttgcaagggtggaaagtgagaagaggaactctttaattaaagcatgggaggagaatgagaagacgaaggctgagaacaaggctgctaaaaaggtatctgctattctctcatgggagaacaccaagaaagcaaacatagaagctcaactgaagaagattgaggagcaattggaaaagaagaaggcggaatacgcagagaagatgaagaacaaggccgcaatgatccacaaggaagccgaagagaagagagcgatggtcgaggcaaagaaaggggaggaactcctaaaggccgaggagatggccgccaagtaccgcgccaccggcaactctcccaagaaagtcatgggatgcttcggggcctgaagtaaaaacgttcctagttcacaaatggagcaagactgaatgaagtgtttatctgtggttgcttgcttgcttccttctttctttcatccctcccaagtgtgtagtgtgccttgtgtgtaaagtctgtcgtttctgtatatacacattgctcccaggacaggtgctcggttgtgtacatctttgatgcttgacaagcaacattcttatgtgtagttaagaaagtcacatttgttattactgttgacattaaagcagtcgtttttggtctcaaaaaaaaaaaaaaactagtaagactagaccg

SEQ ID NO: 1420 - DNA, 1051 bp, Triticum aestivum
cagccagccacattcatccatccgctgcccttctctgctcttattagtacgcccccaccctctccctctcccacagtcccacgacaccaacagccgagccaacagcaacagcccagctaagcccagctcgcccaccaccagacgtaccacgtacagagctagcagcaccatccatggccgcggaggagcccaagaaggtggaggtggaggcggcgccggagccggaggccgcacagccagccgtcccggccgcggagcccgaggcccccgccaaggacgtcaccgaggagaaggccgtcatccccgcgcccgagccggccgccgaggaggagaagccccccgccgatgactccaaggccctcgtcgtcgtcgagaaggttgcagatgaacctgttgctgagaaacccacagacgagaaggctgcacacggcggctcaaatgacagagacctcgctcttgcaagggtggaaagtgagaagaggaactctttaattaaagcatgggaggagaatgagaagacaaaggctgagaacaaggctactaaaaaggtatccgctattctctcatgggagaacaccaagaaagcaaacatagaagctcaactgaagaagattgaggagcaattggaaaagaagaaggcggaatacgccgagaagatgaagaacaaggctgcaatgatccacaaggaggccgaagagaagagagcgatggtcgaggcaaagaaaggggaggaactcctcaaggccgaggagatggccgccaagtaccgcgccaccggccactctcccaagaaagtcatgggatgcttcggggcctgaagcaaaaacgttcctagttcacaaatggagcaagagtgaatgaagtgttgatccgtggttgcttgcttccttccttgtttctttcatccctcccaagtgtgtagtgtgccttgtgtgtaaagtctgccgtctctgtatatacacattgctcccaggacaggtgctcggttgtgtacatctttgatgcttgacaagcaacattcttatgtgtagttaagaaagtcacatttgtt

SEQ ID NO: 1421 - DNA, 1075 bp, Triticum aestivum
ccaacagctgcgccaacagcaacagcccagctaagcccagctcgcccaccaccagacgtaccacgtacagagagctagcagcaccatccatggccgccgaggagcccaagaaggtggaggtggaggcggcgccggagccggaggccgtccctgccgcggagcccgaggcccccgccaaggacgtcaccgaggagaaggccgtcatcccggcgcccgagccggccgccgaggaggagaagccccccgccgatgactccaaggccctcgtcgtcgtcgagaaggttgcagatgaacctgttgctgagaaacccacagacgagaaggctgcacacggcggctcaaatgacagagacctcgctcttgcaagggtggaaagtgagaagaggaactctttaattaaagcatgggaggagaatgagaagacaaaggctgagaacaaggctactaaaaaggtatccgctattctctcatgggagaacaccaagaaagcaaacatagaagctcaactgaagaagattgaggagcaattggaaaagaagaaggcggaatacgccgagaagatgaagaacaaggcggcaatgattcacaaggaggccgaagagaagagagcgatggtcgaggcaaagaaaggggaggaactcctcaaggccgaggagatggccgccaagtaccgcgccaccggcaactctcccaagaaagtcatgggatgcttcggggcctgaagcaaaaacgttcctgtttcacaaatggagcaagagtgaatgaagtgttgatctgtgcttgcttgcttccttccttgtttctttcatccctcccaagtgtgtagtgtgcctcgtgtgtaaagtctgccgtctctgtatatacacattgctcccaggacaggtgctcggttgtgtacatctttgatgcttgacaagcaacattcttatgtgtagttaagaaagtcacatttgttactattgttgacattaaagcagtcgctttttggtttcatcctggtgctgatgttgttttctcccgctgctctggttgaatccattccgtttgcacctataaggctatatggctatcatgt

SEQ ID NO: 1422 - DNA, 800 bp, Triticum aestivum
ttcatccatccgctgcccttctctgctcttattagtacgcccccaccctctccctctcccacagtcccacgacaccaacagctgcgccaacagcaacagcccagctaagctcagctcgcccaccaccagacgtaccacgtacagagctagcagcaccatccatggccgcggaggagcccaagaaggtggaggtggaggcggcgccggagccggaggccgcaccgccagccgtccctgccgcggagcccgaggcccccgccaaggacgtcaccgaggagaaggccgtcatccccgcgcccgcgccggccgccgaggaggagaagccgcccgccgatgactccaaggccctcgtcgtcgtcgagaaggttgcagatgaacctgttgctgagaaacccacagatgagaaggctgcacacggcggctcaaatgacagagacctcgctcttgcaagggtggaaagtgagaagaggaactctttaattaaagcatgggaggagaatgagaagacgaaggctgagaacaaggctactaaaaaggtgtccgctattctctcatgggagaacaccaagaaagcaaacatagaagctcaactgaagaagattgaggagcaattggaaaagaagaaggcggaatacgccgagaagatgaagaacaaggctgcaatgatccacaaggaggccgaagagaagagagcgatggtcgaggcaaagaaaggggaggagctcctcaaggccgaggagatggccgccaagtaccgcgccaccgggcactctcccaagaaagtcatgggatgcttcggg

SEQ ID NO: 1423 - DNA, 1120 bp, Triticum aestivum
cttctctgctcttattagtacgcccccaccctctccctctcccacagtcccacgacaccaacagccgagccaacagcaacagcccagctaagcccagctcgcccaccaccagacgtaccacgtacagagctagcagcaccatccatggccgcggaggagcccaagaaggtggaggtggaggcggcgccggagccggaggccgcacagccagccgtcccggccgcggagcccgaggcccccgccaaggacgtcaccgaggagaaggccgtcatccccgcgcccgagccggccgccgaggaggagaagccccccgccgatgactccaaggccctcgtcgtcgtcgagaaggttgcagatgaacctgttgctgagaaacccacagacgagaaggctgcacacggcggctcaaatgacagagacctcgctcttgcaagggtggaaagtgagaagaggaactctttaattaaagcatgggaggagaatgagaagacaaaggctgagaacaaggctactaaaaaggtatctgctattctctcatgggagaacaccaagaaagcaaacatagaagctcaactgaagaagattgaggagcaattggaaaagaagaaggcggaatacgcagagaagatgaagaacaaggctgcaatgatccacaaggaggccgaagagaagagagcgatggtcgaggcaaagaaaggggaggaactcctcaaggccgaggagatggccgccaagtaccgcgccaccggccactctcccaagaaagtcatgggatgcttcggggcctgaagcaaaaaacgttcctagttcgcaaatggagcaagagtgaatgaagtgttcatccgtggttgcttgcttgcttccttgtttctttcatccctcccaagtgtgtagtgtgccttgtgtgtaaagtctgccgtctctgtatatacacattgctcccaggacaggtgctcggttgtgtacatctttgatgcttgacaagcaacattcttatgtgtagttaagaaagccacatttgttattattgttgacattaaagcagtcgttttttggtctaattctggtgctgatgttgttttctctcactgctctgattgaattgattccgtttgcacct

SEQ ID NO: 1424 - DNA, 1258 bp, Triticum aestivum
gttgcccaattcagcggaatccgaggccctcttccgtgagaaacacgccgtccccccattggcaggctgctgctgctccagtgctcctgaaaatacactctaccacgtcgccccgcgccagctccggctttgtccagacaccgcacgtcgacacaatccgatcgatagtccagccagccattcatccgctgccgtcctcgatctctgctcttattagtacgcccccaccctctccctctcccacagtcccgcgacaccaacagctgcgccaacagcaacagcccagctaagcccagctcgcccaccaccagacgtaccacgtacagagagctagcagcaccatccatggccgccgaggagcccaagaaggtggaggtggaggcggcgccggagccggaggccgtccctgccgcggagcccgaggcccccgccaaggacgtcaccgaggagaaggccgtcatcccggcgcccgagccggccgccgaggaggagaagccccccgccgatgactccaaggccctcgtcgtcgtcgagaaggttgcagatgaacctgttgctgagaaacccacagacgagaaggctgcacacggcggctcaaatgacagagacctcgctcttgcaagggtggaaagtgagaagaggaactctttaattaaagcatgggaggagaatgagaagacaaaggctgagaacaaggctactaaaaaggtatccgctattctctcatgggagaacaccaagaaagcaaacatagaagctcaactgaagaagattgaggagcaattggaaaagaagaaggcggaatacgccgagaagatgaagaacaaggcggcaatgattcacaaggaggccgaagagaagagagcgatggtcgaggcaaagaaaggggaggaactcctcaaggccgaggagatggccgccaagtaccgcgccaccggcaactctcccaagaaagtcatgggatgcttcggggcctgaagcaaaaacgttcctgtttcacaaatggagcaagagtgaatgaagtgttgatctgtgcttgcttgcttccttccttgtttctttcatccctcccaagtgtgtagtgtgcctcgtgtgtaaagtctgccgtctctgtatatacacattgctcccaggacaggtgctcggttgtgtacatctttgatgcttgacaagcaacattcttatgtgtagttaagaaagtcacatttgttactattgttgacattaaagcagtcgctttttggtttcaaaaaaaaaa

SEQ ID NO: 1425 - DNA, 1124 bp, Secale cereale
ggctttgtccaggcacgtccgtcgacacaatcccgatagccagcccagccagccagcccctgccgttctcttctcttattagtacgcccccaccctcgccctctcccgcagtcccacgacaccaacagctgcgccaacagcaacagctcagctaagcccagctcgcccaccaccagacgtaccacgtacagagagagctagcagcgccatccatggccgcggaggagcccaagaaggtggaggtggaggcggcgccggagccggaggccgcgccagtggccgtccctgccgcggagcccgaggcccccgccaaggacgtcaccgaggagaaggccgtcatccccgcgccccgccccgcccgccgctgaggacgagaagacgcccgtcgatgactccaaggccctcgtcgccgtcgagaaggttgcagatgaacctgttgctgagaaacccacagatgagaaggctgcacacggcggctcaaatgacagagacctcgctcttgcaagggtggaaagtgagaagaggaactctttaattaaagcatgggaggagaatgagaagacgaaggctgagaacaaggctgctaaaaaggtatctgccattctctcatgggagaacaccaagaaagcaaacatagaagctcaactgaagaagattgaggagcaattggaaaagaagaaggcggaatacgcagagaagatgaagaacaaggccgcaatgatccacaaggaagccgaagagaagagagcgatggtcgaggcaaagaaaggggaggaactcctaaaggccgaggagatggccgccaagtaccgcgccaccggcaactctcccaagaaagtcatgggatgcttcggggcctgaagtaaaaacgttcctagttcacaaatggagcaagactgaatgaagtgtttatctgtggttgcttgcttgcttccttctttctttcatccctcccaagtgtgtagtgtgccttgtgtgtaaagtctgtcgtttctgtatatacacattgctcccaggacaggtgctcggttgtgtacatctttgatgcttgacaagcaacattcttatgtgtagttaagaaagtcacatttgttattactgttgacattaaagcagtcgttttt

SEQ ID NO: 1426 - DNA, 1543 bp, Hordeum vulgare
tttgggtaaccgctactacttgtcaggaccatgcaagcaaaactggattggttcaagatggatgaaccgctgttgatatcgagagcaggctttgccgtgaatatatatggttagacgacgacgctgcgaagctatctataatatgcatccaccgttcgaccctgccatatcacttcaccccatactgtcacgccaaagccggcaccacccccaacctaccacgtctccccgcccgcgcccgcgccagctccggctttgcccaggcacgtccgtcgacacaattccgatagtccagccagccagccattcatccgctgcgatctctctcccttattagtacgcccccaccctctccctctcctgcccacagtcccactcccacgacaccaacagctgcgccaacagcaacagcccagctccccactaccagacgtaccacgtacagagcttagcaccacccatggccgcggaggagcccaagaaggtggaggtggaggcggcgccggagccggagcccgcacccccggcggcggagcctgaggcccccgccaaggacgtcaccgaggagaaggccgtcatccccgcgcccgcgcccgccgccgacgaggagaagccgcccgtcgacgactccaaggccctcgtcgtcgtcgagaaggttgcagatgaacctgttgctgagaaactcacagatgagaaagctgcacacggcggctcaaacgacagagacctcgctcttgcaagggtggaaagcgagaagaggaactctttaattaaagcatgggaggaaaatgagaagacaaaggctgagaacaaggctactaaaaaggtatctgctattctctcatgggagaacaccaaaaaagcaaacatagaagctcaactgaagaagattgaggagcaattggaaaagaagaaggctgaatacgccgagaagatgaagaataaggccgcaatgatccacaaggaagccgaagagaagagagcgatggtcgaggcaaagaaaggggaggaactcctcaaggccgaggagatggccgccaagtaccgcgccaccggcaactctcccaagaaagtcatgggatgctttggggcctaaagtaaaaacgctccttcttcgcaaatggagcaagagtgaatgaagtgtttatcagtggttgcttgcttccttgtttctttcatccgtccaagttgtgtagtgtgccttgtgtgtaaagtctgccgtttctgtatatacatattgctcccaggacaggtgttcggttgtgtacatctttcatgcttgacaagcaacattcttatgtgtagttaagaagtcacatttgttattactcttgacatttaagcagtcgatttttggtctcatcctggttttgatattgttttctcactattttgattgaattgatccgttttagcctatgtttatgttgaacatgtatagtctgcgtacacgtctatagatcttggtttgtatattgcacctgtcacgtctccctctcattgtaatctgtatgtaacttgaaagacgagacatgagttgcac

SEQ ID NO: 1427 - DNA, 1185 bp, Hordeum vulgare
cgcccgcgccagctccggctttgcccaggcacgtccgtcgacacaattccgatagtccagccagccagccattcatccgctgcgatctctctcccttattagtacgcccccaccctctccctctcctgcccacagtcccactcccacgacaccaacagctgcgccaacagcaacagcccagctccccactaccagacgtaccacgtacagagcttagcaccacccatggccgcggaggagcccaagaaggtggaggtggaggcggcgccggagccggagcccgcacccccggcggcggagcctgaggcccccgccaaggacgtcaccgaggagaaggccgtcatccccgcgcccgcgcccgccgccgacgaggagaagccgcccgtcgacgactccaaggccctcgtcgtcgtcgagaaggttgcagatgaacctgttgctgagaaactcacagatgagaaagctgcacacggcggctcaaacgacagagacctcgctcttgcaagggtggaaagcgagaagaggaactctttaattaaagcatgggaggaaaatgagaagacaaaggctgagaacaaggctactaaaaaggtatctgctattctctcatgggagaacaccaaaaaagcaaacatagaagctcaactgaagaagattgaggagcaattggaaaagaagaaggctgaatacgccgagaagatgaagaataaggccgcaatgatccacaaggaagccgaagagaagagagcgatggtcgaggcaaagaaaggggaggaactcctcaaggccgaggagatggccgccaagtaccgcgccaccggcaactctcccaagaaagtcatgggatgctttggggcctaaagtaaaaacgctccttcttcgcaaatggagcaagagtgaatgaagtgtttatcagtggttgcttgcttccttgtttctttcatccgtccaagttgtgtagtgtgccttgtgtgtaaagtctgccgtttctgtatatacatattgctcccaggacaggtgttcggttgtgtacatctttcatgcttgacaagcaacattcttatgtgtagttaagaagtcacatttgttattactcttgacatttaagcagtcgatttttggtctcatcctggttttgatattgttttctcactattttgattgaattgatccgttttagcctaa

SEQ ID NO: 1428 - DNA, 1305 bp, Leymus cinereus x Leymus triticoides
  misc_feature (206)..(206): n is a, c, g, or t
attcagcggaattccttggcaggctgcagcccctgaaaatacactctaccacgtctccccgcgccagctccggctttgtccaggcacgtccgtcgacacaatccgatagctagcccagccagccagccgctgccgctctcttattagtacgcccccagccccccaccctctccctctccctcccccacagtcccacgacacctacngctgcgccaacagcaacagctcagctaagccaagctcgcccaccaccagacgtacgtacagagctagtaccatggccgcggaggagcccaagaaggtggaggtggaggcggacgccggagccggaggccgcaccgccggccgtggagcctgaggcccccgccaaggacgtcaccgaggagaaggccgtcatccccgcgcccgcgccggccgcccaggaggagaagccgcccgtcgatgactccaaggccctcgtcgtcgtcgagaaggttgcagatgaacctgttgctgagaaacccacagatgagaaggctgcacacggcggctcaaatgacagagacctcgctcttgcaagggtggaaagtgagaagaggaactctttaattaaagcatgggaggagaatgagaagacgaaggctgagaacaaggctactaaaaaggtatctgctattctctcatgggagaacaccaagaaagcaaacatagaagctcaactgaagaagattgaggagcaattggaaaagaagaaggcggaatacgcagagaagatgaagaataaggccgcaatgatccacaaggaagccgaagagaagagagcgatggtcgaggcaaagaagggggaggaactcctcaaggccgaggagatggccgccaagtaccgcgccaccggccactctcccaagaaagtcatgggatgcttcggggcctaaagtaaaaaaggttccttgttcacaaatggatcaagagtgaatgaagtgtttatccgttgtggcttgcttccttccttctttctttcatccgcccaagtgtgtagtgtgccttgtgtgtaaagtctgccgtctctgtatatacacattgctcccaggacaggtgctcggttgtgtacatctttgatgcttgataagcaacattcttatgtgtagttaagaaagtcacatttgttattactgttgacatttgagcagtcgtttttgggtctcatcctggtgtttttttggttttgtacagggcataaaaacattttgcattttgtcacggagggagtaatgtcttgcttccttccttctttcttttatacagaattttgacaatttaaaagca

SEQ ID NO: 1429 - DNA, 1004 bp, Secale cereale
gctgcgccaacagcaacagctcagctaagcccagctcgcccaccaccagacgtaccacgtacagagagagctagcagcgccatccatggccgcggaggagcccaagaaggtggaggtggaggcggcgccggagccggagaccgcgccagtggccgtcccggccgcggagcccgaggcccccgccaaggacgtcaccgaggagaaggccgtcatccccgcgcccccgcccccgcccgccgccgaggacgagaagacgcccgtcgatgactccaaggccctcgtcgccgtcgagaaggttgcagatgaacctgttgctgagaaacccacagacgagaaggctgcacacggcggctcaaatgacagagacctcgctcttgcaagggtggaaagtgagaagaggaactctttaattaaagcatgggaggagaatgagaagacgaaggctgagaacaaggctgctaaaaaggtatctgccattctctcatgggagaacaccaagaaagcaaacatagaagctcaactgaagaagattgaggagcaattggaaaagaagaaggcggaatacgcagagaagatgaagaacaaggccgcaatgatccacaaggaagccgaagagaagagagcgatggtcgaggcaaagaaaggggaggaactcctcaaggccgaggagatggccgccaagtaccgcgccaccggcaactctcccaagaaagtcatgggatgcttcggggcctgaagtaaaaacgttcctagttcacaaatggagcaagactgaatgaagtgtttatctgtggttgcttgcttgcttccttctttctttcatccctcccaagtgtgtagtgtgccttgtgtgtaaagtctgccgtctctgtatatacacattgctcccaggacaggtgctcggttgtgtacatctttgatgcttgacaagcaacattcttatgtgtagttaagaaagtcacatttgttattactgttgacattaaagcagtcgttttttggtc

SEQ ID NO: 1430 - DNA, 1137 bp, Festuca arundinacea
  misc_feature (351)..(351): n is a, c, g, or t
  misc_feature (372)..(372): n is a, c, g, or t
  misc_feature (509)..(509): n is a, c, g, or t
ggcacgagggcggaatccgaggccctcttttgtcaggcacacatccgcctttgcagctcctgaaagaaaagaaaaactcattcccaatcccctcggccagcagccagctccagctttgtttgtccaggcacgtcgacccaaatccaacactccagccggccgctgttattagtacgcgccaccaccacgccggtacgcccccacaaccacactcctcccctaccacgacacgaacagctgcgccaacagcaacagcttagctaagcgctcgcccaccaaacgaactagcgattgccatggctgcggaggaggccaagaaggtggaggtggaggcggcgccggagcccgagntggcgccgccggccgtccccnccgcggagccggaggcccccgccaaggacgtcaccgaggagaaggccgtcgtcccggtcgaggaggagaaggcggccgtcgatgactccaaggcgctcgtcccagtcgagaaggttgcagatgaacctgctgctganaaacccgccgatgagaagcccgcacatgggggctcaaatgacagagatatcgctctcacaagggtggaaacagagaagaggaactctctgattaaggcatgggaagagaatgagaagacaaaggctgagaacaaggctgctaaaaaggtatccgctattctttcatgggagaacaccaagaaagcaaacattgaagctcaactgaagaagattgaggagcaattagaaaagaagaaggctgaatacgcagagaagatgaagaacaaggctgcactcatccacaaggaagctgaagagaagagagcgatggttgaggcaaagcgtggcgaggagctcctcaaagcagaggagacggccgccaagtaccgcgcaactggcaactctcccaagaaagccatgggatgctttggggcataaacaaaaaaaaaagttccctggtcacaaatagggcaagagtgaagtgttcatccgtgcttgcttgcttcccttttctttcacccatccaagtgtgtagtgtgccttgtgtgtaaagtcttctgttgctgtatatacacattgcttcccaagacaggtttctggtggtgtacatctttgatgcttgacaagcaaacattcttatgtgtagtta

SEQ ID NO: 1431 - DNA, 1195 bp, Avena sativa
gccagctcctccagctttgtctgtccaggcgcatcgacacaatccaacaccccccagccccagccggccgccccgcccgctgttattagtacgcgccaccaccacgccggtaccactactacgcccccacccccctaccgcagtcccacgacacacacagctgcgccaacagcaacacctcagcggccaccaaacgtccagcgatcgccatggccgcggaggaccccaagaaggtggaggtggaggcggcgcccgagcccgaggtggcggcgcccgtccccgccgcggagccggaggcccccgccaaggacgtcaccgaggagaaggccgtcgtccccgccgaggaggccaagccgcccgtcgatgacgactccaaggccctcgtcgtcgtcgagaaggttgcagatgaacctgttgctgagaaacccgctgatgagaagactccgcaagggggctcaaatgacagagatattgctctcacaagggtggaaacagagaagaggaactctctaattaaagcatgggaggagaatgagaagacaaaggctgagaacaaggctgctaaaaaggtatccgctattctttcatgggagaacaccaagaaagcaaacattgaagctcaactaaggaagattgaggagcaattagaaaagaagaaggctgaatacgcagagaagatgaagaacaaggctgcactcatccacaaggaagctgaagagaagagagcgatggttgaggcgaagcgcggcgaggaaatcctcaaagctgaggagacggccgccaagtaccgcgccactggcaactctcccaagaaagctatggggtgctttggggcctagaaaaaaatctttccctggtcacaaacggggcaagagtgaagtgctcatccgtggttgcttgcttcctttttttgttcacccgtccaagtgtgtagtgtgccttgtgtgtaaagtcttctgatgctgtatatacatattgcttccaaagacagatttctggtggtgtacatctttgatgcttgacatttgacaagcaaacattcttatgtgtagttaagaagtcacactgttatcactgttgacatttaagcagtctttttggtctcatcctagtggttatgttgttaacttgcattgtggccctccaatcgcaagggcatcgtttttagtatgttgaaaatattaagtgtgtttac

SEQ ID NO: 1432 - DNA, 1331 bp, Oryza sativa
aacccccgttccccaattcggcagaatacgagacctttttctcaggaacacgctgtcacctcacctccacgctcccctcccgcggcagctgaacagagacgagctcaccccacagtcccccactacccccacccaccaccacctccagcttttgtcctgacaccagctaacagttaaaccggttgctgttattagtacgcgccaccacgacgcccacgcacatcatccctccgcgcaaaagcctatcaacagctaagccaaacagggtcaggagccggagccgtccgggagagggaacactcgagcgatccgtccgtccgcccgcccgtcgtcgtcgcgcgccatggctgaggaggaggccaagaaggtggaggtggaggtcaccgaggcgccacccgccgctgccgctgccgcggagacggagccggctgccaaggacgtcgccgaggagaaggccgtcatccccgcccccgcgccgccggccgaggaggagaagcctcccgtcgacgactccaaggcgctggccatcgtcgagaaggttgcagatgaacctcctgccgagaaacctgctcaagggggctctaatgacagagatgttgctcttgcaagggtggaaactgagaagaggaactcattgatcaaagcatgggaggaaaatgagaagacaaaagctgagaacaaggcttcgaagaagctatctgctattctttcctgggagaacacaaagaaagcaaacatagaagctcaactgaagaagattgaggagcaactggaaaagaagaaggctgaatatgcagagaagatgaagaacaaagtcgcgatcgtccacaaggaagctgaggagaagagagcaatggtcgaggcaaagcgcggcgaggaagtcctaaaggccgaggagatggcagccaagtaccgtgccaccggccatgctcccaagaaactcatcgggtgctttggggcctaaagaaattttcgattcacaacgagcaaacgtgaaagtgttcatcagtggttgctttgcttctttcaccctcccaagtgcgtagtgtgtttgttggtgcaagaaaggtcgtgcctggtgtgtaaagtctggtgttgctgtatataacatattactcccaagacagatatgtttggtgctgtacatgtttgatgcttgacaggcaacattcttatgtgtagttaagaagccacattgttattgttattgacagtaagctgtttgttcttttactggtgtctgagtttgtcttgttttgattggccttcattggattcactagtaactgactgcatctttgtgcatgttagtatatttgttttcatctgaa

SEQ ID NO: 1433 - DNA, 1284 bp, Oryza sativa
aacccccgttccccaattcggcagaatacgagacctttttctcaggaacacgctgtcacctcacctccacgctcccctcccgcggcagctgaacagagacgagctcaccccacagtcccccactacccccacccaccaccacctccagcttttgtcctgacaccagctaacagttaaaccggttgctgttattagtacgcgccaccacgacgcccacgcacatcatccctccgcgcaaaagcctatcaacagctaagccaaacagggtcaggagccggagccgtccgggagagggaacactcgagcgatccgtccgtccgcccgcccgtcgtcgtcgcgcgccatggctgaggaggaggccaagaaggtggaggtggaggtcaccgaggcgccacccgccgctgccgctgccgcggagacggagccggctgccaaggacgtcgccgaggagaaggccgtcatccccgcccccgcgccgccggccgaggaggagaagcctcccgtcgacgactccaaggcgctggccatcgtcgagaaggttgcagatgaacctcctgccgagaaacctgctcaagggggctctaatgacagagatgttgctcttgcaagggtggaaactgagaagaggaactcattgatcaaagcatgggaggaaaatgagaagacaaaagctgagaacaaggcttcgaagaagctatctgctattctttcctgggagaacacaaagaaagcaaacatagaagctcaactgaagaagattgaggagcaactggaaaagaagaaggctgaatatgcagagaagatgaagaacaaagtcgcgatcgtccacaaggaagctgaggagaagagagcaatggtcgaggcaaagcgcggcgaggaagtcctaaaggccgaggagatggcagccaagtaccgtgccaccggccatgctcccaagaaactcatcgggtgctttggggcctaaagaaattttcgattcacaacgagcaaacgtgaaagtgttcatcagtggttgctttgcttctttcaccctcccaagtgcgtagtgtgtttgttggtgcaagaaaggtcgtgcctggtgtgtaaagtctggtgttgctgtatataacatattactcccaagacagatatgtttggtgctgtacatgtttgatgcttgacaggcaacattcttatgtgtagttaagaagccacattgttattgttattgacagtaagctgtttgttcttttactggtgtctgagtttgtcttgttttgattggccttcattggattcactagt

SEQ ID NO: 1434 - DNA, 1360 bp, Sorghum bicolor
caaacggccgtccctgaaccgaggaacctggagccccacaccccccaatccgggagaatacgaggcccttttttctgtcagaattcagaacacacaccaaagcctccactgccttccccttcccttgtggcctaaactactctccagcttcgtccagagtccagcagacacggccaacagttaaaccagttgctattagtacgcgccaccacgctcgcacgcacacgcacacgcacagctagctcgcacccctacacactcaacagcaacagctaagcttctccaaccagacagcaacatggctgaggaggcggccaagaaggtggaggtggaggtcaccaaggacaaggagcccgaggcggcgcccgcggaggccgtgccggaggcggcggccaaggaggacgtcgccgaggagaaggccgtcatccccgcgaccgagccgccggccgccgaggagaagccgccggccgacgattccaaggccctcgccatcgtcgagaaagttgcagatgaacctgctccagagaagcctgctgctgagaagcaagggggttccaatgacagagatcttgctcttgcaagggtggaaacagagaagaggaactctttgatcaaagcatgggaagagaatgagaagacaaaagctgagaacaaggctgctaagaaagtatccgctattctttcatgggagaacacaaagaaagcaaacatagaagctcaactgaagaagattgaggaacaactggaaaagaagaaggccgaatatgctgagaagatgaagaacaaggttgcaatgatccacaaggaagccgaggagaagcgagcgatggtggaggcaaagcgcggtgaggaggtcctgaaggccgaggagatggctgccaaataccgggccaccgggcacgctcctaagaagctcatcgggtgcttcggagcctaagaaacattccaagtcacacccgagcaggaagtgaaaaacgtcaaccagtgattgcttggtcctctcgctctatcaagtgtgtagtgtgtcttcgaaagtgtgtaaagcctactgctgctctgtatatacagatgttgcttccaagacaggcgtttggtgggtgtacatgttgaatgcttgacgagaaacattcttatttgtagttaaggggtcacactgttgttgttgctgttgttgttgacatttaagcagacattttgttcttcgcctgctgttattgtttttgtccctgtctctttgttccttactgctgatttcagtttgtctatctatcatgttcttttcaagtacagcttttcgtagcacctgaatagcacccatacttaaatactaagctcctgaaacgggttctgtctggaaaat

SEQ ID NO: 1435 - DNA, 1480 bp, Sorghum bicolor
gctagcagcagttatttttttccccatcaggataactattgtcattcaccagaaggatcgagaccagcgcaaagcaagatataaacaactctatacgtgcctgcaactgcaaggctgcaaacggccgtccctgaaccgaggaacctggagccccacaccccccaatccgggagaatacgaggcccttttttctgtcagaattcagaacacacaccaaagcctccactgccttccccttcccttgtggcctaaactactctccagcttcgtccagagtccagcagacacggccaacagttaaaccagttgctattagtacgcgccaccacgctcgcacgcacacgcacacgcacagctagctcgcacccctacacactcaacagcaacagctaagcttctccaaccagacagcaacatggctgaggaggcggccaagaaggtggaggtggaggtcaccaaggacaaggagcccgaggcggcgcccgcggaggccgtgccggaggcggcggccaaggaggacgtcgccgaggagaaggccgtcatccccgcgaccgagccgccggccgccgaggagaagccgccggccgacgattccaaggccctcgccatcgtcgagaaagttgcagatgaacctgctccagagaagcctgctgctgagaagcaagggggttccaatgacagagatcttgctcttgcaagggtggaaacagagaagaggaactctttgatcaaagcatgggaagagaatgagaagacaaaagctgagaacaaggctgctaagaaagtatccgctattctttcatgggagaacacaaagaaagcaaacatagaagctcaactgaagaagattgaggaacaactggaaaagaagaaggccgaatatgctgagaagatgaagaacaaggttgcaatgatccacaaggaagccgaggagaagcgagcgatggtggaggcaaagcgcggtgaggaggtcctgaaggccgaggagatggctgccaaataccgggccaccgggcacgctcctaagaagctcatcgggtgcttcggagcctaagaaacattccaagtcacacccgagcaggaagtgaaaaacgtcaaccagtgattgcttggtcctctcgctctatcaagtgtgtagtgtgtcttcgaaagtgtgtaaagcctactgctgctctgtatatacagatgttgcttccaagacaggcgtttggtgggtgtacatgttgaatgcttgacgagaaacattcttatttgtagttaaggggtcacactgttgttgttgctgttgttgttgacatttaagcagacattttgttcttcgcctgctgttattgtttttgtccctgtctctttgttccttactgctgatttcagtttgtctatctatcatgttcttttcaagtacagcttttcgtagcacctgaatagcacccatacttaaatactaagctcctgaaacgggttctgtctggaaaatatt

SEQ ID NO: 1436 - DNA, 975 bp, Saccharum officinarum
cacacacacactcaacagcaacagctaagcttctcctaccggacagcaacatggctgaggaggaggccaagaaggtggaggtggaggtcaccaaggacaaggagcccgaggcggcgcccgcggaggccgagccggaggcggccaaggaggacgtcgccgaggagaaggccgtcatccccgcgaccgagccgccggccgacgaggagaagccgccggcgccggccgacgactccaaggccctggcaatcgtcgagaaagttgcagatgaacctgctccagagaagcctgctgctgagaagcaagggggctccaatgacagagatctcgctcttgcaagggtggaaacagagaagaggaactctttgatcaaagcatgggaagagaatgagaagacaaaagctgagaacaaggctgctaagaaagtatccgctattctttcatgggagaacacaaagaaagcaaacatagaagctcaactgaagaagattgaggaacaactggaaaagaagaaggctgaatatgctgagaagatgaagaacaaggttgcaatgatccacaaggaagccgaagagaagcgagcgatggtggaggcaaagcgcggcgaggaggtcctgaaggccgaggagatggctgccaagtaccgggccaccggccacgctcctaagaagctcatcgggtgctttggagcctaagaagccttccaagtcacaccgagcagaaagtgaaaaccgtcaaccagtgattgcttggtcctctcgctctatcaagtgtgtagtgtgtcgtcgaaagtgtgtaaagcctactgctgctgtatatacagatattgcttccaagacaggcgtttggtggtgtacatgttgaatgcttgacgagaaacattcttatttgtagttaaggggtcacactgtgtgtgttgtcccgttgtgtgacatttaagcagacattcttgtctactgggcgtattgtttttgtccc

SEQ ID NO: 1437 - DNA, 1193 bp, Pennisetum glaucum
cggcttcgtccagacagttaaaccggttgctattagtacgcgccaccaccacgctcgcacgcacgcacaggcaaggcaagcacagctagctccccaccccacacactcaacagcaacagctaagctgcacccacaaagacagcaacatggctgaggaggcggccaagaaggtggaggtggaggtcgccaaggagcccgaggcggcaccggcggccgcggaggcgcccaaggaggacgtcgccgaggagaaggccgtcatccccgccagcgagccgccggccgccgaggagaagccggccgacgactccaaggccctggccatcgtcgagaaggttgcagatgaacctgctgcagagaaacctgcagctgagaagcaagggagctctaatgatagagatctcgctctcgcaagggtggaaacggagaaaaggaactctttgatcaaagcatgggaagagaatgagaagacaaaagctgagaacaaggctgccaaaaaaatatctgctattctttcatgggagaacacaaagaaagcgaacatagaagctgaactgaaaaagattgaggagcaactggaaaaaaagaaggctgaatacgccgagaagatgaagaacaaagtggcaatcatccacaaggaagccgaagagaagagggcaatggtcgaagcaaagcgcggcgaggaggtcctgaaggccgaggagatggctgccaagtaccgcgccaccggccacgcacccaagaaggtcatcgggtgctttggagcctaagaaacgccccgagtcacaccgagcaggaagtgcaaaaaaacgtcaatccatggttgcttggttctctcgctctatcaagtcaagtgtgtagtgtgccttcgaaagtgtgtaaagcctaccgttgctgtacatacacatattacttccaagacaggcgtttggtggtggtgtacatgtttgaatgcttgacgagcaacattcttatgtgtagttaagaagtcacattgttggtgttgttgacatttaagcagacatttttgttcttttcctagtgttatgatttttgctagtgacactttgttcctttctgttgatgtgtttaggtttgtatatgcatgtgcaattgtcattgttcttatgtacagtttttcgaggcacctgaatagctcccatatttgaataccaaagctcctgaactcggttcgg

SEQ ID NO: 1438 - DNA, 780 bp, Brachypodium distachyon
aacctttgatactcattatcactttatcagactttgatgaaacaattgaggctgatgctttgtgcgggttggtgagagatggagaaggaacaaatgaagatggccatcctgaggcaagaacagacattcagacaccaggtaaacgagctgcatcgtgtataccaggttcagaagcaactgatgacagaggtgcacgttgttaagatgaactgggctcaggcaggaggagatactcaagccgaagcaatggtggagacaaatcatctgcaatgttacagtaactaaggcgagaagaaaccccctcctgttgaagatttcgacctagagctgacactagcaactgggagtgataggaggaaacaagagatggcatccaactcggactccggggcaacagtgtcgtcatcaacttctgctgaatcggagttacggcagcgattccctgagtccaatgtaaatggtttcaaagtaagagcgagaggtatgatgatcagcacatgcagtctccttggctctatgtttaagtctgacgatggcttagctaggttccagtgtttcagaattcagtctaaacaaaagcactggcattattatgtgtacatcagaaactaatttgttgcaacaggaggaacgagctcaatagaaagtaatcagacacatctagaaacatgtggctgattagaaatagaaagtaatcagaaagggggttattcgtcaacaaaagattcattttatgtacgtatcaagcataaaccttgccttgtttatgtaacatcagtg

SEQ ID NO: 1439 - DNA, 521 bp, Brachypodium distachyon
aacctttgatactcattatcactttatcagactttgatgaaacaattgaggctgatgctttgtgcgggttggtgagagatggagaaggaacaaatgaagatggccatcctgaggcaagaacagacattcagacaccaggtaaacgagctgcatcgtgtataccaggttcagaagcaactgatgacagaggtgcacgttgttaagatgaactgggctcaggcaggaggagatactcaagccgaagcaatggtggagacaaatcatctgcaatgttacagtaactaaggcgagaagaaaccccctcctgttgaagatttcgacctagagctgacactagcaactgggagtgataggaggaaacaagagatggcatccaactcggactccggggcaacagtgtcgtcatcaacttctgctgaatcggagttacggcagcgattccctgagtccaatgtaaatggtttcaaagtaagagcgagaggtatgatgatcagcacatgcagtctccttggctctatgtt

SEQ ID NO: 1440 - DNA, 1955 bp, Brachypodium distachyon
accacgctgcaagcctggaaccatgtcgatccatcccgaaatcccgaaagcctggagcgctcccctatctctgcctcccaggctcccaacgcccccctcctcctggctagggttttctctctgccggccccgcccccagcttcgtcgcatccctagcacccctgcagacgaggcccccagccccaaactccgccgtcgccgcccttgcagcgtgctggttcgcttggcggcggtgattgttcctggtgctttctgagcgttggtcggatttgctaatttggggatttgctttgttcggtgcggcatgcagtgtttgtgtgcgcgggttcttgccgaggcagcatgattcctcgacctgatccggcttcggttgtcaggtgctagcttgctgaggtctggacatctcctgtgggtctgctttgtttgttttgcttcctttcattgtcggtgtgctcctgttgtgctcccagaatgaatcacacaagctggaggcccagttttggtgggataagaaacccctcagattggatcccctctgttcgacatgtccttttcttttgctggagtatgatcaagtgagggagtatgatactagattgggcataaccatgcgcgagggagtatagatcaagaagcagaagccgcagcctctcttacttgacaagtcttggttgcggcgggagcaagagtcaatgcctccatgagagcagggagacagagggagtgccttaccttcttccgaagaattcagaaacagggatccttaccagagactttgatgaaacaagtgaggctgatgctttgtgcgggttggtgagtgatggagaaggaacaaatgaagatggccatcctgaggcaaggacagacattcagacaccaggtaaacgtgctgcatcgtgtataccaggttcagaagcaactgatgacagaggtgcacgttgttaagatgaactgggctcaggcaggaggagatactcaagccgaagcaatggtggagacaaatcatctgcaatgttacagtaactcaggcgagaagaaaccccctcctgttgaagatttcgacctagagctgacactagcaactgggagtgataggaggaaacaagagatgggatccaactcggactccggggcaacagtgtcgtcatcaacttctgctgaatcggagttacggcagcgattccctgagtccaatgtaaatggtttcaaagtaagagcgagaggcatgatgatcagcacatgcagtacacatgcagtctccttggctctatgtttaagtctgacgatggcttagctaggttccagtgtttcagaattcagtctaaacagaagcactggaattattatgtgtacatcagaaactaatttgttgcaacaggaggaacgagctcaatagaaagtaatcagacacatctagaaacatgtggctgattagaaatagaaagtaatcagaaagggggttattcgtcaacaaaagattcattttatgtacatatcaagcataaaccttgccttgtttatgtaacatcagtgtacagagaatttggtgcacaaaatagaagaccttgcaaatgatagaagaaatgcctccagagaatagtgtggaatgtagatgaccaagtagccaaggagtggtatttacgtgtcgcctaatagttttatgtgaatgaagtggccttttttttttctggtaccgatgttgatcatggatcgcgagaaaatagactggaatgtagacgacaaagttgccaaggagtggtatgttgtactgtcaggtgaggggaagctgaattcctaaagaagcaaaggatatcccgacaacaaaatagagttgcagcccttgggtgtggatgtgaggatgtcgatgaacctcaatcatccacgccgttgggtttgtaagataagtggtatattatgtcatctatttgggcagagaataagctcaattgtcgggc

SEQ ID NO: 1441 - DNA, 2829 bp, Brachypodium distachyon
accacgctgcaagcctggaaccatgtcgatccatcccgaaatcccgaaagcctggagcgctcccctatctctgcctcccaggctcccaacgcccccctcctcctggctagggttttctctctgccggccccgcccccagcttcgtcgcatccctagcacccctgcagacgaggcccccagccccaaactccgccgtcgccgcccttgcagcgtgctggttcgcttggcggcggtgattgttcctggtgctttctgagcgttggtcggatttgctaatttggggatttgctttgttcggtgcggcatgcagtgtttgtgtgcgcgggttcttgccgaggcagcatgattcctcgacctgatccggcttcggttgtcaggtgctagcttgctgaggtctggacatctcctgtgggtctgctttgtttgttttgcttcctttcattgtcggtgtgctcctgttgtgctcccagaatgaatcacacaagctggaggcccagttttggtgggataagaaacccctcagattggatcccctctgttcgacatgtccttttcttttgctggagtatgatcaagtgagggagtatgatactagattgggcataaccatgcgcgagggagtatagatcaagaagcagaagccgcagcctctcttacttgacaagtcttggttgcggcgggagcaagagtcaatgcctccatggtgataaccatcacctatggatgaaatgtatgtcattctatattgatactactgcaagcctgcaagttcgtttgtcgaagtaatgccaatttgatacgttgaagaaatgcgagcaatctgatcttgccattggtgatgatacatggtgtaatacacatagtagaaattaagatacggagtacaagatattgaaactccaacttttaccaacacactacttctaagtttagatgaacagaaacagttcatgaatggttgttctgatgtatttctttccttccttaagtatataacagtaacacctatggctacttttattattatgaatcactattttaaatgttagcttaccccaaatttggtcaaatgattaatcatgcagtgctggctggctaatctgcgatatttaagcattgcttttgttttccggagatctagccatgcggcaatccggtgactgctctcatagagtattggatgtgttgagattcagatatgatggtttggaactttggatagtagagctggattatcagcatgtatggcaagtgggcaccatgtgctagaagcaagaaattcatgacggtataaggatatttcctatgtggaaatatgttctaagaagctgacattaacaaatgaagatgtacaccctggtcaattctgctcttcagttttagttttaataatcacatctacaattagatatgacaaaaaattcatacggagtactatgattcctctcctatattctgctttgatttttttacatacagttacatccatggctgacgaatatctatggtggtcggtctgattttagtgttaattttgtatgacaccacaatttaagtaatgaaccttgtataaacagagagcagggagacagagggagtgccttaccttcttccgaagaattcagaaacagggatccttaccagagactttgatgaaacaagtgaggctgatgctttgtgcgggttggtgagtgatggagaaggaacaaatgaagatggccatcctgaggcaaggacagacattcagacaccaggtaaacgtgctgcatcgtgtataccaggttcagaagcaactgatgacagaggtgcacgttgttaagatgaactgggctcaggcaggaggagatactcaagccgaagcaatggtggagacaaatcatctgcaatgttacagtaactcaggcgagaagaaaccccctcctgttgaagatttcgacctagagctgacactagcaactgggagtgataggaggaaacaagagatgggatccaactcggactccggggcaacagtgtcgtcatcaacttctgctgaatcggagttacggcagcgattccctgagtccaatgtaaatggtttcaaagtaagagcgagaggcatgatgatcagcacatgcagtacacatgcagtctccttggctctatgtttaagtctgacgatggcttagctaggttccagtgtttcagaattcagtctaaacagaagcactggaattattatgtgtacatcagaaactaatttgttgcaacaggaggaacgagctcaatagaaagtaatcagacacatctagaaacatgtggctgattagaaatagaaagtaatcagaaagggggttattcgtcaacaaaagattcattttatgtacatatcaagcataaaccttgccttgtttatgtaacatcagtgtacagagaatttggtgcacaaaatagaagaccttgcaaatgatagaagaaatgcctccagagaatagtgtggaatgtagatgaccaagtagccaaggagtggtatttacgtgtcgcctaatagttttatgtgaatgaagtggccttttttttttctggtaccgatgttgatcatggatcgcgagaaaatagactggaatgtagacgacaaagttgccaaggagtggtatgttgtactgtcaggtgaggggaagctgaattcctaaagaagcaaaggatatcccgacaacaaaatagagttgcagcccttgggtgtggatgtgaggatgtcgatgaacctcaatcatccacgccgttgggtttgtaagataagtggtatattatgtcatctatttgggcagagaataagctcaattgtcgggc

SEQ ID NO: 1442 - DNA, 3644 bp, Brachypodium distachyon
tttccctccgtcctttcttttctcccaagtccaaagtgagtccaaaccctgtaaacccccgcaagggccgggccgacagccacagaaaacccagacccgccgccatggccgccgccggagctctccacgccagcggccgcatcctcctccctatgcgccgaaccccgagcaccccctggtcccatgtccgctcccacctccactgcaccaagccccctccttccccgctcccgcctccgccgcctccgccgccgccttcttcccccgggctgttctcgcgcttcacccctgccttcgcccctaccactaggaggagcggccccatcgggtccgggctagtcgcgtggtacctcggctccatcgaagctcggccggtgctgaccaagagcatcacggctgccaccatattcaccgtcgcagacctcacctcccagatgatcacacttgattctgatgggtcactcgatctaattaggactctacgcatggctagttacgggatgctgatctcaggacctagcctgcatttttggttcaactttatctcgagagcagtccccaaaaaggatttggtgaacaccttcaagaaaatgtttctagggcaggccgtttatggaccaattattaattgtgttttcttctcgtataatgcaggattacaaggtgagaccgtcccagagatcattgcaagactgaagcgggatttaattccaaccatcaaaagtgggctcatatactggcctctttgtgacttcatcactttcaagtttatccctgttcatttacagccgctagtaagcaattccttctcgtttctttggaccatctacataacatacatggctagcttaaagaaaccagaattggaggtgattgcgagctcgtagtcctccaatggttttcatggactgagttttctgtcagttatgtctgcgaggcaaaatctatatggccattacctggaagaatcatgcgactgtcagtaccactagctcatttatactttcatcagtcaaagaccacacagagatgaactgcttccttggtgtcttccattttcagtagggtatagtagtgtccacctggcttctaattgcctttgtttttggctaatctatatggccattacctggaagaaaatgacactaggcatttcttctcatttgcaaggtcttctattttgcgcaccaaattctctgtacccagttacactgatgttacatgaaacaatgcaaggtttatgcttgatatgtacataaaatgtattttttgttgacgaataaccccctttctgattactttctatttctaatcagccacacgtttttagatgtggccgattactttctattgagctcgttcctccagttgcaacaaattagtttctgatgtacacataataatgcctgtgattctgtttggactgaattctgaaacactgaagcctagctaagccatcttcagacttaaacattggtagagccaaggagactgcatgtgctgatcatcatgcctctcgctcttattttgaaaccttacgtttacattggacttggggaatcgctgccctgactctgattcagcagaagttgatgacgacactgttgcgccggagtctgagttggatgccatatcttgtttcctcctatcattcccagttgctagtgtcagctccaggttgaagtcttcaacgggagggggcttcttctcgcctgagttactgtaccattgcagatgatttgtctccaccattgcttcagcttgagtatcttctcctgcctgagcccggttcatcttaacaacgtgcatctccgtcatcagttgcttctgaacctggtatacacgatgcagttcgtttacctgctttgatcaaagaacatatatcatcgaactcttccaccaacatagaaaaagatgattctatctctaaccagacattgttggttgcgcttcgtttacctggtgtctgaatgtctgttcttgcctcatgatggccatcttcatttgtttcttctccatttctcaccaacccaaacaaagatcagcttcacctgtttcatcacagcctgattatgcaaaggttgttcttgtaacaattatgaattggcaatgggtatgagatgctgcatctgcattgcaatcattggaactttgtttatgcgcggttgcgtgtcttcttcttgtgatttatctctcccatctttttctcagcgtgtgatggtgacactgtctctcgtgtagcttctgaatgattgtacttcttcaatggctgaagtgtttttggttctcagatgggagtaaccagctttgccattttgtcaattaagttgcattagtgtgtcaatgagtatcctatgcaagcattaatgttatggctgtgtcttgtgtgtgatgtacctaacacattaatcacctgtctatgtgcacatgtgcactgctttgccacacggaaaatctataatgaatattttttgttgatatttaagaaatcttgtaaaaaactgtaccatttgtccatgaaatgcagatagcatgcgggctgtagattctagataatagaaactttatatgtttgtggggcaataggacaaactaagattcatgagtagaacataataaatgatgcaatgatatattcaggcaacatttaagaagtatttttatgtctggtctgaaattttgggtttccaaactcgcgtggtttgatattgtctcttaatgactgaaattccataaatattcaggttttgctatctgtactttctccgagtaacaggttgtagccattcactgagagcataaacaggaatcccccccctcgtacatgcccaaaatgaaacccacaaaattgtaacccctaaactgcaccgatgtttgatactcgtactttgaggcagcagaattattaaagaaaatataacataattctgcatctgttttcatgttctatatgcttggatgtgaggatgtcattatgcttcccgagaggaactactaaacagttgcaatacagaaggcaattctgaagagatcagagagctctaagagaccaagacgaagaccagctaccgttggcaaacagaaacatgccattgcaccttctaaaggttgagcatcagtcctttccctttgcacatagaattaccagaaatggaatgaagaatgaataaaaaaccaagcttcacgaacttctatagatgttatcatgcctcatgaagggctgaagtgcagagctttcaagttaagaatcatgagagatgaacaagacgaaggaaagatcaagacagactttatgctcacctctggtaaggatccctgttcctgaattcttcggaagaaggtaaaggcactctctctgtctcccttctctctgtttatctctctctctctctctctctgttgtttctcccacaagaagatctctcttgctagctacttctaggccaaggccaaatctttttggttctgttaagaagcaacaggttggcatgtatcaaatctggtgaggcagggaggggggaggaggggatttaagattctctcctgtcattagttttactgtcatggtggggccttgtgggcatgccaaacaaatccaagccaatttaggccaatggagttcatgcatgataaaggacccaaag

SEQ ID NO: 1443 - DNA, 4418 bp, Secale cereale
cgaccgaccgaccgtgcgtgtgcaggcgagtaggaaaaaggaagtcagctccttgtgtgcgcgtgtgtgtgttccagcgggcgggggaagaggaggaggagggatcaggggagttttgcctccggcaatggagatggccctccgggcgcagagcccgctctgctcccggagccacccggtgctcgtcgtgcgccccgccagcgccgccctcgcgcagtctatcgtgaagtgcagcaaatttacaagaagcaggctggttcgatgcgtggtagcaagttcagattatcctaagaggaatccgaggagatcatcagctccgaagcccaagggcactgcttctagaggatatgctccaagaccttctgccgaatcttggacctccacaaagaagattgaacatagcagcgccgatgaagacggtgatcttggcagaagcaatgggacgctcggtagcgacacaacagagcagacaagtacctctgaagaggaatctgaggtggaattcgcaggaaatgtttctaccagcgcggagctgaagggtgtgatcgaggccgagactgaagaagaggttgaccaaaagcagtcatctacattggcttccacctccatggatgttgagtcagttaatgaagcaacagagcagacaagtaccgcagatgaatcatctgaggttgacttctcaggaaatgtttctagcagcgtggtgctggagggtgtgaacgaggtcgagactgaacaagaggctgaccagaagcagtcatcagcattggcttccgcttccatggatgttgagtcaattgacagacaacttgaggagtaccgtgtcagaataagtgcactggtgggtgctgctagcactcaaggacagggccactcgatcattggtgttcatgaacacgacaaatcggtaaatagtctcagtgagcaagacatatcagccattgattttcctgaacaaagccagtcaggtgtcggtgttaccagagaagatccaacagaacaaaccaccagcaaacaggatgtcgctgccagcaataatctcgtggcaagaaaacattctttatcagaggatggtgttggggcaagtaaagttgccaatgaagagccattgattgctggcgatgaactgagggtaacagaggatgaagaacagcatgaacccgagatgcaagaacgggtacagaaggatgttgatcttcaagcgctaaagcgaaggcttgaagagcttgcagatggaaattattcgattgggaataagtgttttgtttttcctgaattggtggaagctgattcagttattgatctttacttaaatcgtagtatgtctgccttagcaagtgagcctgatattcttatcaaaggagcatttaatggctggagatggaaccatttcactgaaaaattgcataaaagtgaattaacaggggattggtggtgttgtaagctctacatacccaagcaggcatacagattagattttgtgttctttaatggtgacaccgtctatgaaaataacagttataacgatttcgtcctgcatatagaaagtgacattgatgaagactcatttgaggacttcttgcttgaagaaaagcaaatggaacttgagaggcttgctgcagaagaagctgaaagggaaagacaagctgaggaggagcgccggaaggaggaagaaagagccgcaatggaggctgatagagcacatgcaaaggctgaggttgagatgatgaggaataaattgcagcatgtgttgggtttagccagcagatatgccgataatctatggtatatagagcctaacacatacaaaggaggggatatggttcaattatactataatcgaagctcgggaccactaaagaataaaaatgagatttggttgcatgggggttacaataactggactgatggcccctctattgttgagaggctagtcaaatctgaagaaaaggatggtgattggtggtatggaaatgttactttacctgaaagcgcattggtgttggactgggtttttgctgatggaccgcctgggaatgcaagtaagtatgataacaatgggaagcgagattttcatgccgccgtttcaaaaagtatatccgaggacttgttttggatggaagaagaacataggatatttgaagggcttcaacgagaaagaaaagaaaaggaggatgctggtcggagaaaggctgagataactgcaaggatgaaagctgagatgaaggagaagactatgagagagtttcttctctcacagaaacacatcgtgtatactgagccacttgaagtacgtgcaggaaccacggttgatgttctatacaatccttctaacacagtgctgaatggaagtccagaagtttggttcagatgttcctttaaccgttggactcatccaagtggtcctttgccaccccaaaggatggtgaatgcagaaaatcgttcgcacttacaagctacagttaaggttcctctggatgcatatatgatggactttgttttctctgagtcggaagaaggtgggatatatgacaaccgggatgggatggactatcatattcctgtgtctgattccatggcaaaggaaccacctatgcatattgtgcacattgcagtagaaatggctcctattgcaaaggttgggggccttggcgatgttgttactagtctttcacgagctattcaagatttaggccacaaggttgaggttatttttccaaagtatgactgtttaaacctaagcaatgtgaaggatttacattgccgtcaaagttttacttggggtggtacagagataaaagtatggtttggaaaggttgaaggcatctctgtttatttcttggaaccgcagaatgggatgttttgggttggatgtgtctatggaaggaacgatgaaagtagatttggcttcttttgtcattctgccctggagtttcttctccagagtggctcttctccggatatcatacactgtcatgattggtcaagtgctccagttgcttggctgtacaagcaacagtatgttcataatgggctgccaaatggtcgggttgtatttaccatccacaatcttgaatttggagtacatcacatcggcaaagcaatggcacattgtgataaggctacaactgtttcgtacacatattcaaaggaagtgtctggacatggttctattgctcctcattatttcaaattccatggcattcgtaatggaattgattctgatatttgggatccatataatgacaacttcatcccggtccattatacttctgagaatgttgtcgagggtaagagttctgcgaaaagggcactgcaggagaagcttgggttacatcaaactgattcccctctagtcggaatcatcagtcggcttacagcccagaagggaattcaccttatcaaacatgcaatttatcgaactcttgaacgcaatggacaggtggttttactaggctcagctccagatcatcgcatacaaggtgactttagcaacttagctgctaaactacatggtgaatttgatggtcgtgtgaagctttgtttaacttatgacgagccactatcacatttaatatatgctggcgccgacttcattcttgtgccttccatcttcgaaccttgtggtttaacacagcttactgctatgcgatatggatccatcccaattgttcggaaaactggaggcctttatgataccgtttttgacgtggacgatgataaggatcgggcccgtgaacaaggccttgagccgaacggattcagcttcgaaggagctgacagcaatggcgtagattatgctctcgacagggcaatcaccacatggtatgacgcccgcgactggttccactccctctgcaagcgggtcatggagcaggattggtcctggaaccggcctgctctggactacatggaactgtaccattccgcgcgcaagaagtgagacttttggctgacagggagaagaacaaatgaagttcagggagtgggttcgccaggtttcgcgacatgccaatgcctcactgtatatgccgttctccgagagtcattctttcatcgaatgggctctgagaagaagtattgggtttctgcatacctccgcaagaggataaaatgcgagctgtttacttcatccagtgatcatgatatcgcagcatatgatgcgcacacgtggaatgtggcacacaaggaagttcattctggctagtcttcagtttttgcagacatgtaccgatgcaaatatgttcattttacggtactgtagtcctcgttcagatgtacatatattttgtaagctgttcgttagattcttagggccgacgctcagtgtagtttgattttctgcctcgtctctaataataaagtgcatatcacatggtgcatatcacgttggtatctcaaactcaatagtttttttt

SEQ ID NO: 1444 - DNA, 4432 bp, Triticum aestivum
gtcgggttttgatttttccctgggcaatggagatggctctccgggcgcagagcccgctctgctcccggagccgcccggtgctcctcgtgcggcccgccgtccctggcctcgcgcagtctatcgtcaagtgcagcagatttacaagaagcaggctcgttcggtgcatggtagcaagctcatatcccaagaggaatccgaggagatcatcagctcctaagcccaagggcactgcctccagagaatatgctccaagaccttctgccgaatcttggacctccacgaagaagactgaacatagcagcgctgatgaagacggtgatcttggcgcaagcaatgggacgctcagtagtgacacagcagagcagacaagtaccgcagaggaagaatacgaggtggaattcccaggaaatgtttctagcagcgtggagccgaagggtgtgaacgaggaagaggttgaccaaaagcagcctcctgcattgacttccacatccatggatgctgagtctgttaatgaagcaacggagcacacaagtaccgcaaatgaatcatctgaggttgacttctcaggaaatgtctctagcagcgtggtgctggaggtagtagatgaatctgagactgaagaagaggctgaccagaagcagtcatcagcatcttccacctccatggatgttgagtcaattgacagagaacttgaggggtaccgtgtcagaataagtgcactggtgggtgctagcacccaaggacaggaccaatcaattattggtgttcatgaacaagacaaatcggtaattacttccgatgagcaagacatatcagctgttgatgttcctgaacaaagccagtcagttgttgctgtcaccagagaagatacaacagaccaaaccaccagcgaacaggatatcactgaagcggtagtagaggagatagccagcaagaatctcgtggcaagaaaacattcttcatcagaagatggcgttggggcaaggaaacatgccaatgaagagccattggttgctggtgatggactgagggtaacagaggatgaagaacaacatgaaccagagatgcaagaacaggtaaagatggatgttgatcctcaagcactaaagcgaaggcttgaagagcttgcagataaaaattattcgattgggaataagtgttttgtttttcctgaattagtggaagctgattcagttattgatctttacttaaatcgtagcatgtcggccttagcaaatgagcctgatatccttatcaaaggggcattcaatggttggagatggaaccatttcactgaaaaattgcatagaagtgaattaacaggggattggtggtgttgtaagctctacctacccaagcaggcatacagattagactttgtgttctttaatggtgacactgtctatgaaaacaacagttataatgatttcgtcctgcatatagaaagtgacagggatgaacactcatttgaggacttcttgcttgaagaaaagcaaagggaacttgaaaggcttgctgcagaagaagctgaaagggaaagacaagccgaggaggagcgccggaaggaggaagaaagggccgcaatggaggctgacagggcacaggcaaaagctgaggttgagacgacgaggaataaattgcagcatgtgttgggtttagccagcagatatgtcgataatctatggtatatacagcctagcacatacaaaggaggggatagggtcagattgtactataatcgaagctcgagaccactaaagcataaaaatgagatttggttgcatgggggttacaataactggactgatgggccctctattgttgagagactagtcaaatctgaagaacaggatggtgattggtggtatgcaaatgttactctacctgaaagcgcattggtgtaggactgcgtattagctgatggatcacctgggaacgcaagcaagtatgataaacatgggaagcaagattttcatgctggcggttcaaagagcatatccgatgacttgttttgggtggaagaagaacgtaggatatttgaaaggcttcagcgagaaagaacagagaaggaggatgctggtcggagaaaggctgagataactgcaaggatgaaagctgagatgaaggagaagactatgagagagtttcttctctcacagaaacacattgtgtatactgagccacttgaagtacgtgcaggaaccacagttgatgttctatacaatccttctaacacagtgctgaatggaagtccagaagtttggttcagatgttcctttaatcgttggactcatccaagtggtcctttgccgccccaaaagatggtgaatgaagtaaatggttcacacttacaagctacagttagggttcctttggatgcatatatgatggactttgttttctctgagtcggaagaaggtgggatatatgacaaccgggatgggatggactatcatattcctgtgtctgattccacggcaaaggaaccacctatgcatattgtgcacattgcagtggaaatggctcctattgcaaaggttgggggccttggtgatgttgttactagtctttcacgagctattcaagattcaggccacaaggttgaggttatttttccaaagtatgactgtttaaatctaagcaatgtgaaggatttacattgccgtcaaagttttacttggggtggcacagagataaaagtatggtttggaaaggttgaaggcatctctgtttatttcttggaaccgcagaatgggatgttttgggttggatgtgtctatggaaagaacgatgaaagtagatttggtttcttttgtcattctgccctggagtttcttctccagagtggctcttctccagatatcatacactgtcatgattggtcaagtgctccagttgcttggctgtacaagcaacagtatgttcataatgggctgccaaatggtcgggttgtatttaccatccacaatcttgaatttggggtacatcacattggcaaagcaatggcacattgtgataaggctacaactgtttcgtacacatattcgaaggaagtgtctggacatggttctattgctcctcattatttcaaattccatggcattcgtaatggaattgattctgatatttgggatccctataatgacaacttcattccggtccattatacttctgagaatgttgttgagggtaagagttctgcaaaaagggcattgcaggagaagcttggattacatcaaactgattcccctctagtcggaatcatcagtcggcttacagcccagaagggaattcaccttatcaaacatgcaatttatcgaactcttgaacgcaatggacaggtggttttactaggctcagctccagatcatcgcatacaaggtgactttagcaacttagcagctaaactgcatggtgaatttgatggtcgtgtgaagctttgtttaacttatgacgagccactatcacatttaatatatgctggcgccgacttcattcttgtgccttccattttcgaaccttgtggtttaacacagcttactgctatgcgatatggatccatcccaattgttcggaaaactggaggcctttatgataccgtttttgatgtggacgatgataaggatcgggcccgtgaacaaggccttgagccgaacggattcagcttcgaaggagctgacagcaatggcgtagattatgctctcgacagggcgatcaccacatggtacgacgctcgcgactggtttcactccctctgcaagcgggtcatggagcaggattggtcctggaaccggcctgctctggactacatggaactgtaccattccacgcgcaagaactgagactttaagctggcagggagaagaacagatgaagttccgggagtgggtttgccaggttttgcgacatgccaatgtctcactgcatatgccgttctccggaagccattctttgggatctgagaagtattgggtttctgcatccctctgcgacaggctgagatgtgagctgtttactttatcccttgatcatgatatcgcagcatgtgacacgcagacgtcaaatgtggcacacgggaaagttcgttctagcgggagtcttcagttttcgcaaacatgtaccaatgcaaatatgttcattttacggttctgtagtccttgaagatgtacatattttgtaagctggcagttagattcttagggccgacgctcagtgtagtagtattattgtctgcctcgtctgaataataaagtgcatatcaaatggtgtagtatatcacgttggtatctcaaaactcgaaagcgtgttacattcggcagcaattgagcgtggggaagctgagctctctgttctgattctgctgcatgcgccgcgcacatctaattacgaaatgaaagaattggaatgaaaacctgcccgggcggccgctcga

SEQ ID NO: 1445 - DNA, 4114 bp, Triticum aestivum
caagctcagattatcccaagaggaatccgaggagatcatcagctcctaagcccaagggcactgcctccagaggatatgctccaagaccttctgccgaatcttggacctccacgaagaagactgaacatagcagcgctgatgaagacggtgatcttggcacaagcaatgggacgctcagtagtgagacaacagagcagacaagtaccgcagaggaagaatatgaggtggaattctcaggaaatgtttctagcagcgtggagctgaagggtgtgaacgaggaagaggttgaccaaaagcagcctcctgcattgtcttccacatccatggatgctgagtctgttaatgaagcaacagagcacacaagtaccgcagatgaatcatctgaggttgacttctcaggaaatgtttctagcagcgtggtgctggaggtagtagatgaatctgagactgaagaagaggctgaccagaagcagtcatcagcatcttccacctccatggatgttgagtcaattgacagagaacttgaggggtaccgtgtcagaataagtgcactggtgggtgctagcacccaaggacaggaccaatcaattattggtgttcatgaacaagacaaatcggtaattacttccgatgagcaagacatatcagctgttgatgttcctgaacaaagccagtcagttgttgctgtcaccagagaagatacaacagaacaaaccaccagcgaacaggatatcactgaagcggtagtagaggagatagccagcaagaatctcgtggcaagaaaacattcttcatcagaagatggcgttggggcaaggaaacatgccaatgaagagccattggttgctggtgatgaactgagggtaacagaggatgaagaacaacatgaaccagagatgcaagaacaggtaaagatggatgttgatcctcaagcactaaagcgaaggcttgaagagcttgcagataaaaattattcgattgggaataagtgttttgtttttcctgaattagtggaagctgattcagttattgatctttacttaaatcgtagcatgtcggccttagcaaatgagcctgatatccttatcaaaggggcattcaatggttggagatggaaccatttcactgaaaaattgcatagaagtgaattaacaggggattggtggtgttgtaagctctacctacccaagcaggcatacagattagactttgtgttctttaatggtgacactgtctatgaaaacaacagttataatgatttcgtcctgcatatagaaagtgacattgatgaacactcatttgaggacttcttgcttgaagaaaagcaaagggaacttgaaaggcttgctgcagaagaagctgaaagggaaagacaagccgaggaggagcgccggaaggaggaagaaagggccgcaatggaggctgacagggcacaggcaaaagctgaggttgagacgacgaggaataaattgcagcatgtgttgggtttagccagcagatatgccgataatctatggtatatacagcctagcacatacaaaggaggggatagggtcagattgtactataatcgaagctcgagaccactaaagcataaaaatgagatttggttgcatgggggttacaataactggactgatgggccctctattgttgagagactagtcaaatctgaagaaaaggatggtgattggtggtatgcaaatgttactctacctgaaagcgcattggtgttggactgggtttttgctgatggatcacctgggaacgcaagcaagtatgataacaatgggaagcaagattttcatgctgccgtttcaaagagcatatccgatgacttgttttgggtggaagaagaacgtaggatatttgaaaggcttcagcgagaaagaaaagaaaaggaggatgcttgtcggagaaaggctgagataactgcaaggatgaaagctgacatgaaggagaagactatgagagagtttcttctctcacagaaacacattgtgtatactgagccacttgaagtacgtgcaggaaccacagttgatgttctatacaatccttctaacacagtactgaatggaagtccagaagtttggttcagatgttcctttaaccgttggactcatccaagtggtcctttgccgccccaaaagatggtgaatgcagaaaatggttcacacttacaagctacagttagggttcctttggatgcatatatgatggactttgttttctctgaatcggaagaaggtgggatatatgacaaccgggatgggatggactatcatattcctgtgtctgattccatggcaaaggaaccacctatgcatattgtgcacattgcagtagaaatggctcctattgcaaaggtcgggggcctcggtgatgttgttactagtctttcacgagctattcaagatttaggccacaaggttgaggttatttttccaaagtatgactgtttaaacctaagcaatgtgaaggatttacattgccgtcaaagttttacttggggtggtacagagataaaagtatggtttggaaaggttgaaggcatctctgtttatttcttggaaccgcagaatgggatgttttgggttggatgtgtctatggaaagaacgatgaaagtagatttggcttcttttgtcattctgccctggagtttcttctccagagtggctcttctccagatatcatacactgtcatgattggtcaagtgctccagttgcttggctgtacaagcaacagtatgttcataatgggctgccaaatggtcgggttgtatttaccatccacaatcttgaatttggggtacatcacattggcaaagcaatggcacattgtgataaggctacaactgtttcgtacacatattcgaaggaagtgtctggacatggttctattgctcctcattatttcaaattccatggcattcgtaatggaattgattctgatatttgggatccctataatgacaacttcatcccggtccattatacttctgagaatgttgttgagggtaagagttctgcaaaaagggcattgcaggagaagcttggattacatcaaactgattcccctctagttggaatcatcagtcggcttacagcccagaagggaattcaccttatcaaacatgcaatttatcgaactcttgaacgcaatggacaggtggttttactaggctcagctccagatcatcgcatacaaggtgactttagcaacttagctgctaaactgcatggtgaatttgatggtcgcgtgaagctttgtttaacttatgacgagccactatcacatttaatatatgctggcgccgacttcattctcgtgccttccattttcgaaccttgtggtttaacacagcttactgctatgcgatatggatccatcccaattgttcggaaaactggaggcctttatgataccgtttttgacgtggacgatgataaggatcgggcctgtgaacaaggccttgagccgaacggattcagcttcgaaggagctgacagcaatggcgtagattatgctctcgacagggcgatcaccacatggtacgacgctcgcgactggtttcactccctctgcaagcgggtcatggagcaggattggtcctggaaccggcctgctctggactacatggaactgtaccattccgcgcgcaagaactgagactttaagctggcagggagaagaacagatgaagttccgggagtgggtttgccaggttttgcgacatgccaatgtctcactccatatgccgttctccggaagccattctttgggctctgagaagaagtattgggcttctgcatccctctgcgataggctgagatgtgagctgtttactttatccattgatcatgatatcgcagcatgtgacacgcagacgtcaaatgtggcacacggcaaagttcgttctagcgggagtcttcagttttcgcaaacatgtaccaatgcaaatatgttcattttacggttatgtagtccttgaagatgtacatattttgtaagctggcagttagattcttagggccgacgctcagtgtagtagtagtattattttctgcctcgtcttctgaataataaagtgcatatcaaatggtgtagta

SEQ ID NO: 1446 - DNA, 4200 bp, Hordeum vulgare
tattcagattatcctaagaggaatccgaggagatcgtcagctcctaagcccaagggcactgcctctagaggatatgctccaagaccttctgccgattcttggacctccaccaagaagattgaacatggcagcgctgatgaagacggtgatcttggcagaagcaacgggacgctcagtggtgacgcaacagagcaggcaagtaccgcggaagaagaatctggggtggaatttgcaggaaatgtttctagcagcgcggggctggaaggtgtggccgagactgaagaagaggctgaccaaaatcagcctcctgcattgtcttccacatccatggatgttgagtcagttaatgaagcaacagagcagacaattatcggagatgaatcatctgtggtggacttctcaggaaatgtttctggcagcgtggcattggaggtagtggatgagtctgagactgaagaagaggctgaccagaagcagtcatcatcattggcttccacctctatggattccgagtcaattgacagggaacttgaggggtaccgtgccagaataaatgcactggtgggtgcgagcactcaagaacaggaccaatcgattattggtgttcatgaccaagataaatcggtaattagtcccaatgagcaagacatatcagccgttgacgttcctgaacaaggcctgtcaggtgttggtgttaccagagaagatccaacaaaacaaaccaccagcaaacaggaaatcactgaagcagcagtggaggagatatccagcaagaatttcgtggcgagaaaacattctatatcaggagatggcgttgaggcaagtaaaaatgccaatcaacagcctttggttgatggcgatgaactgaagataacagaggacgaagaacagcatgaaccagagatgcaagaatatgtacggaaggatgttgatcttcaagcgctaaagcgaaggcttgaagagcttgcagatggaaattattcgattgggaataagtgttttgtttttcctgaattggtgaaagctgattcagttattgatctttacttaaatcgtagcatgtctgccttagcaagtgagcctgatattcttatcaaaggggcattcaatggttggagatggaaccatttcactgaaagattgcataaaagtgaattatcaggggattggtggtgttgtaagctatacatacccaagcaggcatacagattagactttgtgttctttaatggtgacaccgtctatgaaaataatagttataatgatttcgtcctgcatatagaaagtgacattgatgaacactcatttgaggacttcttgcttgaagaaaagcagagggaacttgaaaggcttgctgcagaagaagctgaaagagaaagacaagccgaggaggagcgccggaaggaggaagaaagggccgcaatggaggctgatagggcacaagcaaaggctgaggtcgagatgacgaggaataacttgcagcatgtgttgggtttagccagcagatatgccaataatctatggtatatagagcctaacacatacaaaggaggggatagggtcagattatactataatcgaagctcgggaccactaaagcataaaaatgagatttggttgcatgggagttacaataactggactgatgggccctctattgttgagaggctagtcaaatctgacgaacaggatggtgactggtggtatgcaaatgttactttacctgaaagcgcattggtgttggactgggtttttgctgatggaccacctgggaacgcaaggaagtatgataacaatgggaagcgagatttccatgctgctgtttcaaagagcatatccgaggacttgttttgggtgaaagaagaacataggatatttgaaaggcttcagcgagaaagaaaagagaaggaggatgctggtcggagaaaggctgagataactgcaaggatgaaagctgagatgaaggagaagactatgagagagtttcttctctcacagaaacacattgtgtatactgagccacttgaagtacgtgcaggaatgacagttgatgttctatacaatccttctaacacagtgctgaatggaagtccagaagtttggttcagatgttcctttaaccgttggactcatccaagtggtcctttgccaccgcaaaagatggtgaatgcagaaaatggttcacacttacaagctacagtcagggttcctttggatgcatatatgatggactttgttttctctgagtcggaagaaggtgggatgtatgacaaccgggatgggatggactatcatattcctgtgtctgattccatggcaaaggaaccacctatgcatattgtgcacattgcagtagaaatggctcctattgcaaaggttgggggcctgggcgacgttgttactagtctttcacgagctattcaagatttaggccacaaggttgaggttgtttttccaaagtatgactgtttaaacctaagcaatgtgaaggatttacattgccgtcaaagttttacttggggtggtacagagataaaagtatggtttggaaaggttgaaggcatctctgtttatttcttggaaccgcagaatgggatgttttgggttggatgtgtctatggaaggaacgatgaaagtagatttggcttcttttgtcattctgccctggagtttcttctccagagtggctcttctccagatatcatacactgtcatgattggtcaagtgctccagttgcttggctgtacaagcaacattatgttcataatgggctgccaaatggtcgggttgtatttaccatccacaatcttgaatttggagtacatcacatcggcaaagcaatggcacattgtgataaggctacaactgtttcatacacatattcaaaggaagtgtctgggcatggttctattgctcctcattatttcaaattccatggcattcgtaatggaattgattctgatatttgggatccctataatgacaacttcatcccggtccattatacttctgagaatgttgttgagggtaagagttctgcaaaaagggcattacaggagaagcttggcttacatcaaactgattcccctctagtcggaatcatcagtcggcttacagcccagaagggaattcaccttatcaaacatgcaatttatcgaactcttgaacgcaatggacaggtggttttactaggctcagctccagatcatcgcatacaaggtgactttagcaacttagctagtaaacttcacggtgaatttgatggtcgcgtgaagctttgtttaacttatgatgagccactatcacatttaatatatgctggtgccgacttcattcttgtgccttccattttcgaaccttgcggtttaacacaacttactgctatgcggtatggatccatcccaattgttcggaaaactggaggcctttatgacacggtttttgatgtggacgatgataaggatcgggcccgtgaacaaggccttgagccaaacggattcagcttcgaaggagctgacagcaatggcgtagattatgctcttgacagggcgatcacgacatggtacgacgcccgcggctggttccactccctctgcaagcgggtcatggagcaggattggtcctggaatcggcctgctctggactacatggaactgtaccattccgcgcgcaagaactgaaactttgagctggcggggagaggaacaaatgaagttcagggagtgtgtttgccaggtttcgcgacatgccaatgcctcactgtatatgccgttatccggaaagccattcttccgtcaaatgggctctgaggagaagtatagggcttctgcgtccctctgcgagaggctgaaatgtgagctgtttacttcatccattgatcatgatatcgcagcatgcgacgcgcacgcacacgacaaatgtggcacacggaaaagttcgttccagcgagagtcttcagtttattgcaaccatgtaccgatgcaaatatgttcccattttacggttctgtagttcttcagatgtacatattttgtaagctgtttgctagattcttagggccggcccacgctcagtgtagtttgattttctgcctcgtctaaataacaaagtgcatatcaaatggtgtagcccagctctatggttcttattctgctgcatgcgccgcgccattagcgacgattgagtggtcctcttcgacg

SEQ ID NO: 1447 - DNA, 850 bp, Avena sativa
tacacgtggtggtcgccttatccgccgccgcgatttctcgtggagcctatgccgcggttctgttcgtagctagctctagatcgaggcgcctcgtgcgtgcgcggccatggaagctctcgcatcctcaccccgcgctctcttctcccgcacggcctcgccgacgccgtccgtggcgaaatgggcgtcctcgtcggcaacgcgtccagctgccggccgtgtaagggccgccgccgccgccgagccggccggcgaggcgcagccggctgctgcctctgctgatggcgacgcggcgtcggcaccggcgcccaagaagatcctgaagaagaagcccgtctactccatgaagaaaggacaaatcgttcgcgtcgagaaagaaaagtacctaaacagcatcaactacctgtcagtggggcatccaccattttacaaggggctagactacatctacgaagaccgtggcgaggttctggacatcagaatcttcgaaaccggagagtatgccctgatcgcgtgggtaggtattccaacccctccggcatggttaccaacttatatgctcatcaagtccgacaaactcaactacgagagaatatgatggctagatgaacaactccattggatgacaggagaacagtattttgcgcatagaaggatgtcgctgtgtggcagtgttgtgccattgctccgtggctacatggggaaaagattgtaaatcgagtaacaagggtgaagatataaaaattgctgttgtatttaataagtgtgttgtttcacctctcttatttcttacactagccaaatgcttgtgtgttgctacagaagtttttgaattgactgagttagttattta

SEQ ID NO: 1448 - DNA, 775 bp, Avena sativa
cctatgccgcggttttcttcgtagctagctctagatcgagctgcctcgtgcgcgcgcggccatggaagctctcgcgtcctcaccccgcgctctcttctcccgcacggcctcgccgacgccgtccgtggcgaaatggggtcctcgtcggcaacgcgtccagctgccggccgtgtaagggccgccgccgccgagccggccggcgaggagaagccggctgccgtcgctgctgatggcgacgcggcgtcggcaccggcgcccaagaagatcctgaagaagaagcccgtttactccatgaagaaagggcaaatcgttcgcgtcgagaaagaaaagtacctaaacagcatcaactacctatcagtgggtcatccaccattttacaaggggctagactacatctacgaagaccgtggcgaggttctggacatcagaatcttcgaaaccggagagtatgcgctgatcgcgtgggttgggattccaacccctccggcatggctaccaacttatatgcttatcaagtccgacaaactcaactacgagagaatatgatggctagatgaacaactccattgggtgacaggagaacaatattttgtgcatagaaggatgtcactgtgcggcaatgttgtgccattgctccatggctacatggggaaaaggttgtaaatcgaataacaagggtgaagatataaaaaattgctgttgtatttaataagtgtgttgtttcacctctactttaaaaaaaaaaaaactaagagacacgcaacagggagcgcag

SEQ ID NO: 1449 - DNA, 994 bp, Triticum aestivum
acagcaatggaagctctcgcctcgtcgccgcgggctctcttcgcccgcaccgcctctccgacaacggcggtggccacgtcagcaagatggatgccgtcatcgagcaggcttgtcaaggccgccgccgccgccgagcccgccggcgaggccaagccggctgcggcagccgcgtcgccggcgcccaagaagatcctcaagaagaagcccgtctactccatgaagaaaggacagattgttcgcgtcgagaaagagaagtacctgaacagcatcaattacctgtcagtggggcacccacccttctacaaggggctagactacatatacgaagaccgcggcgaggttttggacatcagaatctttgaagagaccggagagtatgctctgatcgcgtgggtggggattccaaccccgccggcatggctcccaacttatatgctcatcaagtcagacaaacttgactacgagaggatatgattgttggatgagcagttgcaagggagaacgatgttctctgaataaatcaatgttgctatgtggccatgttgtgacattgctccatggatgcaaaacgaagtagttgtaaattgaagaaacaatagtgaaatatatccaaagtttttttatttaagcattttcttttccaccttttcaacgtttgaggttgttaacaatcataccatggatttgacatactgccactcttaaacttaacatgcctgaaataagatgcatttaaattagtctatgtctaaaaggtttgaattgacaaggttttgaacaatttatatgattttgattattagatccaatagtccatttaaattgcaaccttcctaacatatattttcccccttccatttagggctttttcggacatgtacttcaacattttggatgggtcgagaaatctgttcattcttctggcctgtctagaagaatactagattatgccccacgcgttgctacgggaaccttaataaaaacaaatgcataa

SEQ ID NO: 1450 - DNA, 867 bp, Triticum aestivum
agccacagctatggaagctctcgcctcgtcgccgcgggctctcttcgcccgcaccgcctctccgacaacggcggtggccacgtcagcaagatggatgccgtcatcgagcaggcttgtcaaggccgccgccgccgccgagcccgccggcgacgccaagccggctgcggcagccgcggcgccggcgcccaagaagatcctcaagaagaagcccgtctactccatgaagaaaggacagattgttcgcgtcgagaaagagaagtacctgaacagcatcaattacctgtcagtggggcacccacccttctacaaggggctagactacatatacgaagaccgcggtgaggttttggacatcagaatcttcgaagaaaccggagagtatgctctgatcgcgtgggtaggcattccaacaccgccggcatggctcccaacttatatgctcatcaagtcagacaaacttgactacgagaggatatgatcactggatgagcggttgcgagggagcacaatgttctcggcataaatcgatgttgttgtgtggcgatgttgtgacaatgctccatggatgcaaaacgaagtagctgtaaatcgaagaaacaatagtgaaatatatataaagttgttgtatttcagggtattttcaaaaaatccttcagtccatgtcatttcctcgggccccagttctagagtattcctcgaggggcctaacgcttacgtctacccgggtttcctgcacaaagtggtgccccaaactgggtctaaattataacctagaatttggcggttgttttaaacggtcttcattgggaaaattgttatcttggaatcttggagaaggaaaccttcactctggggtgggacacaagt

SEQ ID NO: 1451 - DNA, 775 bp, Triticum aestivum
gtgcaggttctcgtggatttttcccaactagctagagccacagccacagcaatggaagctctcgcctcgtcgccgcgggctctcttcgcccgcaccgccagtccgaccacggcgctggccacgccagcaagatggacgccgtcatcgaccaggcgtgtcaaggccgccgccgccgccgagccggccggcgaggccaagccggctgcggcagccgcgtcgccggcgcccaagaagatcctcaagaagaagcccgtctactccatgaagaaaggacagatcgtgcgagtcgagaaagagaagtacctgaacagcatcaattacctgtcagtggggcacccacccttctacaaggggctagactacatatacgaagaccgtggcgaggttttggacatcagaatcttcgaagaaaccggagagtatgctctgatcgcgtgggtagggattccaacaccaccagcatggctcccaacttatatgctcatcaagtcagacaaactcgactatgagaggatatgatcgccggatgagagattgcgagggagaacaatgttttgtgcataaattgatgtcgctatgtggtgatgttgtgacattgctccatggatacaagattaagcagttgtaaatcaaagaaacaatagtgaaatatatccaaagttgttatattttagcattttatttttcaccttttcaacgtttgatgtcgttgacaatcacataccacctgttttaacctcagcatgcctgaaataagacgcatttaaattaggct

SEQ ID NO: 1452 - DNA, 896 bp, Triticum aestivum
ggcccaaacacgctgtggcgctagttttccaatccagcctcacctcaccgccgtggccgccttatccgccgcacgcggtgcaggttctcgtggatttttcccaactagctagagccacagccacagcaatggaagctctcgcctcgtcgccgcgggctctcttcgcccgcaccgccagtccgaccacggcgctggccacgccagcaagatggacgccgtcatcgaccaggcgtgtcaaggccgccgccgccgccgagccggccggcgaggccaagccggctgcggcagccgcgtcgccggcgcccaagaagatcctcaagaagaagcccgtctactccatgaagaaaggacagatcgtgcgagtcgagaaagagaagtacctgaacagcatcaattacctgtcagtggggcacccacccttctacaaggggctagactacatatacgaagaccgtggcgaggttttggacatcagaatcttcgaagaaaccggagagtatgctctgatcgcgtgggtagggattccaacaccaccagcatggctcccaacttatatgctcatcaagtcagacaaactcgactatgagaggatatgatcgccggatgagagattgcgagggagaacaatgttttgtgcataaattgatgtcgctatgtggtgatgttgtgacattgctccatggatacaagattaagcagttgtaaatcaaagaaacaatagtgaaatatatccaaagttgttatattttagcattttatttttcaccttttcaacgtttgatgtcgttgacaatcacataccacctgttttaacctcagcatgcctgaaataagacgcatttaaattaggctacgtctaaatggtttgaattgacggggttttgaaccatttgatt

SEQ ID NO: 1453 - DNA, 1056 bp, Hordeum vulgare
ggcccaaacacactgcggcctctagctgctttccaatccagcctcagctcaccgccgtggccgccttatccggcgcgcgcggtgcagcttcgtcccagtggagattagagccacagctatggaagctctcgcctcgtcaccgcgggctctcttcgccggcaccgcctctccggcgacggcgcttgccacgccagcaagatggacgccgtcatcgaccaggcgtgtcaaggccgccgccgccgccgagccggccggcgaggccaagccagctgccgcagccgcgtcgccggcgcccaagaagatcctcaagaagaagcccgtatactccatgaagaaaggacagatcgtgcgggtggagaaagaaaagtacctgaacagcatcaattacctgtcagtggggcacccacccttctacaaggggctggactacatatatgaagaccgcggcgaggttttggacatcagaatcttcgaagaaaccggagagtatgctctgatcgcgtgggtcgggattcccaccccgccggcatggctcccaacctatatgctcatcaagtcggacaaactcgactacgagaggatatgatcgctggatgagcggttgcgagggaggataatgttctgtgcataaatctattcattatgtggtgacgctgtgacattgctccacggatgcaaaacgaaacagttgtggatggaagaaacaatagtgaaattgattcaaaaatgttttactacatccgatgcataagaaccagtgttttaaatagtgagctatgccaaatagccgcaaccctccaaatcagctatagctaggctatagccttctacttcgtaagtttataaccctgctatacctgggatataaccagctatttaaaactttgataagaagtgtggcagttttgaactaaacccagttcagaacttcaacaattattttggatcagttagtagtagtattttattttgcgccttgtcaagttttgaggtagtcgacaatcggatgatggatcccacatacttccacttttaaccttaatatgcttgaaataa

SEQ ID NO: 1454 - DNA, 916 bp, Triticum aestivum
cctccctgccgcatttcgagcgatggccgactccgccgccctctcctcctccctcccgcgctcgctggcgtccaggaggcccctctcctcccctctccgcggcggcgggaggccccggtccccgcgccgctgccgccccggctcgcggctgcgcgcccgggccaggaagggcgagcccgaggacctctacgggccgtacccgtgggagcagcccctggatctcaccactgggttcgatatcgagtgggtgcaagaggataaaatcacgctcttcacttccgatgggcttgttcagataggcggtaacatggtgcctcgccgagtcaccgcttccgagaagaggcaacaaaaaggaaaaggcaaactccgccggtttcaggagagctcttacatggatccaaatcaaagtctttgccttggagcactatttaacattgcagctacaaatggcctagacatgggtagaagattatgcatctttggcttctgtcggtctattgaaatgctgagcgatgtggtagaagataccgtcttggagcatggtggcgagattgtgactgcagagaaggcgagtagtgacggccttcaggagaagctgaccatgtcggtggcggttccgttgctgtggggcgtccctccggcatcggagaccctccatgtcgctgtgcgaagcggtggaggcatcgtggacaagatctactggcagtgggacctgttctaagagctcagagcccccagacactggttgacaaataatccaccccacccacactgtatatatgatccttaactggcctggctgcacacattgtgtcagcatgcaactgtgttcgtgtccttgtgcgcaaccagcaacaaacatggtgtatacctgtacagacctgattcctctggtgcatataaataaataaaaagg

SEQ ID NO: 1455 - DNA, 1010 bp, Triticum aestivum
tgcgacccacccgttccgtccacgcccaccacacctcgcccccgccgtcccccgataaacatccgccgatctttcctccctccctccgtccgcgatccctccctgccgcatttcgagcgatggccgactccgccgccctctcctcctccctcccgcgctcgctggcgtccaggaggcccctctcctcccctctccgcggcggcgggaggccccggtccccgcgccgctgccgccccggctcgcggctgcgcgcccgggccaggaagggcgagcccgaggacctctacgggccgtacccgtgggagcagcccctggatctcaccactgggttcgatatcgagtgggtgcaagaggataaaatcacgctcttcacttccgatgggctggttcagataggcggtaacatggtgcctcgccgagtcaccgcttccgagaagaggcaacaaaaaggaaaaggcaaactccgccggtttcaggagagctcttacatggatccaaatcaaagtctttgccttggagcactgtttaacatagcagctacaaatggcctagacatgggtagaagattatgcatctttggcttctgtcggtccattgaaatgctaagcgatgtggtggaagataccgtcttggagcatggtggcgagattgtcactgcagagaaggcgagtagtgacggccttcaggagaagctgaccatgtcggtggcggttccgttgctgtggggcgtccctccggcatcggagaccctccatgtcgccgtgcggagcggcggaggcatcgtggacaagatctactggcagtgggacctgttctaagagcccagagcccccagacactggttgacaaataatccaccccacccacactgtatatatgatccttaactggcctggctgcacacattgtgtcagcatgcaactgtgttcgtgtccttgtgcgcaaccagcaacaaacttggtgtatacctgtacagacctgattcctctggtgcatataaataaataaaa

SEQ ID NO: 1456 - DNA, 1035 bp, Avena sativa
ccacgccagccacacctcgcccccgccgcccctccataaaaatccaccgaattcttcttccgcgatcccccccgcacggcttctccccgccctctccccaccacatttcccatggccgattccgccgccctctccaccgcctcctcctcctccctgccccgctcgctggcgtccaggaggcccctctcctccccgctccacggcggccggccccgatccccgcgccgctgccgcttcgggtcgcggctgcgggcccgggcgaggaagggcgatcccgaggacatctacgggccctacccgtgggagcagcccttggatctcaccactgggttcgatatcgagtgggtgcaggaagacaagatcacactcttcacttccgatgggctcgttcagataggcggttccatggtgcctcgtcgagttactgcctccgagaagaggcaacaaaaagcaaaaggcacaaataaaatccggcggtttcaggagagctcttacatggatccaaatcaaagtctttgccttggagcactctttaacatagcagcgacaaatggtctagacatgggtagaagattgtgcatatttggcttctgccggtctatcgaaatgctaagcgatgtggtggaagatacagtattggagcatggtggtgagattgtcaccgcggagaaggcgagcagcgatgggcttcaggagaagctgaccatgtccgtggcggttccgttgctgtggggcgtccctccagcctcggagaccctccatgtcgcggtgaggagtggtggaggtatcgtggacaagatctactggcagtgggacttgttctaagaagcccagagcccagacattaacaaacaattccatctcacactgtatatatgctccttccctctaattggccgcacatattgcgcctctatacctgtacagccctgattcctctcttgctgtcgagcctgtcatggcatcgtgcatataaataaataaataaaaaggctccgagctcacagctagctcatcttcaacaaaaaaaaaaaa

SEQ ID NO: 1457 - DNA, 1202 bp, Secale cereale
tgccttgcacgtctccacgtcgacctccatccgccccaaaatcaacgccagccacggccacgatccaccggacccctccgtaccctcgttagggcccaccgggaaaactagcccgccgaaagaaaggcaccgcggccaagcccaaggtcccacccgcccgggacgaatcccaccgcccacccacaccctcgcccccgccgccccctccccgataaaaatccgccgatccttccttcctccctcctcccgcgatccccctgccgcatttcgagcgatggccgactccgccgccctctcctcctccctcccgcgctcgctggcgtccaggaggcccctctcctccccgctccacggcggcaggccccgatccccgcgccgctgccgccccggctcgcggctgcgcgcccgggccaggaagggcgagcccgaggacctctacgggccctacccgtgggagcagcccctggatctcaccactgggttcgatatcgagtgggtgcaggaggataagatcacgctcttcacttccgatgggcttgttcagataggcggtaacatggtgcctcgtcgagtcaccgcttccgagaagaggcaacaaaaaggaaaaggcaaactccgccggtttcaggagagctcttacatggatccaaatcaaagtctttgccttggagcactgtttaatatagcagctacaaatggcctagacatgggtagaagattatgcatctttggcttttgtcggtccattgaaatgctaagcgatgtggtggaagatacagtattggagcatggcggcgagattgttacagcggagaaggcgagcagcgacggccttcaggagaagctgaccatgtcggtggcggttccgttgctgtggggcgtccctccggcatcggagaccctccatgtggccgtgcggagcggcggaggcatcgtggacaagatctactggcagtgggacctgttctaaaagcccagagcccccagacactggttgacaaataatccaccccacccacactgtatatatgatccttaactggcctggctgcacatattgtgtcagcatgcaacaacctttgttcgtgtccttgtgcgcaaccagcaaacttggtgtaatacctgtacagacagacctgattcctctggtgcatataaataaataaaaagggttccgaattcacagctcaaaaaaaaaaaaa

SEQ ID NO: 1458 - DNA, 1018 bp, Hordeum vulgare
aaatcaacgcccaccacacctcgcccccgccgcccccccacgataaaaatccttccttgctccttccgcgatcctcccctccctgccgcatttcgatcgatggccgactccgccgccctctcctcctccctcccgcgctcgctggcgtccaggcggcccctctcatcccctccccgcggcggcggcggcggcggcagcgggaggccacggtccccgcgccgctgccgccccggatcgcggctgcgcgcccgggccaggaagggcgagcccgaggacctctacgggccgtacccctgggagcagcccctggatctcaccactgggttcgatatcgagtgggtgcaggaggataaaatcacgctcttcacttccgatgggcttgttcagataggcggcaacatggtgcctcgtcgagtctctgcttccgagaagaggcaacaaaaaggaaaaggcaaattacgccggtttcaggagagctcctacatggatccaaatcaaagtctgtgccttggagcactgtttaacattgcagcgacaaatgggctagacatgggtagaagattatgcatctttggcttctgtcggtctattgaaatgctgagcgatgtggtggaagatacagtattggagcacggcggcgagattgtcattgcagagaaggcgagcagcgacggcctccaggagaagctgaccatgtcggtggcggttccgttgctgtggggagtccctccggcatcggagaccctccatgtggccgtgcggagcggcggaggcatcgttgacaagatctactggcagtgggacctgttctaagagcccaggccccccagacattggttgacaaataatccaccccacccacactgtatatatgatccttaactggcctggctgcacacattgtgtcagcatgcaacaacctgtgttggtgtccttgtgcgcaaccagcaaacttggtgtatacctgtacagaccgacctgattcctctggtgcatataaataaataaaaagggttcc

SEQ ID NO: 1459 - DNA, 1012 bp, Pseudoroegneria spicata
tccacgcccaccacacctcgcccccgccgccccccgataaaaatccgccgatctttccttcctccttccgcgatccttcctcctctccccctgccgcatttccaacgatggccgattccgccgccctctcctcctccctcccgcgctcgctggcgtccaggaggcctctctcctcccctctccatggcggcaggccccgatccccgcgccgctgccgccccggctcgcggctgcgcgcccgggcgaggaagggcgagcctgaggacctctacgggccgtacccgtgggagcagcccctggatctcaccactgggttcgatatcgagtgggtgcaagaggataaaatcacgctcttcacttccgatgggcttgttcagataggtggtaacatggtgcctcgtcgagtcacagcttccgagaagaggcaacaaaaaggaaaaggcaaactccaccggtttcaggagagctcttacatggatccaaatcaaagtctttgccttggagcactgtttaatatagcagctacaaatggcctagacatgggtagaagattatgcatctttggcttttgtcggtccattgaaatgctaagcgatgtggtggaagatactgtcttggagcatggtggcgagattgtcacagcagagaaggcgagcagcgacggccttcaggagaagctgaccatgtcggtggcggttccgttgctgtggggcgtccctccggcatcggagaccctccatgtcgccgtgcggagcggcggaggcatcgtggacaagatctactggcagtgggacctgttctaagagcccacagctcccagacattggttgacaaataatccaccccacccacactgtatatatgatccttaactggcctggctgcacacattgtgtcagcatgcaactgtgttcgtgcccctgtgcgcaaccagcaaacttcttgcatacctgtacagacagacctgattcctctggtgcatatataaataaataaaagggttccgaattca

SEQ ID NO: 1460 - DNA, 1223 bp, Panicum virgatum
ccacgaccaccacaggaaaaagacgagagcgcgccgacctcacctttaccataaaatccctcggcttttatccgcgatcggcgatcccccactgccgcgcgtgttctctcctcgccttccccgtcatttcccatggccgattccgccgcgttgtccaccgcctcctcctccctcccccgctcgctggcgtccaggaggcccctctcctcccctctccacgcaaggtcccggctcctccgccgcagccggtccggatcgcggtcgctccaccggctgcgagctcgggcggggaaggacgatccggaggacctctacgggccctacccctgggaccagcccctggatctcacctccgggttcgacattcagtgggtgccggaagacagggtcacactcttcacttcggatgggctggtccaaattgggggttccctggttcctcgtcgagttagttcttctgagaagaggcaacagaaattgaagagtaaacaaaagttgcgcaggtttcaagagagctcctacatggatccaaatcaaagtctttgtcttggagcactatttaacatagcggcaacaaacggtctggacatgggcagaagattatgcatctttggcttttgtcgttccattgaaatgctaagtgatgtggtggaagatacagtattggagcatggtggtgaggttgtcgccgcagaaaaggcgagcaatgacgggctccaggagaagctaaccatgtctgtcgcggtaccattgctctggggtgttcctccagcatcagagaccctccatgtcgccgtgcggagcggtggaggtatcgtggacaagatctattggcagtggaacttattctagacgtccagagccaaaacgttaacaaaaattgattcacgctgtatatatactctcactctaattcgctgcacgcattgtgccagcaattgtccattgtgcagaaactgtaaacttaatctctactattatgattggtaggttgcataagagcctacccaggcttggatatttggtagccttagttagccttagtaggaaacgcaaatgcggctcgtatgtgcaggctgcacatcgtcccggctgatcaagtttcggctctagtttagctacaacagtttagcctagggagcaatgcagtatgtaaacaaaatcttatgtgggtcaacacaagatattcagccaaccaaataaactcacaaaatagtaaagcc

SEQ ID NO: 1461 - DNA, 1175 bp, Oryza sativa
gataaaacaccccaaccgggtacgggctaatctgaccccttcattctttcttaaagctaccaaccaacggcccagatccaacatcctcctcctgtggccaagaacaaaaaccgaccaagagaccaagcgccggccaccacaagaaaaaaagagcgcgcacgcatcgcctccccaaaaaatccacccatttttccgcgatcccgtgcgcatctcatcgcccccacctcgtccgccatggccgattccgccgcagccgcatcctcctccctcccccgctcgctggcgtccaggaggccgctgccctcctcccctctccgcggcgggaggccccggtctccccgccgctgccgcttcgggtcccgctcgctccaccggctgcgagctcgagctgggaaggacgatcccgaggatctgtatgggccctacccatgggatcagtccttggatctcaccactggcctcgatattcagtgggtgccagaagatagagtcacactgttcacttctgatgggcttgttcaaatagggggttccctggttcctcgtcgaattactccatcagagaagaggcaacgaaaagtaaaaggtatacaaaatatccaacggtttcaggagagctcgtacatggacccaaatcaaagtctttgccttggagcactatttaacatagcagcaacaaatggtctagatatgggaagaagactatgcatctttggcttttgtcgctctattgaaatgctaagtgatgtagtggaagatacagtattggagcatggtggtgaggttgtcacggcagagaaggcaagcaaagatggcctccaggagaagttgaccatgtctgttgcagtgccattgttgtggggtgttcctccagcatcagagaccctccatgtcgcggtgcggagcggtggaggcattgtggagaagatctactggcaatgggacttattttaaaagtcccaagccgtccagtcattaacaaatgatccatgccacggtgtaaatactcattcagtctaattcgctgctcgcattgtgtcagcaattgtaaattgtgcatatatgtaaacagaaaactttggaatctctatacatgtacagacatggtcacacccctgcatataagaaactgtgagttaacagctcaacttctacttttatccttgttttaatat

SEQ ID NO: 1462 - DNA, 987 bp, Oryza sativa
aaaaaatccacccatttttccgcgatcccgtgcgcatctcatcgcccccacctcgtccgccatggccgattccgccgcagccgcatcctcctccctcccccgctcgctggcgtccaggaggccgctgccctcctcccctctccgcggcgggaggccccggtctccccgccgctgccgcttcgggtcccgctcgctccaccggctgcgagctcgagctgggaaggacgatcccgaggatctgtatgggccctacccatgggatcagtccttggatctcaccactggcctcgatattcagtgggtgccagaagatagagtcacactgttcacttctgatgggcttgttcaaatagggggttccctggttcctcgtcgaattactccatcagagaagaggcaacgaaaagtaaaaggtatacaaaatatccaacggtttcaggagagctcgtacatggacccaaatcaaagtctttgccttggagcactatttaacatagcagcaacaaatggtctagatatgggaagaagactatgcatctttggcttttgtcgctctattgaaatgctaagtgatgtagtggaagatacagtattggagcatggtggtgaggttgtcacggcagagaaggcaagcaaagatggcctccaggagaagttgaccatgtctgttgcagtgccattgttgtggggtgttcctccagcatcagagaccctccatgtcgcggtgcggagcggtggaggcattgtggagaagatctactggcaatgggacttattttaaaagtcccaagccgtccagtcattaacaaatgatccatgccacggtgtaaatactcattcagtctaattcgctgctcgcattgtgtcagcaattgtaaattgtgcatatatgtaaacagaaaactttggaatctctatacatgtacagacatggtcacacccctgcatataagaaactgtgagttaacagctcaacttctactttta

SEQ ID NO: 1463 - DNA, 1113 bp, Setaria italica
agaaagggaacccaccaccgccaagcaaagctccggccggaaccaagtccaccacctcccgggaaggggaatccacgaccaccacaggaaaaagacgagcgcgccgaccgtaaccaaacatccccctcgggcttttatccgcgatcggcgatcccccagtgccgtgctgccgctgccgcgttttctgactcctcgccttcgccattcccatggccgattccgccgcgctctcctccgcctcctcctccctcccccgctcgctggcgtccaggaggcccctctcctcccctctccacgccaggtcccggcccctccgccgcggcaggtccggatcgcggtcgctccaccggttgcgagctcgggcggggaaggacgatccggaggacctctacgggccgtacccctgggaccaatccctggatctcaccaccgggttcgacattcagtgggtgccagaagacagggtcacactgttcacttcggatgggctcgtccaaattgggggttccttggttccccgtcgagttagttcttctgagaagaggcaacggaaattaaagagtacaccaaagttgcgccgtttccaggagagctcttacatggatcctaatcaaagtctttgtcttggagcactatttaacatagcagcaacaaatggcctagacatgggcagaagattatgcatcttcggcttttgtcgttccattgaaatgctaagtgatgtagtggaagatacagtattggagcatggtggtgaggttgtcaccgcagagaaggcgagcaatgacggcctccaggagaagctaacaatgtctgttgcagtaccattgctgtggggtgttcctccagcgtcagagaccctccatgtcgcggtgcggagcggtgggggcatcgtcgacaagatctattggcagtgggacttattctagatgtccagagccgaaacattaacaaaattgattctacgctgtacatatactccactctaatccgctgcacgctttgtgccaccgattgtgcattgtgcagaaactgtgaactcaatctctacctgtacagacccggtcaccattgtgcatatactcaattgtcatttttagtttgtaccttttt

SEQ ID NO: 1464 - DNA, 1098 bp, Sorghum bicolor
ccggcgaaaacgaacaagtccacgtccaccacctctcgggaatccacgaccaccacaggaaaaagagacgagcgcggcgcccctttatccgcgatcacctgtgttcctcgctgccgctgcatcttcttcggacccgcctcgcgcagtgcaccgttcccatggccgattcagccgcgctctccacctccctcccccgctcgctggcgtccaggaggcccctctcgtcccctctccacgccagggccagagcccgctcccagctcgattcgcgctcgctccaccggttgcgtgctcgggcggggaaggacgatccggaggacctctacggaccctacccatgggaccagcccttggatctcaccactgggttcgacattcagtgggtgccagaagacagagtcacgctgttcacttctgatgggctgatccaaattgggggttccctggttcctcgccgagttagtgcttctgagaagaggcaacggaaactgaaaagcgcacaaaagttgcgccggtttcaggagagctcttacatggatccaaatcaaagtctttgccttggagcactatttaacatagcagcaacaaatggcctagacatgggcagaagattatgcatctttggcttttgtcgttctattgaaatgttaagcgatgtagtggaagatacagtattggagcatggtggcgaggttgtcactgcagagaaagcaagcaatgacggcctccaggagaagctaatcatgtctgtcgcagtaccattgctgtggggtgttcctccagcatcagagaccctccatgtcgctgtgcggagcggtggaggtattgtcgataagatctattggcagtgggacttattctaggatgtccggagccaaaacgttaacaaaattgattccacgatgtatatacatatatctctctaattctctgcacgcattgtgcaggaagtgtaaacttagtatctacctgtacagtcccggtcacccttgtgcatatataaaaaaactctggggccacgtctcatttttcatgcatccgtattttgaatgtcaatttcttggccacctaaacctaaacacacaatactacaactac

SEQ ID NO: 1465 - DNA, 1313 bp, Sorghum bicolor
ccgagatccaacgtgccttgttgtggacaccaacgccaccggaacaaagaaacagaagacgacgcacggccaagcagaggcggcaccaggcaggcagaggcaccggcgaaaacgaacaagtccacgtccaccacctctcgggaatccacgaccaccacaggaaaaagagacgagcgcggcgcccctttatccgcgatcacctgtgttcctcgctgccgctgcatcttcttcggacccgcctcgcgcagtgcaccgttcccatggccgattcagccgcgctctccacctccctcccccgctcgctggcgtccaggaggcccctctcgtcccctctccacgccagggccagagcccgctcccagctcgattcgcgctcgctccaccggttgcgtgctcgggcggggaaggacgatccggaggacctctacggaccctacccatgggaccagcccttggatctcaccactgggttcgacattcagtgggtgccagaagacagagtcacgctgttcacttctgatgggctgatccaaattgggggttccctggttcctcgccgagttagtgcttctgagaagaggcaacggaaactgaaaagcgcacaaaagttgcgccggtttcaggagagctcttacatggatccaaatcaaagtctttgccttggagcactatttaacatagcagcaacaaatggcctagacatgggcagaagattatgcatctttggcttttgtcgttctattgaaatgttaagcgatgtagtggaagatacagtattggagcatggtggcgaggttgtcactgcagagaaagcaagcaatgacggcctccaggagaagctaatcatgtctgtcgcagtaccattgctgtggggtgttcctccagcatcagagaccctccatgtcgctgtgcggagcggtggaggtattgtcgataagatctattggcagtgggacttattctaggatgtccggagccaaaacgttaacaaaattgattccacgatgtatatacatatatctctctaattctctgcacgcattgtgcaggaagtgtaaacttagtatctacctgtacagtcccggtcacccttgtgcatatataaaaaaactctggggccacgtctcatttttcatgcatccgtattttgaatgtcaatttcttggccacctaaacctaaacacacaatactacaactacaatagtgaggttcaatcaaaagacatgaatacggaatgaatcatttgctcgtatcgttatctttgccttcgttatttatgatgaatgcctgggtcgatggatcctctagcttt

SEQ ID NO: 1466 - DNA, 934 bp, Saccharum officinarum
tgaaaaaaggcccccccacgcgtccggccaaaacgaagaagtccaccactctctcttttattccacgaccaccacaggattccgaaagagagacgagcgcgccgccctttatacgcgatcacctgcgctcctcgctgccgcggcatcttcttcttgacccgcctcgcgcaccattcccatggccgattcagccgcgctctccacctcccttccccgctcgctggcgtccaggacgcccctctcgtcccctctccacgccagggccagagcccgctcccagctcggatcgcgctcgctccaccggttgcgtgctcgggcggggaaggacgatccggaggacctctacgggccctacccatgggaccagcccttggatctcaccactgggttcgacattcagtgggtgccagaagacagagtcaccctgttcacttctgatggcctgatccaaattgggggttccctggttcctcgtcgagttagtgcttccgagaagaggcaacggaaaatgaagagtgcacaaaagttgcgccggtttcaggagagctcttacatggatccaaatcaaagtctttgccttggagcactatttaacatagcagcaacaaatggcctagacatgggcagaagattatgcatctttggcttttgtcgttctattgaaatgttaagcgatgtggtggaagatacagtattggagcatggtggcgaggttgtcactgcagagaaggcaagcaatgacggcctccaggagaagctaaccatgtccgtcgcagtaccattgctgtggggtgttcctccagcatcagagaccctccatgtcgctgtgcggagcggtggcggtattgttgataagatctattggcagtgggacttattctaggatgtccggagccaaaacgttaacaaaattgattccacgatgtaaatatat

SEQ ID NO: 1467 - DNA, 997 bp, Zea mays
acgacaaccacaggaaaaaggagacgaccgcgccggcgccgcccattaatttctccccttctatccgcgatcacctctcctcgctgccgcggcatcttcttctgggtcctggcccgtcctcgtcgcaccattccatggccgattcagccgcgctctccacctccctcccccgctctctggcgtccaggaggcccctctcgtcgcctctccacgccagagcccgggcccgctcccagcgccgctgccggctcggatcgcgctcgctccaccggttgcgtgctcgggcgggaaaggacgacccggaggacctctacgggccctacccctgggaccagcccttggatctcaccgctgggtccgacattcaatgggtgcctgaagacagagtcacgctattcacttctgatgggctgatccagattgggggttccttggttcctcgtcgagtttctgcttctgagaagaggcaacggaaactgaagagtggacaaaagttgcgccggtttcaggagagctcttacatggatccaaatcaaagtctttgccttggagcactatttaacatagcagcaacaaatggcctagacatgggcagaagattatgcatctttggcttttgccgttctattgaaatgttaagcgatgtagtggaagatacggtattggagcatggcggtgaggttgtcactgcagagaaggcaagcagtaacggcctccaggagaagctaaccatgtctgttgcagtaccattgctgtggggcgttcctccagcatcagagaccctccatgtcgcggtgcggagcggtggaggtattgtcgataagatctattggcagtgggacttattctagatgtccagcgttaacaaaattggttccaagatgtatatgtctctctaattttctgcacgcgttgtgcagcaactgtaaacttagtctctacctgtacagacccggtcacccttgtgcatatatataaaagaactttgggatcacaa

SEQ ID NO: 1468 - DNA, 831 bp, Triticum aestivum
ccctctcctcccctctccgcggcggcgggaggccccggtccccgcgccgctgccgccccggctcgcggctgcgcgcccgggccaggaagggcgagcccgaggacctctacgggccgtacccgtgggagcagcccctggatctcaccactgggttcgatatcgagtgggtgcaagaggataaaatcacgctcttcacttccgatgggctggttcagataggcggtaacatggtgcctcgccgagtcaccgcttccgagaagaggcaacaaaaaggaaaaggcaaactccgccggtttcaggagagctcttacatggatccaaatcaaagtctttgccttggagcactgtttaacatagcagctacaaatggcctagacatgggtagaagattatgcatctttggcttctgtcggtccattgaaatgctaagcgatgtggtggaagataccgtcttggagcatggtggcgagattgtcactgcagagaaggcaagcagtgacggccttcaggagaagctgaccatgtcggtggcggttccagttgctgtggggcgtccctccggcatcggagaccctccatgtcgccgtgcggagcggcggaggcatcgtggacaagatctactggcagtgggacctgttctaagagcccagagcccccagatactggttgacaaataatccaccccacccacactgtatatatgatccttaactggcctggctgcacacattgtggcagcatgcaattgtgttcgtgtccttgtgcgcaaccagcaaacttggtgtatacctgtacagacctgattcctctggtgcatataaataaataaaa

SEQ ID NO: 1469 - DNA, 2375 bp, Secale cereale
cccctccccggcccgatggccgacccgcggctcctcctccccaggatcctctgcgtcgtcgccgccgccgccttctgcgccctcctcccggcgcccgtctccgccatccggaaggacactggttttgctgcacccatcatctgcaggagaactgttcaaggccggcatttgatatcggatgataatggttatgtatgttctgccctttcaatcgatccatggtctcgctgctgcccacaaacaggaggacgcttctcctgtcagggctgcaaccttgattcgcagtgctgcaattcttacgagtattgtgtttcttgctgcttgaatccttccaggaccaaggaagcagatgtgctgaagttgaaggtagctaagccagttactgctggaacttacaccaatatcttcgatttctgcatgggaagatgccgccatagctctgcaagcgtggtccatgaaaatgcatatttgagtgatttccatcattgctttctggtgcagcaaaattcgtcggcaggatcaactgaatctaattttggatcaaggctggatggcattaacgtcattttgggaaggcagggggaaacgtgtagttctgcatgcagagcaaaaggacaatcatgtgttccaagcaggctttctgaattgaacaaatgtcagattttgcagaaatatatgagatgcaaaaatggttgctttcccagtcttgggcccgatcaacctgccgaagttgtagacgaagctccaaaaaatttgaatccaggagcatgcttgtatatgcagatggatgaccgcctcacctgcgatggctcacatcaacatacccgaaggctctgtccttgtgcatgaaacgatggaaaaaaagtggcagtcataacagagtcacttgccaggaaacaagcggaggtaatctgctgaaagctgacggcccaaaatggcatgaccatttccgcaccaagtttccaaatgggaaaagagaacatattttcgctttgtcctacccatgcagtttatcttttgcatgtctggactcaagcgttcgtgtccagagcaagcagattctcaaacacttatctttatagtaatatatatggtcacaaatttccatgcatgttcagtacaaaaacagccaaaaccaactacagaaacatgacattttttaaaaacaactgccccatgacagcatcatcacaaacttccacgctccttaaaaggagtagtcgggcttgaaatctgtcaagctctttggcctgcccctgcctttgttgtcatccttattattctgaccagtggcactgcccgtgtcagcctcctcatctgctcctgctgcttcgtcttcttcgcagtcgaaggcggggtgagtgaagatgttctccaggagccgcgtccccctgagggcattggtgaggggcaggtggccctccggcgtgtcgtcgttgagctcccagatgaactcgtcggggaaggccctgtagttgaactgcaccacgtcggtgtccagcttcttcatccagccaatcttgatgaagaagcgggtgaactcgcgcagcgacttctcccaaatccggcgctgcacgctgtacccgaacctgccgttgctgtgctccagccagagcgcgtccacggcgcggaggtcctccacggagatgaactggacctccgagaagaagacgtaccctcggcggcgcgcggcctcgcccgccaggacgatgaggagcgcgcgggtggtctcgtcggcctgccggtagtccccctccgccagctgctggcccaggagctccagggatggggtaggcggcgatgttgtcgcagcggcggcggcggcggcgaccggagttggagccgatgagttggcagtcgatgcggctgtggacactgaggaggagctgctggcgaagagcttgaatgaaatgctgttgctggcggtggtgctggtggtgagcttgaggagcgcgggaggggagccgtcgtgggtcgtgctgctgaggaaagaatggtggtgctgggggaggaaggactggagggaagcatttgccatggctggctggctggccggccggcgaagaggcggctggggatgaatggaggaggaggaaagggagggaaacgctgataaaggagtggatggggttttatcgggggattggttgtacttggtggtggtggcggtgtgcggagggagacctgaggctgaggctgtgggcgcgtggtctactagtctgtgtgcccttcttctcctctgtgttgtgaaattttttaggctgtggttttgtaggggtgcatctggaggagaatacaaaggagcgccgtgattggtgggttctgggtgagatgaggatactggctatcgcagctcaacacatgtgtttgtttgc

SEQ ID NO: 1470 - DNA, 962 bp, Festuca arundinacea
  misc_feature (441)..(441): n is a, c, g, or t
ggcacgaggtctttgcctgccatggcaaacgcttctctccaatccttccttcttcagcacaaccattctttcctcaacaacacagtccatgacggctcccctactgcagctctcaggctcaccaccaacgccagcaccagcatttccttcaagctcttcaccagcagctcctcctcggtgaccacagcatccaccgcagctccaactccagtagcctccgcggccgcgacaacctcgccccctaccccctccctggagctcctaggccagcagctcgcggagggagattaccgccaggccgacgagaccacccgcgcgctcctcatctacctcgcgggcgagcctgcgcgtcgtcgagggtatgttttcttctcggaggtccagttcatctctgtggaggacctccgcgccatcgacacgctctggatggagcacagcaanggcaagttcgggtacagcgtgcagcggcggatttgggagaagtccgtgcgcgactacacccgcttgttcattaagattggctggatgaagaagctggacagtgaagtggagcagttcaactacagggccttccctgatgagttcatatgggagctgaacgatgacacgccagagggccatttgcccctcaccaatgccctcagagggacacggctcatggagaacatattcactcacccagcctttgactgcccagaagaggaagcagcagaggagaacaatgacacaggcagcaacgctgggcagaataaggatgatagcaaagtgagggtgaggccaaagattatgacagacttcaagcctgactactccttttaaggagcgtgcacatggatgtttgtaattctgtcatggtacagttgatttaagaagtcatgtttctgtagttcgttttggttgttttgtactaaacatgcatggaaatttgtgaccagatatattataaagataaatgtttgaga

SEQ ID NO: 1471 - DNA, 1157 bp, Leymus cinereus x Leymus triticoides
  misc_feature (202)..(202): n is a, c, g, or t
  misc_feature (244)..(244): n is a, c, g, or t
  misc_feature (259)..(259): n is a, c, g, or t
  misc_feature (261)..(261): n is a, c, g, or t
  misc_feature (270)..(270): n is a, c, g, or t
  misc_feature (284)..(284): n is a, c, g, or t
  misc_feature (315)..(315): n is a, c, g, or t
  misc_feature (358)..(358): n is a, c, g, or t
  misc_feature (389)..(389): n is a, c, g, or t
  misc_feature (395)..(396): n is a, c, g, or t
  misc_feature (406)..(406): n is a, c, g, or t
  misc_feature (412)..(413): n is a, c, g, or t
  misc_feature (457)..(457): n is a, c, g, or t
  misc_feature (484)..(484): n is a, c, g, or t
  misc_feature (527)..(527): n is a, c, g, or t
  misc_feature (541)..(541): n is a, c, g, or t
  misc_feature (556)..(556): n is a, c, g, or t
  misc_feature (584)..(584): n is a, c, g, or t
  misc_feature (601)..(601): n is a, c, g, or t
  misc_feature (643)..(643): n is a, c, g, or t
  misc_feature (685)..(685): n is a, c, g, or t
  misc_feature (697)..(697): n is a, c, g, or t
  misc_feature (739)..(739): n is a, c, g, or t
  misc_feature (763)..(763): n is a, c, g, or t
  misc_feature (772)..(772): n is a, c, g, or t
  misc_feature (814)..(814): n is a, c, g, or t
  misc_feature (844)..(845): n is a, c, g, or t
  misc_feature (862)..(862): n is a, c, g, or t
  misc_feature (889)..(889): n is a, c, g, or t
  misc_feature (918)..(918): n is a, c, g, or t
  misc_feature (959)..(959): n is a, c, g, or t
  misc_feature (1024)..(1024): n is a, c, g, or t
  misc_feature (1079)..(1079): n is a, c, g, or t
  misc_feature (1100)..(1100): n is a, c, g, or t
  misc_feature (1106)..(1106): n is a, c, g, or t
cacacggacaagtagaccacacgcccacagcctcagcctcagcctcagcctcaggtctccctccgcacaccgctaccaccaccaccgcaagtacaatcccccgacaaaaccccatccactcctttatcagcgtttccctccctttcctcccctccatccatcctcagccgcctcttcgccggccagccagccggccatggcnaatgcttccctccagtccttcctccctcagcaccaccattcnttcctcaacagcacnanccatgacgnctccccttccgcgntcctcaagctcaccaccaacgccagcaacancaacagcatttccttcaagctcttcgccagcagctcctcctcngtgaccacagcagcatcgaccgccaactcgncggctnngactccagtngccgcnnccgccgcaacaacctcgccccctaccccctccctggagctcctnggccagcagctcgcggagggggactancgccaggccgacgagaccacccgcgccctcctcatcatcctcncgggcgaggccgcncgtcgccgagggtangtcttcttctcggaggtccagttcatcnccgcggaggacctccgngccgtcgacgcgctctggctggagcacagcaacggcaggttngggtacagcgtgcagcgccggatttgggagaagtcgctgcgngagttcacccgnttcttcatcaagattggctggatgaagaagctggacaccgangtggagcagttcaactacagggcnttccctgangagttcatatgggagctgaatgatgacacgccagagggccanctgcctctcaccaatgccctcagggggacnnggctcctggagaacatnttcactcaccccgcctttgactgcgangaagaggaagcagcagcagaagaggaggntgacacaggcagtgccactggtcagaataataaggatgacnacaaaggcagggggaggccaaagattttgacagatttcaagcccgactactccttttaaggagcntggaagtttgtgatgctgtcatggggcagttgattttaaaaagtcatgtttctgnagttcgttttggttgtttttntactgnacatgcatggaaatttgtgaccatatatattataaagataagtgtttgaga

SEQ ID NO: 1472 - DNA, 962 bp, Triticum aestivum
ctccatccatcctcagccgcctcttcgccggccggccatggcaaatgcctccctccagtccttcctcccccagcaccaccattctttccccagcagcacgacccacgacggctcccctcccgcgctcctcaagctcaccgccaacaccaccaccaacgccagcaacagcatttcattcaagctcttcgccagcagctcctcctcagtgaccacaaccgccaactcgccggctccgactccggtcgccgccgccgcggcgacaacctcgccgcccaccccctccctggagctcctgggccagcagctggcggagggggactactggcaggctgacgagaccacccgggccctcctcatcgtcctcgcgggcgaggccgcgcgccgccgagggtacgtcttcttctcggaggtccagttcatctccgtcgaggacctccgcgccgtggacgcgctctggctggagcacagcgggggcaggttcgggtacagcgtgcagcgccggatttgggagaagtcgctgcgcgagttcacccgattcttcatcaagattggctggatgaagaagctggacaccgaggtggagcagttcaactacagggccttcccggacgagttcatctgggagctcaatgacgacacgccggagggccacctgcccctcaccaatgcgctcaggggcacacggctcctggagaacatcttcacccaccccgccttcgactgcgaggaagaagaagcagcaggagcagaggaggaggctgacaagggcagtgccactgatcagaataataaggatgacaacaaaggcaggggcaggccaaagagtttgacagatttcaagcctgattactccttttaaggagcgtggaagtttgtgatgatgctgtcatggggcagctgattttaaaaaaagtcatgtttctgtagttcgttttggttgtttctgtactgaacatgcatgg

SEQ ID NO: 1473 - DNA, 2112 bp, Triticum aestivum
cagctgccacgcgcgcatccgtacacccgctgccccggcgtccccctccccggcccgatggccaacccgcgcctcctcctccccaggatcctctgcgtcgccgccgtcgccgccttctacgcctgcctcccggcgcccgtctccgccatccggaaggacattggttttgctgcacccatcatctgcaggagtactgttcaaggccggcatttgatatcagatgataatggttatgtatgttctgctctttcgatcgatccatggtctcgctgctgcccacgaacaggaggacgcttctcctgtcagggctgcaaccttgattcgcagtgctgcaattcttacgagtattgtgtttcttgctgcttgaatccttctaggaccaaggaagcagatgtgctgaagttgaaggtagctaagccagttactgctggaacttacaccaatatcttcgatttctgcatgggaagatgccgccatagttctgcaagcgtggtccatgaaaatgcatatttgagtgatttccatcattgctttctggtgcagcaaaattcatcgggatcaactgaatctaattttggatcaaggttggatggcattaacgtcattttgggaaggcagggggaatcgtgtagttctgcatgcagagcaaaaggacaatcatgtgttccaagcaggcttgctgagttgaacaaatgtcagattttgcagaaatatatgagatgcaaaaatggttgctttcccagtcttgggcccgatcaacctgccgaagttgtagacgaagctccaaaaaatttgaatcctggagcgtgcttgtacatgcagatggatgaccgcctcacctgtgatggctcacatcgacatacccgaaggctctgtccttgtgcatgaaacggtggagaaaatagtggcagtcataagagagtcacttgccaggaaacaagcggaggtaatccgccgaaagctgacggctcaaaatggcatggccatttctgcaccgagtttccaaatggcatatcgccgatgaaaagagaacatattttagctttgcagtttatcttttgcatctctggatgcaatcacccatgtccagagcaagcagcttctcaaacacttatctttatagtaatatatatggtcacaaatttgcatgcatgttcagtacaaaaacagccaaaacgaactacagaaacatgactttttttaaaatcagctgccccatgacagcatcatcacaaacttccacgctccttaaaaggagtaatcaggcttgaaatctgtcaaactctttggcctgcccctgcctttgttgtcatccttattattctgaccagtggcactgcccttgtcagcctcctcatctgcccctgctgcttcatcttcttcgcagtcgaaggcggggtgggtgaagatgttctccaggagccgcgtccccctgagggcattggtgaggggcaggtggccctccggcgtgtcgtcggtgagctcccagatgaactcgtcggggaaggccctgtagttgaactgctccacctcggtgtccagcttcttcatccagccgatcttgatgaagaatcgggtgaactcgcgcagcgacttgtcccaaacccggcgctgcacgctgtacccgaacctgccgccgctgtgctccagccagagcgcgtccacggcgcggaggtcctcgacggagatgaactggacctccgagaagaagacgtaccctcggcggcgcgcggcctcgcccgcgaggacgatgaggagggcgcgcgtggtctcgtcggcctgccggtagtcccccgccgcgagctgctggcccaggagctccagggagggggtgggcggcgaggttgtcgccgcggcggcggcggcgaccggagtcggagccggcgagttggcggttgtggtcaccgaggaggagctgctggcgaagagcttgaaggaaatgctgttgctggcgttggtgctgttggtggtgagcttgaggagcgcgggaggggagccgtcgtgggtgttgctgttgaggaaggaatggtggtgctgggggaggaaggactggagggaagcatttgccatggccggccggcgaaggggcggctgaggatggatggaggggag

SEQ ID NO: 1474 - DNA, 2007 bp, Triticum aestivum
ctttcgatcgatccatggtctcgctgctgcccacgaacaggaggacgcttctcctgggctgcaaccttgattcgcagtgctgcaattcttacgagtattgtgtttcttgctgcttgaatccttctaggaccaaggaagcagatgtgctgaagttgaaggtagctaagccagttactgctggaacttacaccaatatcttcgatttctgcatgggaagatgccgccatagttctgcaagcgtggtccatgaaaatgcatatttgagcgatttccatcattgctttctggtgcagcaaaattcatcaggatcaactgaatctaattttggatcaaggttggatggcattaacgtcattttgggaaggcagggggaatcgtgtagttctgcatgcaaagcaaaaggacaatcatgtgttccaagcaggctttctgagttgaacaaatgtcagattttgcagaaatatatgagatgcaaaaatggttgctttcccagtcttgggcccgatcaacctgccgaagttgtagacgaagctccaaaaaatttgaatcccggagcttgcttgtacatgcagatggatgaccgcctcacctgtgatggctcacatcgacatacccgaaggctctgtccttgtgcatgaaacggtggaaaaaatagtggcagtcacaagagagtcacttgccaggaaacaagcggaggtaatccgccgaaagcagatggctcaaaatggcatggccatttctgcaccaagttcccaaatggcgtatagcggatgaaaagagaacatagtattttagctttgcagtttatcttttgcatgtctggatgcaatcatccgtgtccagagcaagcaacttttcaaacacttatctttataatatatatatggtcacaaatttccatgcatgttcagtacagaaacaaccaaaacgaactacagaaacatgactttttttaaaatcagctgccccatgacagcatcatcacaaacttccacgctccttaaaaggagtaatcaggcttgaaatctgtcaaactctttggcctgcccctgcctttgttgtcatccttattattctgatcagtggcactgcccttgtcagcctcctcctctgctcctgctgcttcttcttcctcgcagtcgaaggcggggtgggtgaagatgttctccaggagccgtgtgcccctgagcgcattggtgaggggcaggtggccctccggcgtgtcgtcattgagctcccagatgaactcgtccgggaaggccctgtagttgaactgctccacctcggtgtccagcttcttcatccagccaatcttgatgaagaatcgggtgaactcgcgcagcgacttctcccaaatccggcgctgcacgctgtacccgaacctgccgccgctgtgctccagccagagcgcgtccacggcgcggaggtcctcgacggagatgaactggacctccgagaagaagacgtaccctcggcggcgcgcggcctcgcccgcgaggacgatgaggagggcccgggtggtctcgtcagcctgccagtagtccccctccgccagctgctggcccaggagctccagggagggggtgggcggcgaggttgtcgccgcggcggcggcgaccggagtcggagccggcgagttggcggttgtggtcactgaggaggagctgctggcgaagagcttgaatgaaatgctgttgctggcgttggtggtggtgttggcggtgagcttgaggagcgcgggaggggagccgtcgtgggtcgtgctgctggggaaagaatggtggtgctgggggaggaaggactggagggaggcatttgccatggccggccggcgaagaggcggctgaggatggatggaggggaggggaggggaggaaagggagggaaacgctgataaaggagtggatggggttttgtcgggggatttggttgtacttggtggtggtggcggtgcgcggagggagacctgaggctgaggctgtgggcgcgtggtctacttgtctgtgt

SEQ ID NO: 1475 - DNA, 1201 bp, Triticum aestivum
cctccacctaccgcagcagcaagggcccttgtcgcgcggcggcggcggggaggatgtcatcgccgccggcaccggtattcgagaggctggccgggatccggcccctcgccgagtccggccgcttcaaggcatggttcctggaccagttcggtgttcttcatgacgggaagaaaccctacccgggcgccattttggcattggagaagctcgctgggaatggcgccaagatggtgataatcagcaattcctcaaggcggtcgtctgtaaccatggagaagctgcagagccttgggtttgacacgtcttgtttcctcggggcgatcaccagcggggaactcacccatcagtaccttgacaagagggatgacccatggtttgcatctctgggaaggaagtgtgtccatctgacatggggcaatcgaggtgcaatttctctggagggacttggtttgcaagttgtgaacaatgttgacgatgcagagtttatactagcccatggtactgaagccctgggtttaccttctggtgatccactttcgaaaagtcttgaggagcttgagcagattctagtgcttggtatacaaaagcgacttccaatggtggtagctaatccagattatgtcactgttgaagctcgaaacctgcgtgtcatgcctggcaccctggcagcaaaatacgagagtcttggtggtgaagtaaaatggatggggaagcctgataaggttatctatacatcagcaatgtccctagcaggtgttgaagcacacgaatgtatcaccgtaggtgattcgctgcaccacgacatcaaaggcgcaaatggagccggaatggcatctgcattcatcactggagggatccatgcggctgaacttggactcggtgaatttggagaaactgctggagatgatgccgtcagtgcgttgtgttgcaagcatagctcatacccatcttacgttttgccttcatttgcatggtagaaaacacggtttagattcaggcacaccgtttaaacgggattgcggtctaggataatgatgctcttttcagttgtcaaagtgagcatcaagaccgtggaggtgtttcagtgccgcgctaaattattagcgttatgcattttccggaaataaaatatctgttgatttgattgataggaactgcatgcaatcatttgggaggaaacatcctttgtaaatatttatat

SEQ ID NO: 1476 - DNA, 1283 bp, Secale cereale
ctcctccatcgcctctgcctgctcgtctccactctcccacagcccaccctccaggcctccacctaccgcagcagcaagtgctctcgtcgcgcggcggcggctgcggcgaggaggatgtcatcggcgccgacgccggtgttcgagaggctggccgggatccgacccctcgccgagtctggccgcttcaaggcatggttcctggaccagttcggtgtcctgcatgacgggaagaaaccctaccctggcgccattttggcattggagaagctcgcggggaatggtgccaagatggtgataatcagtaattcctcgaggcggtcgtctgtaaccatggagaagctgcagagccttgggtttgacacgtcttgtttcctcggggcgattaccagcggggaactcacccatcagtacctacataagagggatgacccatggtttgcagctctgggaaggaagtgtatccatctgacatggggcaatcgaggtgcaatttctctggagggacttgatttgcaagttgtgagcaatgttgacgacgcagagtttatactagcccatggtactgaagccctgggtttaccttctggtgatccactttcgaaaagtcttgaggagcttgagcagattctagtgcttggtatacaaaagcgacttccaatggtggtagctaatccagattatgtcactgttgaggctcgaaacctgcgtgtcatgcctggcactctggcagcaaaatacgagagtcttggtggtgaagtaaaatggatggggaagcctgataaggttatctatacatcagcaatgtccctagcaggcgttgaagcacacgaatgtatcaccgtaggtgattcgctgcaccacgacatcaaaggcgcaaatggagccggaatggcatctgcattcatcactggagggatccatgcggctgaactgggactcggtgaattcggagaaactgctggagatgatgctgtcggtgcgttgtgttgcaagcatagctcatacccatcttacgttttgccttcatttgcatggtagaaaacacggttcagattcaggcacaccgtttaaacgggattgcggtctaggataatgatgctcttttcagttgtcaaagtgagcatcaagaccgtggaggtgtttcagtgccgcgctaacttattagcgttatgcattgtccggaaataaaatatctgttgatttgatttataggaactgcgtgcaatcatgtgtggaggaaacgtcctttgtgaaatatttatctgcattgttaaattatatgc

SEQ ID NO: 1477 - DNA, 1324 bp, Hordeum vulgare
ctagcctgtatccgtgtccacggctacgatggccgtggtggccggcgagacgccgcagtcacgcggctgtatatgccgctcgttcgctggtactcggcccagccactacctgctaggcgtcctcgttgccttacccttccaaaggagctcctccatcgcctccactctccgcagcccagcctccacctaccgcagcagcaagtgctctcgtcgcgcggcggcggcggcggggaggatgtcatcggcgccggcgccggtgttcgagaggatggccgggatccgacccctcgccgagtccggccgcttcaaggcatggttcctggaccagttcggtgttcttcatgacgggaagaaaccctaccctggcgccattttggcattggagaagctcgctgggaatggcgccaagatggtgataatcagcaattcctcgaggcggtcgtctgtaaccatggagaagctgcagagccttgggtttgacacgtcttgtttcctcggggcgatcaccagcggagaactcacccatcagtaccttcacaagagggacgacccatggtttgcagctctgggaaggaagtgtgtccatctgacatggggcaatcgaggtgcaatttctctagagggacttggtttgcaagttgtgagcaatgttgacgatgcagagtttatactagctcatggcactgaagccctgggtttaccttctggtgatccactttcgaaaagtcttgaggaacttgagcaggttctagtgcttggtatacaaaagcgacttccaatggtggtagctaatccagattatgtcactgttgaagctcgagacctgcgtgtcatgcctggcactctggcagcaaaatatgagagtcttggtggtgaagtaaagtggatggggaagcctgataaggttatctatacatcagcaatgtgcttagcaggtgttgaagcacacgaatgcatcaccgtgggagattcgctgcaccacgacatcaaaggcgcaaatggggcaggaatggcatctgcgttcatcactggagggatccatgcggctgaacttggactagttgaattcagagaaactgctggtgatgacgccatcagtgcgttgtgttgcaagcatagctcatacccatcttacgttttgccttcatttgcatggtagaaacacggtacaccgtttaatcaggatagtgatagcggtccagcgtaaccatactcttttgaattgtcaaagagagcatcaagaccgcgctaaattgttagtgttatgtgttttccggaaataaaacaatgttgaattgattgatagaaaatgcacgcaattatg

SEQ ID NO: 1478 - DNA, 1236 bp, Triticum aestivum
gcgtggtcgcggccgaggttcgttgccttacccttccaaacgagctccatcgtctccactctccacagcccagcctccacctaccgcagcattaagtgctctcgtcgcgcggcggcggcgacgaggatgtcatcggcgccgacgccggtgttcgagaggctggccgggatccgacccctcgccgagtccggccgcttcaaggcatggttcctggaccagttcggcgttcttcatgacgggaagaaaccctaccccggcgccattttggcattggagaagctcgctgggatgggcgccaagatggtgataatcagcaattcctcgaggcggtcgtctgtaaccatggagaagctgcagagcctggggtttgacacgtcttgtttcctcggggcgatcaccagcggggaactcacccagcagtaccttcacaagagggatgacccatggtttgcatctctgggaaggaagtgtatccatctgacatggggcaatcgaggtgcaatttctctggagggacttggtttgcaagttgtgaacaatgttgacgatgcagagtttatactagcccatggtactgaagccctgggtttaccttctggtgatccactttcgaaaagtcttgaggagcttgagcagattctagtgcttggtatacaaaagcgacttccaatggtggtagctaatccagattatgtcactgttgaagctcgaaacctgcgtgtcatgcctggcactctggcagcaaaatacgagtgtcttggtggtgaagtaaaatggatggggaaacctgataaggttatatatacatcagcaatgtccctagcaggtgttgaagcacacgaatgtatcaccgtaggtgattcgctgcaccacgacatcaaaggcgcaagtggagccggaatgacatctgcattcatcactggagggatccatgcggctgaactgggactcggtgaatttggagaaactgctggagatgatgccgtcagtgcgttgtgttgcaagcatagctcatacccatcttacgttttgccttcatttgcatggtagaaaacacggtttagattcgggcacaccgtttaaacaggattgcggtctaggatgatgatgcgtttttcaattgtcaagtgagcatcaaggccgtggaggtgtttcagtgccgcgctaaattattagcattatgcattttccggcaataaaatatctgttgatttcaaacctcggccgcgaccacgc

SEQ ID NO: 1479 - DNA, 1233 bp, Triticum aestivum
gcgtggtcgcggccgaggttcgttgccttacccttccaaacgagctccatcgtctccactctccacagcccagcctccacctaccgcagcaccaggtgctctcgtcgcgcggcggcggagaggatgtcatcggcgccggcgccggtgttcgagaggctggccgggatccggcccctcgccgagtccggccgtttcaaggcatggttcctggaccagttcggcgttcttcatgacgggaagaaaccctaccccggcgccattttggcattggagaagctcgctgggaatggcgccaagatggtgataatcagcaattcctcgaggcggtcgtctgtaaccatggagaagctgcagagccttgggtttgacacgtcttgtttcctcggggcgatcaccagcggggaactcacccagcagtaccttcacaagagggatgacccatggtttgcatctctgggaaggaagtgtatccatctgacatggggcaatcgaggtgcaatttctctggagggacttggtttgcaagttgtgaacaatgttgacgatgcagagtttatactagcccatggtactgaagccctgggtttaccttctggtgatccactttcgaaaagtcttgaggagcttgagcagattctagtgcttggtatacaaaagcgacttccaatggtggtagctaatccagattatgtcactgttgaagctcgaaacctgcgtgtcatgcctggcactctggcagcaaaatacgagtgtcttggtggtgaagtaaaatggatggggaaacctgataaggttatatatacatcagcaatgtccctagcaggtgttgaagcacacgaatgtatcaccgtaggtgattcgctgcaccacgacatcaaaggcgcaagtggagccggaatgacatctgcattcatcactggagggatccatgcggctgaactgggactcggtgaatttggagaaactgctggagatgatgccgtcagtgcgttgtgttgcaagcatagctcatacccatcttacgttttgccttcatttgcatggtagaaaacacggtttagattcgggcacaccgtttaaacaggattgcggtctaggatgatgatgcgtttttcaattgtcaagtgagcatcaagcccgtggaggtgtttcagtgccgcgctaaattattagcattatgcattttccggcaataaaatatctgttgatttcaaacctcggccgcgaccacgc

SEQ ID NO: 1480 - DNA, 1638 bp, Triticum aestivum
gcgtggtcgcggccgaggttcgttgccttacccttccaaacgagctccatcgtctccactctccacagcccagcctccacctaccgcagcaccaggtgctctcgtcgcgcggcggcggagaggatgtcatcggcgccggcgccggtgttcgagaggctggccgggatccggcccctcgccgagtccggccgtttcaaggcatggttcctggaccagttcggcgttcttcatgacgggaagaaaccctaccccggcgccattttggcattggagaagctcgctgggaatggcgccaagatggtgataatcagcaattcctcgaggcggtcgtctgtaaccatggagaagctgcagagccttgggtttgacacgtcttgtttcctcggggcgatcaccagcggggaactcacccagcagtaccttcacaagagggatgacccatggtttgcatctctgggaaggaagtgtatccatctgacatggggcaatcgaggtgcaatttctctggagggacttggtttgcaagttgtgaacaatgttgacgatgcagagtttatactagcccatggtactgaagccctgggtttaccttctggtgatccactttcgaaaagtcttgaggagcttgagcagattctagtgcttggtatacaaaagcgacttccaatggtggtagctaatccagattatgtcactgttgaagctcgaaacctgcgtgtcatgcctggcactctggcagcaaaatacgagtgtcttggtggtgaagtaaaatggatggggaaacctgataaggttatatatacatcagcaatgtccctagcaggtgttgaagcacacgaatgtatcaccgtaggtgattcgctgcaccacgacatcaaaggcgcaagtggagccggaatgacatctgcattcatcactggagggatccatgcggctgaactgggactcggtgaatttggagaaactgctggagatgatgccgtcagtgcgttgtgttgcaagcatagctcatacccatcttacgttttgccttcatttgcatggtagaaaacacggtttagattcgggcacaccgtttaaacaggattgcggtctaggatgatgatgcgtttttcaattgtcaagtgagcatcaagaccgtggaggtgtttcagtgccgcgctaaattattagcgttatgcattttccggcaataaaatatctgttgatttgattgataggaactgcatgcaatcatgtgtggaggaaacatcctttgtgaaatatttatatgcattgttaaattatatgctccagaacccaggcggtgtacaacatactatgctgggaagctggcttgatgctttgatctggaggttaaagtcttctgattctggcaggggcaatgccacttgttggttggctacgtcgtaatgatccaatcgttttgagtcttcaggtgggcgctaggatcgtgggcatccttgcacaaaccggagttgcaacttgctaggactctgtagtctcgaggagcaaacgactggagacggtggggatgggcatctttagcactgaaacatgacaaagacaaacggcgatggcatcattcacgatgttttgtcagataaatagttcagttgctcttcaagagaatagata

SEQ ID NO: 1481 - DNA, 1480 bp, Oryza sativa
acgaacctcacccatttcggacttctacccactctcctctctccccttccctccctcctccctgctgggcttcgggcggcggcggcggcggcggtgggggtggatggcctccgcggcatcggcgccggcgttcgagaggctggccgggatccgggcactggcggagtccggccgcttcaaggcgtggttcctcgatcagtttggtgttcttcacgatgggaagaagccttaccctggtgccgttctcgcgttggagaagctcgctgagaaaggggcgaagatggtaatcattagcaattcgtcgaggaggtcgtctgtaaccatggagaagctagagagccttggttttgacccatcctgtttcctcagggccattactagcggggaactcacacatcagtaccttcagaagagagatgatccttggtttgcagctcttggaagaaagtgcgtccatctgacatggggcaatcgaggcgcaatttctctggagggccttggtttgcaagtcgtgagcaatgtcgaagaggcagagtttatattagcccatggtactgaggccctgggtctaccttcaggggatccacttcccaaaagtcttgaggagcttgagcaggttctaatgctatgcctagaaaagcgactgccaatggtagtagctaaccctgattatgttactgttgaagcacgagatctgcgagtcatgcctggcactctggcagccaaatacgagagtcttggtggtgaggtgaaatggatggggaagcctgataaggtgatctatacatcagcaatgtccctggcaggggttaatcctcatgaatgtatcacagtaggtgattcactgcaccacgacatcaaaggtgcaaacgcatctagagtcgcttctgcattcattactggagggattcatgcaactgaacttggactcaatgagattggagaaatcgctggagaggacgccatcgattcattgtgccgcaagcatggctcctatcccacctatgttttgccttcatttacatggtagaaacacggtatacctttgggtaaatgcatcatctgtgtctcagaacatggtgcagaaaccgtcaattccagcaaggtcatgcagtataatcagtaattgtgctcttgaggtacctgctactgtgctcaacgtttcccattttcctgagttgttggcaaaggtcaaaactgagaccagcagagttcaggatgagaatagtcttatttccttgctggatatacaagatggtgtcaaacttacatgtgttttttatgatttgttttgcaatggttccttctctgaaccatttggatttcatagacagattactgagaattactcatgttagagttaaacacgttatgctaataagatcacttatcagtgacacaccccttgtacatcaaatttcattgatgaatattaaacgagcaaaccatcaaacaactgaaaaattttgtgtgtgtctgc

SEQ ID NO: 1482 - DNA, 1473 bp, Oryza sativa
gaacctcacccatttcggacttctacccactctcctctctccccttccctccctcctccctgctgggcttcgggcggcggcggcggcggcggtgggggtggatggcctccgcggcatcggcgccggcgttcgagaggctggccgggatccgggcactggcggagtccggccgcttcaaggcgtggttcctcgatcagtttggtgttcttcacgatgggaagaagccttaccctggtgccgttctcgcgttggagaagctcgctgagaaaggggcgaagatggtaatcattagcaattcgtcgaggaggtcgtctgtaaccatggagaagctagagagccttggttttgacccatcctgtttcctcagggccattactagcggggaactcacacatcagtaccttcagaagagagatgatccttggtttgcagctcttggaagaaagtgcgtccatctgacatggggcaatcgaggcgcaatttctctggagggccttggtttgcaagtcgtgagcaatgtcgaagaggcagagtttatattagcccatggtactgaggccctgggtctaccttcaggggatccacttcccaaaagtcttgaggagcttgagcaggttctaatgctatgcctagaaaagcgactgccaatggtagtagctaaccctgattatgttactgttgaagcacgagatctgcgagtcatgcctggcactctggcagccaaatacgagagtcttggtggtgaggtgaaatggatggggaagcctgataaggtgatctatacatcagcaatgtccctggcaggggttaatcctcatgaatgtatcacagtaggtgattcactgcaccacgacatcaaaggtgcaaacgcatctagagtcgcttctgcattcattactggagggattcatgcaactgaacttggactcaatgagattggagaaatcgctggagaggacgccatcgattcattgtgccgcaagcatggctcctatcccacctatgttttgccttcatttacatggtagaaacacggtatacctttgggtaaatgcatcatctgtgtctcagaacatggtgcagaaaccgtcaattccagcaaggtcatgcagtataatcagtaattgtgctcttgaggtacctgctactgtgctcaacgtttcccattttcctgagttgttggcaaaggtcaaaactgagaccagcagagttcaggatgagaatagtcttatttccttgctggatatacaagatggtgtcaaacttacatgtgttttttatgatttgttttgcaatggttccttctctgaaccatttggatttcatagacagattactgagaattactcatgttagagttaaacacgttatgctaataagatcacttatcagtgacacaccccttgtacatcaaatttcattgatgaatattaaacgagcaaaccatcaaacaactgaaaaaatttgtgtgtg

SEQ ID NO: 1483 - DNA, 1338 bp, Sorghum bicolor
tagacacctcaccttggctttgcctcgcgtcgcctccactccaccctccgcctcctgctccttcctccaggtccgggcggcggcgggggaggagagaatggcctccgcggcggcggcgccggtgtttgagagggtggccgggatccgagccatcgccgagtccgggcgctttaaggcatggttcctggaccagtttggcgttcttcacgacgggaagaagccgtacccgggcgccattctggcattggagaagcttgcggggaatggggcaaagatggtgataatcagcaattcctctaggcggtcgtctgtgacaatggagaagctcaagagcctggggttcgacacgtcctgtttcctcgcgaccatcaccagtggggagctcacacatcaacaccttcagaagagaaacgacccatggtttgcagcccttggaaggaagtgtatccatatcacttggggtgacagaggagcaatctctctggagggacttggtttgcaagttgtgaacaatgttgatgatgcagagtttatattagcccacggtactgaagcccttggatcaccttctggtgatcctcttcccaaaagtcttgaggagcttgagcaggttctaatgcttggcctagaaaagcaacttccaatggtggtggctaatccagattatgtcactgtcgaagctcgagatctccgtgtcatgcctggcactctggcagctaaatatgagagccttggtggtgaagtgaaatggatggggaagcctgataagatgatctatacatcagcgatgtccctaccaggtgttgatgctcatgaatgtatcatggtgggtgattcactgcaccacgacatcaaaggagcaaatgtgtcaggaatcgcgtctgcgttcattactggagggattcatgcagatgaacttggacttggtgagtttggagaaactgctgggaaggatgccatcaattcactgtgcagcaagcatggatcatatccttcttatgttttgccttcattcacatggtagaaacacgatctgtacatttggttttaggtgcactggcaagtgatttaggcagatgtttttatggaaatgccacacaaggatcaagccattggcggtatcattgtacttaatgattactgtggttgttcaatagtcgctgttaatttgatagatagaagctggatgtactatgctatggcgttaagagtttgagtaataaggtatacaggaaacaataatccaaatgaggcattgcttatttcagttcggcacaccaatcagtatgtgattactcaatagatttcaggacaatccagctaggatgtcaatttcct

SEQ ID NO: 1484 - DNA, 1376 bp, Sorghum bicolor
tcaactttttttttaccaacttgactagacacctcaccttggctttgcctcgcgtcgcctccactccaccctccgcctcctgctccttcctccaggtccgggcggcggcgggggaggagagaatggcctccgcggcggcggcgccggtgtttgagagggtggccgggatccgagccatcgccgagtccgggcgctttaaggcatggttcctggaccagtttggcgttcttcacgacgggaagaagccgtacccgggcgccattctggcattggagaagcttgcggggaatggggcaaagatggtgataatcagcaattcctctaggcggtcgtctgtgacaatggagaagctcaagagcctggggttcgacacgtcctgtttcctcgcgaccatcaccagtggggagctcacacatcaacaccttcagaagagaaacgacccatggtttgcagcccttggaaggaagtgtatccatatcacttggggtgacagaggagcaatctctctggagggacttggtttgcaagttgtgaacaatgttgatgatgcagagtttatattagcccacggtactgaagcccttggatcaccttctggtgatcctcttcccaaaagtcttgaggagcttgagcaggttctaatgcttggcctagaaaagcaacttccaatggtggtggctaatccagattatgtcactgtcgaagctcgagatctccgtgtcatgcctggcactctggcagctaaatatgagagccttggtggtgaagtgaaatggatggggaagcctgataagatgatctatacatcagcgatgtccctaccaggtgttgatgctcatgaatgtatcatggtgggtgattcactgcaccacgacatcaaaggagcaaatgtgtcaggaatcgcgtctgcgttcattactggagggattcatgcagatgaacttggacttggtgagtttggagaaactgctgggaaggatgccatcaattcactgtgcagcaagcatggatcatatccttcttatgttttgccttcattcacatggtagaaacacgatctgtacatttggttttaggtgcactggcaagtgatttaggcagatgtttttatggaaatgccacacaaggatcaagccattggcggtatcattgtacttaatgattactgtggttgttcaatagtcgctgttaatttgatagatagaagctggatgtactatgctatggcgttaagagtttgagtaataaggtatacaggaaacaataatccaaatgaggcattgcttatttcagttcggcacaccaatcagtatgtgattactcaatagatttcaggacaatccagctaggatgtcaatttccttgtgatactctca

SEQ ID NO: 1485 - DNA, 1393 bp, Zea mays
ataaaaatgtaataaaatagtccaatcgccttgactaccgcttccggttccggatccgaatctcgccctcccctctctttcttgcctccaggtccggccgtccgggcggcgccgggaggagagaatggcctccacggcgtcgccgccggtgttcgagagggtggccgggatccgagccattgccgagtccggccgcttcaaggcatggttgctggaccagtttggcgttcttcatgacgggaagaagccgtaccccggcgccattctggcattggagaagctagcggagaatggggcaaagatggtgataatcagcaattcctctaggcggtcatctgtgacaatgaagaagctcaagagcctggggttcgacacgtcctgtttcctcgcgaccatcaccagtggggagctcacacatcagcaccttcagaagagagacgacccatggtttgctgctcttggaaggaagtgtatccatatcacttgggacgatcgaggggcaatttctctcgagggccttggtttgcaagttgtgaacaatgttgatgatgcagagttcatattagcccacggtactgaagctcttggctcaccttctggtgttcctcttcccaaaagtcttgaggagcttgagcaggttctaatgcttggcatagaaaagcgacttccaatggtggtagctaatccagattatgtcactgtcgaagctcgagatctccgtgtcatgcctggcactctggcagctaaatatgagagtcttggtggtgaagtgaaatggatggggaagcctgataaggtgatctatacatcagcgatgtccctagcgggcgttgatgcccgtgaatgtatcatggtgggtgattcgctgcaccacgacatcaaaggagccaatgcgtcagggatggcatccgcgttcgtcactggaggggtccatgcggacgaacttggactcggtgaatttggagaaactgctggggaggatgctgtcagttcgctgtgcagcaagcacggatcgtacccttcttatgttctgccttcattcgcgtggtagagatgcggcctagaatttttttttgttttaggtgcacgggaaagtgattttaggcagatattgttgttatggaaataagtgccacgcaatgatcaagccgctggaggtgtcattcttcttaataaataataagtgacacgcaatgctcaagccgctggaggcagatttgtatttgcatttgtagtgtgtgtgtgtctatatatgctgcctgtggtgtatataccgcctgtgctgcaatgttcggttgagactttagacagcgatactgtatgaaggattcacattgttctgctcaattatgtaaacccgctctattacttttcgtggatgctgctttacgta

SEQ ID NO: 1486 - DNA, 1389 bp, Setaria italica
aaatccccgacttccgaacgaatcctcacctttcctcgcgtcgcgtccaccctccgcgcctccgcttcgtccctccaggtccgggcggcgccggggcggagagaatggcctccgcgccatcggcgccggtgttcgagagggtggccgggatccgagccatcgccgagtccggccgctttaaggcctggttcctggaccagtttggcgtccttcacgatggcaagaagccgtaccccggcgccattttggcattggagaagctcgcggggaatggggcgaagatggtgataatcagcaattcctctaggcggtcgtctgtgacaattgagaagctgcagagcctggggttcgacacatcttgtttcctcgggaccatcaccagtggggagctcacacatcaacaccttctaaagaggaatgattcatggtttgctacccttggaagaaagtgtatccatatcacttggggcaatcgtggcgcaatttctcttgagggtcttggtttgcaagttgtgaacaatgttgatgatgcagagtttatattagcccatggtactgaagcccttggttcaccttctggtgaccctcttcccaaaagtcttgaggagcttgagcaggttctaatgcttggcctagaaaagcgacttccaatggtggtagctaatccagattatgtcaccgttgaagctcgagatctgcgtgtcatgcctggcactctggcagctaaatatgagagtcttggtggggaagtgaaatggatgggcaagcctgataaggtgatctatacctcagcgatgtccctagctggagttgatgctcatgaatgcatcatggtgggtgattcactgcaccacgacatcaaaggggcaaatgcaacaggaatcgcatctgcgttcattactggagggattcatgcagctgaacttgggctcactgaatttggagaaactgctggggaggatgccatcaatgctctatgtagcaagcatggatcatatccctcttatgttttgccttcgtttacatggtagaaacacggtgttcaggcaaatattgttctggaagtgacacaggaggatgaagcccttggaggcatatgattgttcgatggttgttgaatttgatcaatacaagctggatgcagctatgctatgaagttaagagcttgggaaagaggatttgattgtttatcatcaaactttcaagaaataattgtccagatgaaacattgcttatttcagttcagcacagcaactagtagcacctcttcggctgaaaaaaatgtcaatactaattaaaattgtctcatttgaactgaaaatgtgttgaaggcctaaattaaaagaccaaactgatatttaagctatattgaaaaaattgtaagattat

SEQ ID NO: 1487 - DNA, 1134 bp, Pennisetum glaucum
aaaccccctcctgcttcgagcgaaccaaattccctcgcatcgcgttcgcgtccaccctccgcctcgtccctccaggtccgggcggcgcaggggcggagagaatggcctccgcgccatcggcgccggtgttcgagatggtggccgggatccgaaccatcgccgagtccggccgctttaaggcctggttcctggaccagtttggcgtccttcacgatggcaagaagccgtaccccggcgccattttggcattggagaagctcgcggggaatggtgcgaagatggtgataatcagcaactcctctaggcggtcgtctgtgacaatagagaagctgcaaagcctagggttcgacacatcttgtttcctcgggaccatcaccagtggggagctcacacatcaacaccttctaaagaggaatgacccatggtttgctgcccttggaagaaagtgtatccatatcacttggggtgatcgtggcgcaatttctcttgagggtcttggtttacaagttgtgaacaatgttgatgatgcagagtttatattagcccatggcactgaagcccttggttcaccttctggtgaccctctttccaaaagtcttgaggagcttgagcaggttctgatgcttggcctagaaaagcgacttccaatggtggtagctaatccagattatgtcaccgttgaagcccgagatctgcgtgtcatgcctggcactctggcagctaaatatgagagtcttggtggggaggtgaaatatatgggcaagcctgatgaggtgatctatacgtcagcgatgtccctagctggagttgacgctcatgaatgcatcatggtgggtgattcactgcaccacgacattaaaggggcaaatgcatcaggaattgcatctgctttcattactggaggggttcatacagatgaacttggtctcactgaatttggagaaactgctggggaggatgccatcaatgctctgtgtagcaagcatggatcatacccctcttatgttttgccttcgtttacatggtagaaacatggtccggttatttcttttgagcacctgaaagtgatttgtggcaaatattgctctgcaagggacacaggaggataaagcccttggaggcattaatgtggcc

SEQ ID NO: 1488 - DNA, 1939 bp, Festuca arundinacea
  misc_feature (36)..(37): n is a, c, g, or t
  misc_feature (39)..(39): n is a, c, g, or t
  misc_feature (46)..(46): n is a, c, g, or t
  misc_feature (518)..(518): n is a, c, g, or t
  misc_feature (1031)..(1031): n is a, c, g, or t
ggcacgaggcccaccacgacggacgccattagagcnntngttgcgnagggaggaggatgaaggtgatcgagaagatccaggaggcggcggcgaatggccggacggccttctccttcgagtacttcccgcccaagacggaggagggggtggagaacctcttcgagcggatggaccgcatggtggcgcacggccccaacttctgcgacatcacctggggcgccgggggctccaccgccgacgtcaccctcgacatcgccaaccgcatgcagaacatggtatgcgtggaaacaatgatgcatttgacatgcaccaacatgccagtagagaagatcgatagtgccttggatgccattaagtccaatgggattcaaaatgttttggcactgagaggagaccctccacatggtcaggacaaatttgttcaagttgctgggggattttcctgcgcactagatctggtgcagcacattagagccaagtatggtgattactttggaataactgtcgctggctatccngaggcacaccctgaggtaatactaggcgaggaaggggcgaccgaggaggcatatagcaacgatcttgcttatttgaagagaaaggttgatgctggtgctgaccttatagttacacagcttttctatgacaccgatatctttctcaagtttgtgaatgactgccgtcaaattggcataacctgccccatcgttcctggcataatgccaataaataactacaaaggtttcatccgaatgactggattctgcaaaactaagataccagctgagattactgctgccttggaacctattaaagacaatgaggaggctgtcaaagcatatggaatccacctcggaactgagatgtgcaagaaaattttagctactgggattaatactttgcacctttacacactaaacatggaaaaaactgctttagcaattttgacgaatcttgggttaatagaggagtccaagctctcaagaacattaccttggaggcctccaaccaatgttttccgtgtcaaagangatgttcgccctattttctgggctaacagaccaaagagttacatttcaaggaccataggttgggatcagtacccacatggtcggtggggtgattcccggaacccatcatatggagcacttactgactaccagttcacacggccacgtgggcgtggtaagaagctccaagaggaatgggctgttcctgtgaaatctgtgcaagacattaacgagaggtttatgaatttctgtcaaggaaaacttacaagcagcccatggtctgagctagacggtcttcaaccagagacgaagataattgacgatcagctggtgaagattaacttgaagggtttccttaccatcaacagccaacctgctgtaaatgcagagaaatctgattctccaagtgttggatggggcggcccaggaggctacgtttaccagaaagcctatgttgagttcttctgcgcaaaggagaagctggaccagctaatcgagaagagcaaggcgttcccttctcttacatacattgctgtgagcaaggaaggggagacattctcgaacatcccagcgaatgcagtgaatgccgtgacatggggtgtgttccctggcaaggagatcatccagcccaccgtcgtcgattcggcgagcttcttggtctggaaagacgaggcgttcgagatctggtcgaagggatgggcctgcctgttccccgagggcgactcgtctagggagttgctagagcaggttcagaagagctactacttggtcagcctagtggacaacgattacgtccagggggacctcttcgctgcgttcaaggagatctgataccgatgatacctgacaaatcttccagtctcttgttggcttgctagattcatcaatacaattgcttgctgcatccacgactacagggtccgatcaca

SEQ ID NO: 1489 - DNA, 2053 bp, Avena sativa
ggcgcaccccccaccacgacggagacgccattaatcagagcaaggttctagccgaagatgaaggtgatcgagaagatccaggaggcggcggccaatggccggacggccttctccttcgagtacttcccgcccaagacggaggagggggtcgagaacctcttcgagcggatggaccgcatggtggcgcacggccccaacttctgcgacatcacctggggcgccggcggatccaccgccgacgtcaccctcgacatcgccaaccgcatgcagaacatggtatgtgtggaaacaatgatgcatttgacatgcaccaacatgccagtagagaagatcgatagtgccttggatgccattaagaccaatgggattcaaaatgttttggcacttagaggagaccctccacatggtcaggacaagtttgttcaagttgctgggggattttcttgcgcactagatctggtgcagcacattaaagccaagtatggtgattactttggcataactgtcgctggctatccagaggcacaccctgaggtaatactaggcgaggaaggggctaccgaggaggcatatagcaacgatcttgcttatttgaagagaaaggttgatgctggtgctgaccttatagttacacagcttttctatgacaccgatatctttctcaagtttgtgaacgactgccgtcagattggcataacctgccccattgttcctggcataatgccaataaataactacaaaggtttcatccgaatgactggattctgcaaaactaagataccagctgagattactgctgccttggatcctattaaagacaacgaagaggctgttaaagcatatggaatccacctcggtactgagatgtgcaagaaaattttagctagtgggattaacactttgcacctttacacactaaacatggaaaaaactgctttagcaattttgacgaatcttgggttaatagaggagtccaagctctcaagaacattaccttggaggcctccaactaatgttttccgtgtcaaagaggatgttcgccctatattctgggctaacagaccaaagagttacatttcaaggaccctaggttgggatcagtacccacaaggccggtggggtgattctcggaacccatcatatggagcgcttactgactaccagttcacacggccacgtggacgtggtaagaagctccaagaggaatgggctgttccattgaaatctgtgcaggatattaatgagcgattcgtgagcttctgtcaaggaaaacttacaagcagcccatggtccgagttagacggtcttcaaccagagacgaagattattgacgatcagctggtgaacattaacttgaagggtttccttaccatcaacagccaacctgctgtgaatgcagagaaatctgattctcctagtgttggatggggcggcccaggaggctatgtttaccagaaggcctacgctgagttcttctgcgcaaaggagaagctggaccagctgatcgagatgtgcaaggcgttcccttctatcacatacatcgccgtgagcaaagaaggggagacgttctcgaacctccccgcgaacgccgtgaacgccgtgacatggggcgtgttccctggcaaggagatcatccagcccaccgttgtcgactcatcgagcttcttggtctggaaagatgaggctttcgagatctggtcgaaggggtgggcttgcctgttccccgagggcgactcgtctagggcgttgctagagcaggttcagaagagctactacttggtcagcctcgtggacaacgactacatccagggggacctcttcgctgtgttcaaggggatctgatgtcgatgtgatgccttgcagtcttccaacctcctcttgcctgtctaaattcatctgtactattgcttgctgcatccacgactacagggtccgatcacactggaagttgcgcattgacccacctttgctagagcctcccccatctaagtctgatctctcgtgatttgtatcgatttatccaacagtccaatatcaataagaatttgagctt

SEQ ID NO: 1490 - DNA, 2498 bp, Triticum aestivum
gctacccctcgtccacccgccccgacgccattagagccgtgggaaggttctagaggaagagggagaggaagatgaaggtgatcgagaagatccaggaggcggcggcgaatggccggaccgtcttctccttcgagtacttcccgcccaagacggaggagggcgtcgagaacctcttcgagcggatggaccgcatggtggcgcacggcccaaacttctgcgacatcacctggggcgccggcggatccaccgccgacgtcaccctcgacatcgccaaccgcatgcagaacatggtatgcgtggaaacgatgatgcacttgacgtgcaccaacatgccagtggagaagatcgataatgctttggataccattaagtccaacgggattcaaaatgttctcgcacttagaggagatcctccacatggccaggacaagtttgttcaagttgctggtggattttcttgtgctctagatctggtggagcacattaaagccaagtatggtgattactttggcataactgtcgctggctatccagaggcacaccctgaggtaatactaggcgaggaaggggctacggaggaagcatatagcaaagatcttgcttacttgaagagaaaggttgatgctggcgctgacgttatagtcacccaacttttctatgataccgatatctttctcaagtttgtgaacgactgccgtcagattggtataacctgccctatcgttcctggcataatgccaataaataactacaaaggatttgtgcgcatgactggattctgcaaaactaagataccagctgagattactgctgccttggatcctattaaagacaatgaggaggctgtgaaagcatatggaattcaccttggtactgagatgtgcaagaaaattttggctagtgggatcaagactttgcacctgtacacactaaacatggagaagactgctttagcaattctgatgaatcttggattaatagaggagtccaagctttcaagaacattaccttggaggccaccaactaatgttttccgtgtcaaagaggatgttcgccctatattctgggccaacagaccaaagagttacatttcaaggaccactggttgggatcaatacccacatggacggtggggtgattccaggaacccatcatacggagcacttaatgatcaccagttcacacggccacgtggacgtggtaagaagctccaagaggaatgggctgttccactgaaatctgtgcaagatattaatgagcggttcgtgaacttctgtgaaggaaaacttaaaagcagcccatggtccgagttagatggtcttcaacctgagacgacgataattgacgatcagctggtgaagattaactcaaagggtttccttaccatcaacagccaacctgctgtaaatgcagagaaatccgagtctcctagtgttggatggggcggcccaggaggctatgtttaccagaaggcctacgttgaattcttctgcgctaaggagaagctgggccaactcattgagaagagcaaggcattcccttccctcacgtacatagctgtgaacaaggaaggggaatcgatctcaaacatccctgcgaacgccgtgaacgctgtcacatggggtgtgttccccggcaaggagatcatccagcctaccgtcgttgactcggcgagcttcatggtctggaaagatgaagcgtttgagatctggtccaggggatgggcctgcctgttcccggagggtgactcatccagggagctgctagagcagattcagaagagctattacttggtcagcctcgtggacaatgactacatcagcggggacctctttgctgcattcaaggagatctaatttcgatgataccttacagtatgctgtgtttgaccgccctccgctagagtcctgtaatatgatttgtcgtgatttctgtcgatttatccaaaccactcaatatgaataagacttttcgatctttgttacttcttcgtgtgcagtctctcctcttgtctagcttatttgttacctaggtttattttccccgatgatgagttgaagcttttttaatgtgtatatgtggtaatacagtttactgccacgatagaagctcggttcattacttgggttataatttcaaacgagaaccactcatctatgaaggattgaagatgtcaactagggagagaggggggcttgaacagacgactacgaacgttttgcagctgattttagatatttgtagaattataagttctctgcaaatgtaactaactgatcatatatgataagcaatttagcaacctaaattagttatagaagtaataagagataggaaaaattaaagttggaaaaattaaagttaatgtccgtggatggaagctaatctttgtttgtttttcttgcaaaagggaagctaatctttgttggagggattaggtctgggaaatatatcttttgctttgtttgggagtacatgatgaaaattagtttgggatg

SEQ ID NO: 1491 - DNA, 2311 bp, Triticum aestivum
gaaggttctagaggaagagggagaggaagatgaaggtgatcgagaagatccaggaggcggcggcgaatggccggaccgccttctccttcgagtacttcccgcccaagacggaggagggcgtcgagaacctcttcgagcggatggaccgcatggtcgcgcacggccccaacttctgcgacatcacctggggcgccggcggatccaccgccgacgtcaccctcgacatcgccaaccgcatgcagaacatggtatgcgtggaaacgatgatgcacttgacgtgcaccaacatgccagtggagaagatcgataatgctttggataccatcaagtcgaatgggattcaaaatgttctggcacttagaggagatcctccacatggccaggacaaatttgttcaagttgctggtggattttcttgtgctctagatctggtggagcacattaaagccaagtatggtgattactttggcataactgtcgctggctatccagaggcacaccctgaggtaatactaggcgaggaaggtgctacggaggaagcatatagcaaagatcttgcttacttgaagagaaaggttgatgctggcgctgacgttatagtcactcagcttttctatgataccgatatctttctcaagtttgtgaacgactgccgtcaaattggtataacatgccctattgttcctggcataatgccaataaataactacaaaggatttgtgcgcatgactggattctgcaaaactaagattccagctgagattactgctgccttggatcctattaaagacaatgaggaggctgtgaaagcatatggaatccaccttggtactgagatgtgcaagaaaattttggctagtgggatcaagactttgcacctttacacactaaacatggaaaagactgctttagcaattttgatgaatcttggattaatagaggagtccaagctttcaagaacattaccttggaggcctccaactaatgttttccgtgtcaaagaggatgttcgccctatattctgggccaacagaccaaagagttacatctcaaggaccactggttgggatcagtacccacatgggcggtggggtgattccaggaacccatcatatggagcacttaatgaccaccagttcacacggccacgtgggcgtggcaagaagctccaagaggaatgggctgtgccactgaaatctgtgcaagacattaatgagcggtttgtgaacttctgtgaagggaaacttaaaagcagtccatggtctgagttagacggtcttcaacccgagacgacgataattgatgatcagctggtgaagattaactcaaagggtttccttaccatcaacagccaacctgctgtaaacgcagagaaatctgattctcctagtgttggatggggcggcccaggaggctatgtttaccagaaggcctacgtcgaattcttctgcgctaaggagaagctgggccaactcatcgagaagagcaaggcattcccttccctcacgtacatcgccgtgaacaaggaaggggaatcgatctccaacatccctgcgaacgccgtgaacgctgttacatggggtgtgttccccggcaaggagatcatccagcctaccgtcgttgactcggcaagcttcatggtctggaaagatgaagcgtttgagatctggtccaggggatgggcctgcctgttccctgagggcgactcgtccagggagttgctagagcagattcagaagagctattacttggtcagcctcgtggacaatgactacatcagcggggacctctttgctgcattcaaggagatctaatttcgatgataccttacagtatgctgtgtttgaccgcccttcgctagagtcctgtaatatgatttgttgtgatttctgttgatttatccaaaccactcaatatgaataagaattttcgatctttgttccttcttcgtgtgcagtctctccccttgtctagcttatttgttacctaggtttattttccccgatgatgagttgaagcttttttaatgtgtatatgtggtaatacagtttactgccacgatagaagctcggtccattacttgggttgtaatttcaaacgagaaccactcatctatgaaggactgaagatgtcaactagggagagatgggggtttgaataggtgactacaaactttttgcaggtgattttagatatttgtagaattataagttctctacaaatgtaactaactgaagatcatatatgataagcaatttagcaacctaaattagttataaaagtaataagagataggaagaagtaaagttgg

SEQ ID NO: 1492 - DNA, 2853 bp, Triticum aestivum
gaataacgatgcttcagacaaggtaatcaatcagattcaagtaccataaaaaggtctcccgtacaagtacaacccaagtactgtgaaacatcagtttattacactaccgcagatgaaatgcggagccagtttttgtgaccaaagcaaactgcaaaaaccccggttgccgccaaacaaatttgaacagctaatcgtcgtcttcgtcaaagtagcgctgctcattggcgtgtttcgcacgctcaagcatcttgtcaaggtccaccttgaccttctcatcaaacttcaccagttggtttacaaacacaacacccagacccattcccagcacatgctcccagggatggcgcatgtaggggagcttccggagggcgttggagtacatctgggtgcccagccccagcagggcaccgatgatggtcggcgtcgccggcatgtcgctgcgctctcctctcggggtggaccggacggcgtggttcgggttcgggcgatgctggaacaagaggagaatcttggtggctggggcaaagaagagttgagcagtgggggagaaggttctagaggaagaggaagaggaagatgaaggtgatcgagaagatccaggaggcggcggcgaatggccggaccgtcttctccttcgagtacttcccgcccaagacggaggagggcgtggagaacctcttcgagcggatggaccgcatggtggcgcacggccccaacttctgcgacatcacctggggcgccggcggatccaccgccgacgtcaccctcgacatcgccaaccgcatgcagaacatggtatgcgtggaaacgatgatgcacttgacatgcaccaacatgccagtggagaagatcgataatgctttggataccatcaagtccaatgggattcaaaatgttctggcacttagaggagatcctccacatggccaggacaaatttgttcaagttgctggtggattttcttgtgctctagatctggtggagcacattaaagccaagtatggtgattactttggcataactgtcgctggctatccagaggcacaccctgaggtaatactaggcgaggaaggtgctacggaggaagcatatagcaaagatcttgcttacttgaagagaaaggttgatgctggcgctgacgttatagtcacccagcttttctatgataccgatatctttctcaagtttgtgaacgactgccgtcagattggtataacctgccctatcgttcctggcataatgccaataaataactacaaaggatttgtgcgcatgactggattctgcaaaactaagattccagctgagattactgctgccttggatcctattaaagacaatgaggaggctgtgaaagcatatggaatccaccttggtactgagatgtgcaagaaaattttggctagtgggatcaagactttgcacctgtacacactaaacatggagaagactgctttagcaattctgatgaatcttggattaatagaggagtccaagctttcaagaacattaccttggaggccaccaactaatgttttccgtgtcaaagaggatgttcgccctatattctgggccaacagaccaaagagttacatttcaaggaccactggttgggatcaatacccacatggacggtggggtgattccaggaacccatcatacggtgcacttaatgatcaccagttcacacggccacgtggacgtggtaagaagctccaagaggaatgggctgttccactgaaatctgtgcaagacattaatgagcggttcgtgaacttctgtgaaggaaaacttaaaagcagcccatggtctgagttagatggtcttcaacccgagacgacgataattgacgatcagctggtgaagattaactcaaagggtttccttaccatcaacagccaacctgctgtaaatgcagagaaatctgagtctcctagtgttggatggggcggcccaggaggctatgtttaccagaaggcctacgtcgaattcttctgcgctaaggagaagctgggccaactcatcgagaagagcaaggcattcccttccctcacgtacatcgccgtgaacaaggaaggggaatcgatctcaaacatccctgcgaacgccgtgaatgctgtcacatggggtgtgttccccggcaaggagatcatccagcctaccgtcgttgactcagcgagcttcatggtctggaaagatgaagcgtttgagatctggtccaggggatgggcctgcctgttcccagagggcgactcgtccagggagttgctagagcagattcagaagagctattacttggtcagcctcgtggacaatgactacatcagcggggacctctttgctgcattcaaggagatctaatttcgatgagaccttacagtatgctgcgtttgaccgcccttcgctagagtcctgtaatatgatttgtcgtgatttctgtcgatttatccaaaccactctatgaataagaattttctatctgtgttccttcgtgtgcagtctctccacttgtctagcttatttgttacctaggtttattttacccaatgatgagttgaagcctttttaatgtatatacgtggtaatacagtttactgccacgacagaagctcagttcattacttgggttgtaatttcaaacgagaaccactcatctatgaaggactgaagatgtcaactagggagagatgggggtttgaataggtgactacgaactttttgcagctgattttagatatttgtagaattataagttctctgcaaatgtaactaactgaagatcatatatgataagcaatttagcaacctaaattagttataaaagtaataagagataggaaaaagtaaagttgg

SEQ ID NO: 1493 - DNA, 1913 bp, Leymus cinereus x Leymus triticoides
  misc_feature (294)..(294): n is a, c, g, or t
  misc_feature (497)..(497): n is a, c, g, or t
  misc_feature (617)..(617): n is a, c, g, or t
  misc_feature (1401)..(1401): n is a, c, g, or t
  misc_feature (1523)..(1523): n is a, c, g, or t
  misc_feature (1667)..(1667): n is a, c, g, or t
tgatcgagaagatccaggaggcggcggcgactggccggaccgtgttctccttcgagtacttcccgcccaagacggaggagggcgtggagaacctcttcgagcggatggaccgcatggtggcgcacggccccaacttctgcgacatcacctggggcgccggcggatccaccgccgacgtcaccctcgacatcgccaaccgcatgcagaacatggtatgcgtggaaacgatgatgcacttgacgtgcaccaacatgccagtggagaagattgataatgctttggataccattaagnccaatgggattcaaaatgttctggcacttagaggagatcctccacatggccaggacaaatttgttcaagttgctggtggattttcttgtgctctagatctggtgcagcacattagggccaagtatggtgattactttggcataactgtcgctggctatccagaggcacaccctgaggtaatactaggcgaggaaggggctacngaggaagcatatagcaaagatcttgcttacttgaagagaaaggttgatgctggtgctgacgttatagtcacccagcttttctatgataccgatatctttctcaagtttgtgaacgactgncgtcagattggtataacctgccctatcgttcctggcataatgccaataaacaactacaaaggattcgtgcgcatgactggattctgcaaaactaagataccagctgagattactgctgccttggatcctattaaagacaatgaggaggctgtgaaagcatatggaatccaccttggtactgagatgtgcaagaaaattttggctagtgggatcaagactttgcacctttacacactaaacatggaaaagaccgctttagcaattttgatgaatcttggattaatagaggagtccaagctttcaagaacattaccttggaggcctccaacaaatgttttccgtgtcaaagaggatgttcgccctatattctgggccaacagaccaaagagttacatttcaaggaccactggttgggatcagtacccacatgggcggtggggtgattccaggaacccatcatacggagcacttaatgaccaccagttcacacggccacgtggacgtggtaagaagctccaagaggaatgggctgttccactgaaatctgtgcaagacattaatgagcggttcgtgaacttctgtgaagggaaacttaaaagcagcccatggtctgagttagacggtcttcaacccgagacaacgataattgatgatcagctcgtgaagattaactcaaagggtttccttaccatcaacagccaacctgctgtaaatgcagagaaatctgattctcctagtgttggatggggcggcccaggaggctatgtttaccagaaggcctacnccgaattcttctgcgctaaggagaagctggaccaactcatcgagaagagcaaggcattcccttccctcacgtacatcgccgtgaacaaggaaggggaatcgatctcgaacatccctgcgaangccgtgaacgctgtcacatggggcgtgttccctggcaaggagatcatccagcctactgtcgtcgactcggcgagcttcatggtctggaaagatgaagcgtttgagatctggtccaagggatgggcctgcctgttccctgagggngactcgtccagggagttgctagagcaggttcagaagagctattacttggtcagcctcgtggacaacgactacatcaacggggacctctttgccgcattcaaggagatctaattgcgatgatacctcacaatattccgcgtttgaccgcccttcgctagagtcctgtaatatgatttgtcgtgatttgtgccgatttatccaaaccactcaatatgaataataattttctatctgtgttcattcttc

SEQ ID NO: 1494 - DNA, 1930 bp, Secale cereale
gaggaggatgaaggtgatcgagaagatccaggaggcggcggcgaatggccggaccgtcttctccttcgagtacttcccgcccaagacggaggagggcgtcgagaacctcttcgagcggatggaccgcatggtggcgcacggccccaacttctgcgacatcacctggggcgccggcggatccaccgccgacgtcaccctcgacatcgccaaccgcatgcagaacatggtatgcgtggaaacgatgatgcacttgacgtgcaccaacatgccagtggagaagatcgataatgctttggataccattaagtccaatgggattcaaaatgttctggcacttagaggagatcctccacatggccaggacaaatttgttcaagttgctggtggattttcttgtgctctagatctggtgcagcacattaaagccaagtacggtgattactttggcataactgtcgctggctatccagaggcacaccctgaggtaatactaggcgaggaaggggctacggaggaagcatatagcaaagatcttgcttacttgaagagaaaggttgatgctggtgctgaggttatagtcacccagcttttctacgatactgatatctttctcaagtttgtgaacgactgccgtcagattggtataacctgccctatcgttcctggcataatgccgataaataactacaaaggatttgtgcgcatgactggattctgcaaaactaagataccggctgagattactgctgccttggatcctattaaagataatgaggaggctgtgaaagcatatggaatccaccttggtactgagatgtgcaagaaaattttggctagtgggatcaagactttgcacctttacacactaaacatggaaaagactgctttagcaattctgatgaatcttgggttaatagaggagtccaagctttcaagaacattaccttggaggccaccaactaatgttttccgtgtcaaagaggatgttcgccctatattctgggccaacagaccaaagagttacatttcaaggaccactggttgggatcagtacccacaggggcgatggggtgattccaggaacccatcatacggagcacttaatgaccaccagttcacacgtccacgtggacgtggcaagaagctccaagaggaatgggctgtgccactgaaatctgtgcaagacattaatgagcggtttgtgaacttctgtgaagggaaacttaaaagcagtccatggtctgagttagacggtcttcaacctgagacgacgataattgatgatcagctggtgaagattaactcagagggtttccttaccatcaacagccaacctgctgtaaatgcagagaaatctgattctcctagtgttggatggggcggtccaggaggctatgtttaccagaaggcctacgtcgagttcttctgcgctaaggagaagctgggccaactcattgagaagaccaaggcattcccttccctcacgtacatcgccgtgaacaaggaaggggaatcgatctcaaacatccctgtgaacgctgtgaacgctgtcacatggggtgtgttccccggcaaggagatcatccagcctaccgttgttgactcggcgagcttcatggtctggaaagatgaagcgtttgagatctggtccaggggatgggcctgcctgttcccggagggcgactcgtccagggagttgctagagcagattcagaagagctattacttggtcagcctcgtcgacaatgactacatcagcggggacctctttgctgcattcaagggcatctaatttcgatgatacctcacagtatgccgtgtttgaccgcccttcgctagagtcctgtaatatgatttgccgtgatttgcgtcgatttatccaaaccactcaatatgaataagaattttcgatatgtgttcctgtgcagtc

SEQ ID NO: 1495 - DNA, 2085 bp, Secale cereale
gaggaggatgaaggtgatcgagaagatccaggaggcggcggcgaatggccggaccgtcttctccttcgagtacttcccgcccaagacggaggagggcgtcgagaacctcttcgagcggatggaccgcatggtggcgcacggccccaacttctgcgacatcacctggggcgccggcggatccaccgccgacgtcaccctcgacatcgccaaccgcatgcagaacatggtatgcgtggaaacgatgatgcacttgacgtgcaccaacatgccagtggagaagatcgataatgctttggataccattaagtccaatgggattcaaaatgttctagcacttagaggagatcctccacatggccaggacaaatttgttcaagttgctggtggattttcttgtgctctagatctggtgcagcacattaaagccaagtacggtgattactttggcataactgtcgctggctatccagaggcacaccctgaggtaatactaggcgaggaaggggctacggaggaagcatatagcaaagatcttgcttacttgaagagaaaggttgatgctggtgctgaggttatagtcacccagcttttctacgataccgatatctttctcaagtttgtgaatgactgccgtcagattggtataacctgccctatcgttcctggcataatgccgataaataactacaaaggatttgtgcgcatgactggattctgcaaaactaagataccagctgagattactgctgccttggatcctattaaagacaatgaggaggctgtgaaagcatatggaatccaccttggtactgagatgtgcaagaaaattttggctagtgggatcaagactttgcacctttacacactaaacatggaaaagactgctttagcaattctgatgaatcttgggttaatagaggagtccaagctttcaagaacattaccttggaggccaccaactaatgttttccgtgttaaagaggatgttcgccctatattctgggccaacagaccaaagagttacatttcaaggaccactggttgggatcagtacccacaggggcgatggggtgattccaggaacccatcatacggagcacttaatgaccaccagttcacacgtccacgtgggcgtggcaagaagctccaagaggaatgggctgtgccactgaaatctgtgcaagacattaatgagcggtttgtgaacttctgtgaagggaaacttaaaagcagtccatggtctgagttagacggtcttcaacctgagacgacgataattgatgatcagctggtgaagattaactcagagggtttccttaccatcaacagccaacctgctgtaaatgcagagaaatctgattctcctagtgttggatggggcggcccaggaggctatgtttaccagaaggcctatgttgagttcttctgcgctaaggagaagctgggccaactcattgagaagaccaaggcattcccttccctcacgtacatcgccgtgaacaaggaaggggaatcgatctcaaacatccctgtgaatgctgtgaacgctgtcacatggggtgtgttccccggcaaggagatcatccagcccaccgtcgttgactcggcgagcttcatggtctggaaagatgaagcatttgagatctggtccaggggatgggcctgcctgttcccagagggcgactcgtccagggagttgctagagcagattcagaagagctattacttggtcagcctcgtcgacaatgactacatcagcggggacctctttgctgcattcaagggcatctaatttcgatgatacctcacagtatgccgtgtttgaccgcccttcgctagagtcctgtaatatgatttgtcgtgatttgcgtcgatttatccaaaccactcaatatgaataagaattttcgatatgtgttcctgtgcagtctctccacttgtctagtttatttgttacctaggtttattttccccaaagatgagttgaagcttttttaatgtatatatgtgctaatactagtttattgccacgacagaagtcttgtctagtttacttgggttataatttcaaacgtgtacgtgggt

SEQ ID NO: 1496 - DNA, 2065 bp, Secale cereale
gactcgacgccattagcatttagcagagcagcagggggaggaggatgaaggtgatcgagaagatccaggaggcggcggcgaatggccggaccgtcttctccttcgagtacttcccgcccaagacggaggagggcgtcgagaacctcttcgagcggatggaccgcatggtggcgcacggccccaacttctgcgacatcacctggggcgccggcggatccaccgccgacgtcaccctcgacatcgccaaccgcatgcagaacatggtatgcgtggaaacgatgatgcacttgacgtgcactaacatgccagtggagaagatcgataatgctttggataccattaagtccaatgggattcaaaatgttctggcacttagaggagatcctccacatggccaggacaaatttgttcaagttgctggtggattttcttgtgctctagatctggtgcagcacattaaagccaagtacggtgattactttggcataactgtcgctggctatccagaggcacaccctgaggtaatactaggcgaggaaggggctacggaggaagcatatagcaaagatcttgcttacttgaagagaaaggttgatgctggcgctgaggttatagtcacccagcttttctacgataccgatatctttctcaagtttgtgaacgactgccgtcagattggtataacctgccctatcgttcctggcataatgccgataaataactacaaaggatttgtgcgcatgactggattctgcaaaactaagataccagctgagattactgctgccttggatcctattaaagacaatgaggaggctgtgaaagcatatggaatccaccttggtactgagatgtgcaagaaaattttggctagtgggatcaagactttgcacctttacacactaaacatggaaaagactgctttagcaattctgatgaatcttgggttaatagaggagtccaagctttcaagaacattaccttggaggccaccaactaatgttttccgtgtcaaagaggatgttcgccctatattctgggccaacagaccaaagagttacatttcaaggaccactggttgggatcagtacccacaggggcgatggggtgattccaggaacccatcatacggagcacttaatgaccaccagttcacacgtccacgtgggcgtggcaagaagctccaagaggaatgggctgtgccactgaaatctgtgcaagacattaacgagcggtttgtgaacttctgtgaagggaaacttaaaagcagtccatggtctgagttagacggtcttcaacctgagacgacgataattgatgatcagctggtgaagattaactcagagggtttccttaccatcaacagccaacctgctgtaaatgcagagaaatctgattctcctagtgttggatggggcggcccaggaggctatgtttaccagaaggcctacgttgagttcttctgcgctaaggagaagctgggccaactcattgagaagaccaaggcattcccttccctcacgtacatcgccgtgaacaaggaaggggaatcgatctcaaacatccctgtgaacgctgtgaacgctgtcacatggggtgtgttccccggcaaggagatcatccagcctaccgtcgttgactcggcgagcttcatggtctggaaagatgaagcgtttgagatctggtccaggggatgggcctgcctgttcccggagggcgactcgtccagggagttgctagagcagattcagaagagctattacttggtcagcctcgtcgacaatgactacatcagcggggacctctttgctgcattcaagggcatctaatttcgatgatacctcacagtatgccgtgtttgaccgcccttcgctagagtcctgtaatatgatttgccgtgatttgcgtcgatttatccaaaccactcaatatgaataagaattttcgatatgtgttcctgtgcagtctctccccttgtctagtttatttgttacctaggtttattttcccaaagatgagttgaagcttttttaatgtatatatgtgctaatacagtttattgcca

SEQ ID NO: 1497 - DNA, 2155 bp, Hordeum vulgare
caagatgatggaagctccgctcaccgaggggccgccgctcttagctatggatccaccgggctgcaggcgccattagcagagcagcggggaggttcagaggaagatgaaggtgatcgagaagatccaggaggcggcggcgaatggccgcaccgtcttctccttcgagtacttcccgcccaagacggaggagggcgtcgagaacctcttcgagcggatggaccgcatggtggcgcacggccccaacttctgcgacatcacctggggcgccggcggatccaccgccgacgtcaccctcgacatcgccaaccgcatgcagaacatggtatgcgtggaaacgatgatgcacttgacgtgcaccaacatgccagtggagaagattgataatgctttggataccattaagaacaatgggattcaaaatgttctcgcacttagaggagatcctccacatggtcaggacaaatttgtccaagttgctggtggattttcttgtgctctagatctggtgcagcatattagagccaagtatggtgattactttggcataactgtcgctgggtatccagaggcacaccctgaggtaatactaggtgaggacggggctacagaggaagcatatagcaaagatcttgcttacttgaagagaaaggttgatgctggcgctgacgttatagttacccagcttttctatgataccgacatcttcctcaaatttgtgaacgattgccgtcagattggtataacctgccctatcgttcctggcataatgccaataaataactacaagggatttgtgcgcatgaccggattttgcaaaactaagataccagctgagattactgctgccttggatcctattaaagacaatgaggaggctgtgaaagcatatggaatccaccttggtactgagatgtgcaagaaaattttggctagtgggatcaagactttgcacctttacacactaaacatggaaaagaccgctttagcaattctgatgaatcttggattaatagaggaatccaagctttcaagaacattaccttggaggccaccaactaatgttttccgtgtcaaagaggatgttcgccctatattctgggccaacagaccaaagagttacatttcaaggaccactggttgggatcaatacccacaggggcggtggggtgattccaggaacccatcatacggagcccttaatgaccaccagttcacacggccacgtgggcgtggtaagaagctccaagaggaatgggctgttccactgaaatctgtgcaagacattaatgagcggttcgtaaacttctgtgaaggaaaacttaaaagcagcccatggtctgagttagatggtcttcaacccgagacaacgataattgatgatcagctggtgaagatgaactcaaagggtttccttaccatcaacagccaacctgctgtaaatgcagagaaatctgagtctcctagtgttggatggggcggtccaggaggctatgtttaccaaaaggcctacgtcgaattcttctgcgctaaggagaagctggaccaactcatcgagaagagcaaggcattcccttccctcacatacatcgcggtgaacaaggaaggggaatcgatctcaaacatccctgcgaacgccgtgaacgctgtcacttggggcgtgttccccggcaaggagatcatccagcctaccgtcgttgactcggcgagcttcatggtttggaaagatgaagcgtttgagatctggtccaggggatgggcctgcctgttcccggagggtgactcatccagggagttgctagagcaggtgcagaagacctattgcctggtcagccttgtggacaatgactacatcagcggggacctctttgctgcattcaaggagatctaatttcgatgatatcttaagtgtttgaccgcccttcgttagaatcctgtaatacgatctgtcgtgatttgtgtcgatttatccaaaccactcaatatgaataagaatttttgatatgtgttccttcttcgtgtgcagcctctccccttgtctagcttatttgttagctaggtttattttccccaaagttgagctgagcttttttataatgtatatatgtgctaatacagtttactgccacgacagatgcccggttctttattagggtta

SEQ ID NO: 1498 - DNA, 4173 bp, Oryza sativa
cccgtcccctcccctctgcccgcgcaagccgcagcagcagcatcaggggaagggtctagaagcttctagaagcttcttccgagatgaaggtgatcgagaagatccaggaggcggcggcggatgggcggacggtgttctcgttcgagtacttcccgcccaagacggaggaggggctcgacaacctgttcgagcggatggatcgcatggtggcgcacggccccaacttctgcgacatcacctggggcgccgggggatccaccgccgacctcaccctcgagatcgccaaccggatgcagaacatggtgtgtgtggaaacaatgatgcacctgacatgcaccaatatgccagttgagaagattgatgatgccttaacaacaataaagtctaatgggattcaaaatgttctggctcttaggggtgatcctccacatggtcaggacaaatttgttcaagttgctggtggattcgcttgtgctcttgatttggtacaacacattagagccaagtatggtgattattttggtattactgttgctggttatccagaggcccacccggatgcaatacaaagtacggaaggggctacaccagaagcatacagcaatgatcttgcttatttgaagcaaaaggttgatgctggtgctgaccttatcattacacagcttttctatgacactgatatctttctcaagtttgtgaatgactgccgccaaattggcataacttgccccattgttcctggcataatgcctataaataactacaaaggtttcctgcgcatgacagggttctgcaaaactaagataccagctgagatcactgctgcactggaacctattaaagataacgaggaggcggtcaaagcatatggaatccaccttggtactgaaatgtgcaagaaaattttagctactggaatcaagaccttgcacctttacacgctaaacatggagaagtctgctctaggaatattgatgaaccttggattaattgaggagtccaagatctcaaggtcattgccttggaggcccccaacaaatgttttccgtgtcaaggaggatgtccgccctatattctgggctaacagaccaaagagctatatttcaaggacccttggttgggatcaatacccacatgggcggtggggtgattcccggaacccatcgtatggagcacttactgactaccagttcactcgaccacgtgggaggggtaagaagctccaagaggaatgggcggttccagtgaaatctgttgaagacattaacgagcgattcatgaacttctgtcaaggaaaacttacaagcagcccatggtctgagcttgatggccttcaacctgagacaaagataatagacgaccaattggtgaagattaaccagaagggcttccttaccattaacagccaacctgctgttaatggagagagatctgattcaacaagtgttggatggggtggtcctggaggctatgtttaccagaaggcctatcttgagttcttctgttcaaaagagaagctggatcagctaattgagaagagcaaggcattcccttctcttacatacattgccgtgaacaaggacggagagtcattctcaaacattcccacaaacgctgtgaatgcggtcacatggggtgttttccctggcaaggaaatagtccagccaactgtcgttgactcagccagctttatggtttggaaagacgaagctttcgaaatttggtcaaagggttgggcttgcctgttccctgagggcgactcatctagggagatactagacaaggtccagaagagctacttcttggttagtcttgtggacaacgactacatcaacggtgatctcttcgcggcgttcaaggagatttgatgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcacctcagaacgggaccatgcccatgccggcgccggcgcgtggcgtcgtccccttcacccgcggcgacgcgaagagcgacgagtagaagtcgtcgcccggcggcagcatgtcgaggccgctgtacatgccctggatatcgtcgtagctcaggtccacgaacaggctgctgttgttcctggggatggtggcggcggcggcggcggccgcggtggcgtcgtccatcgattctttcttgggcaccatcatcgccgtcgccggcggcggcgcaggctggaacgccgggaacgagtccagctccgggaaggggtcgttgtccacgatctccgactccggcgtgcgcgtctcgccccacgagtgggtgtgcgagtgcgactgcgacgtaaccatgtcggacgcctcctccttcacctccttcccctgctgcatcttctcccactcgttcttcttgttgtacagccgacacagcacccaatcatccaactgcacaaacaattcacaccagatcagatcagaccacgatccaattatcgatcatcactcccaccgaataatcttcgatcgaagcaaggatcattgctagtaattcggatgaatctgagctaagcttaccctgagagatcccttcttggcgcccgcggcggcgcggccagcatcggcgagccggtactcatgcatgatccaatcagtcttgacccctcgcggcgccttgccggcgtagaacacgagcgccttcttgatcccaagcgtgcgcccccgcggcgcgacgggcttgtcggcgccggtggccttccagtacccgttgccggcggcgcggttggggcgtgacccattaggatacttgcgatcccgcggggtgaagaagtaccactccctggcgccgaacagcgcgcgctcgggcagatcccacgggtcgaacttgtagagatccacctcggcgatgatcggcaccggcaggcgctgccccgccgccttcctgcacaggtagtgctccaccagctcgtcgtccgtggggtggaacctgaaccccggcggcaggttcagctccgcctccgcgtccctctccctcctcatccccatccccatcgcttcttgcttgcttctcgctgctgctactgctttgcgttgtttgaaaatgttgtgggttgtgagggatttctcgaatggggagaaatggcgggcggagggggggatatatagagggaggtagtctggaaggttcggcggcggggggatgagtcaaagcggagtcggcggctgcgggaagaagaggagatgggatgaaatggggcacgtgtggtggtgaggtggtgggtttcgaggaaggaggccacctcctgcgtcggggattggacccgtgcgaggatggcgtcacggccgaggtcagcagaattgggacagctcggcgccgcggtcgggtcggcggtgcg

SEQ ID NO: 1499 - DNA, 2070 bp, Oryza sativa
tcccctctgcccgcgcaagccgcagcagcagcatcaggggaagggtctagaagcttctagaagcttcttccgagatgaaggtgatcgagaagatccaggaggcggcggcggatgggcggacggtgttctcgttcgagtacttcccgcccaagacggaggaggggctcgacaacctgttcgagcggatggatcgcatggtggcgcacggccccaacttctgcgacatcacctggggcgccgggggatccaccgccgacctcaccctcgagatcgccaaccggatgcagaacatggtgtgtgtggaaacaatgatgcacctgacatgcaccaatatgccagttgagaagattgatgatgccttaacaacaataaagtctaatgggattcaaaatgttctggctcttaggggtgatcctccacatggtcaggacaaatttgttcaagttgctggtggattcgcttgtgctcttgatttggtacaacacattagagccaagtatggtgattattttggtattactgttgctggttatccagaggcccacccggatgcaatacaaagtacggaaggggctacaccagaagcatacagcaatgatcttgcttatttgaagcaaaaggttgatgctggtgctgaccttatcattacacagcttttctatgacactgatatctttctcaagtttgtgaatgactgccgccaaattggcataacttgccccattgttcctggcataatgcctataaataactacaaaggtttcctgcgcatgacagggttctgcaaaactaagataccagctgagatcactgctgcactggaacctattaaagataacgaggaggcggtcaaagcatatggaatccaccttggtactgaaatgtgcaagaaaattttagctactggaatcaagaccttgcacctttacacgctaaacatggagaagtctgctctaggaatattgatgaaccttggattaattgaggagtccaagatctcaaggtcattgccttggaggcccccaacaaatgttttccgtgtcaaggaggatgtccgccctatattctgggctaacagaccaaagagctatatttcaaggacccttggttgggatcaatacccacatgggcggtggggtgattcccggaacccatcgtatggagcacttactgactaccagttcactcgaccacgtgggaggggtaagaagctccaagaggaatgggcggttccagtgaaatctgttgaagacattaacgagcgattcatgaacttctgtcaaggaaaacttacaagcagcccatggtctgagcttgatggccttcaacctgagacaaagataatagacgaccaattggtgaagattaaccagaagggcttccttaccattaacagccaacctgctgttaatggagagagatctgattcaacaagtgttggatggggtggtcctggaggctatgtttaccagaaggcctatcttgagttcttctgttcaaaagagaagctggatcagctaattgagaagagcaaggcattcccttctcttacatacattgccgtgaacaaggacggagagtcattctcaaacattcccacaaacgctgtgaatgcggtcacatggggtgttttccctggcaaggaaatagtccagccaactgtcgttgactcagccagctttatggtttggaaagacgaagctttcgaaatttggtcaaagggttgggcttgcctgttccctgagggcgactcatctagggagatactagacaaggtccagaagagctacttcttggttagtcttgtggacaacgactacatcaacggtgatctcttcgcggcgttcaaggagatttgatgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcct

SEQ ID NO: 1500 - DNA, 2250 bp, Panicum virgatum
ccccccttcgccattagagagcgcgcgcagcggcgaagctcctgaggttcgagatgaaggtgatcgagaagatccagcaggccgcggcggatggccggacggcgttctcgttcgagtacttcccgcccaagaccgatgagggcgtcgagaacctcttcgagcggatggaccgcatggtggcgcacggcccgtccttctgcgacatcacctggggcgccgggggttccaccgccgacctcaccctcgaaatcgccaaccgcatgcagaacatggtgtgtgtggaaactatgatgcatctgacatgtacaaatatgccagttgagaagattgaccatgctttggaaaccatcaaatccaatgggattcaaaatgttttggcacttagaggggatcctcctcacgggcaagacaaatttgtgcaagttgaaggtggatttgcttgtgctcttgatctggtgcagcatattagagccaagtatggtgattattttggcataactgtagctggttatccagaggcacaccctgatgcgatacaaggcgaaggaggtgctacattggaagcatataccaatgatcttgcttatttgaagagaaaggttgatgctggtgctgaccttattgtcacacaacttttctatgataccgacatctttctcaagtttgtgaatgactgtcgtcaaatcggtattacttgtcccattgttccgggcataatgccgataaataactacaaaggtttcgtgcgcatgactggattctgtaaaactaagatacctgctgaaatcactgctgcactggatcctattaaagataatgaggaggccgtcaaagcatatggaatccaccttggaactgagatgtgcaagaaaattctagctagtggcatcaagactttgcacctttacacactaaacatggagaagtctgcgttagcaattttgatgaatcttggattaattgaggagtccaagatttcaaggccattaccatggaggccgccaactaatgttttccgtgttaaagaggatgttcgacctatattctgggctaacagaccaaagagctatattacaaggactctaggttgggatcagtatccacacggacggtggggtgattcccgaaacccatcatatggagcacttactgaccaccagttcacaagaccgcgtgggcgtggtaaaaagctccaagaggaatgggctgttccactgaaatctgtggaggacattagcgagcgctttacaaacttctgtgaagggaaacttacaagcagcccatggtcagagttggatggtcttcaaccagagacaaagattattgatgaacagctgatgaagattaaccagaagggtttccttaccatcaacagccaacctgctgtaaatggggagaaatctgactcgcctaccgttggttggggtggtccaggaggttacgtttatcagaaggcctaccttgaattgttctgtgcgaaggagaagttggaccaactagttgagaagatcaaagcattccctgctctcacatacattgctgtgaacaaggatggggaatcattctccaatattcctgcgaacgccgtgaatgctgtcacatggggtgttttccctggcaaggagattatccaacctacagttgttgattcggcaagttttatggtttggaaggatgaggcatttgaaatctggacgaggggatggggctgtctgttccccgagggtgactcctctagggaactactagagaaggttcagaagagctactacctggtgagccttgttgacaacgactacatccacggggatctgtttgccgccttcaaggagctctgatgatcctcttattgtctctgtatgtattgttgttgtacggccaaatccgacaactattcttgcttccccgaccacagggtctgatcgccacgaaagcttctgctcatttgacctcggaggaatcccctagtctgatttttcctgatttctttggctaattcgaaccatatgatataaataagatccgagatgtgttctctatccatttcctcccatgtgccaatggcacaatggtaagtttcaagatgtaagattcgttttcgtcgaaattgctggatgcccccagtgatcaagacaaaaaaaaaaggacgtgctgctggtattgtactgaattcgtgcctctgcttgatgtaaatgtggacagtataagatgttcatatccccgattttcgtgggaacacccaggatttta

SEQ ID NO: 1501 - DNA, 2256 bp, Sorghum bicolor
ccgcacccacttcctcctacctgcgcacagccccctccctccgctcctcgcctcggctcgccattagagcgcgcgcgccaagctagtggcgaggttttcgagatgaaggtgatcgagaagattcaggaggccgcggggaatggccggacggcgttctcgttcgagtacttccctcccaagacggaggagggggtcgagaacctgttcgagcggatggaccgcatggtggcgcacggcccctccttctgcgacatcacctggggcgccgggggatccaccgccgaccttaccctcgaaatcgccaaccgcatgcagaacatggtgtgtgtggaaactatgatgcacctgacatgtacaaacatgccagtagagaagattgaccatgccttggaaactatcaaatccaatgggattcaaaatgttttggcccttcgaggggatcctccacatggacaagacaaatttgtgcaagttgaaggcggatttgcttgtgctcttgatttggtgcagcatattagagccaagtatggtgattattttggcataactgtagctggttatccagaggcacaccctgatgcgatacaaggcgagggaggtgctacattggaagcatatagcaatgatcttgcgtatttgaagagaaaggttgatgctggtgctgaccttattgttacacaacttttctatgatactgacatcttcctcaagtttgtgaatgactgccgccaaattggtattacttgtcccattgttcctggcataatgccaataaataactacaaaggtttcctgcgcatgactgggttctgcaaaactaagataccttctgagatcactgctgcactggatcctattaaagacaatgaggaggctgttaaacaatatgggattcaccttggaactgagatgtgcaagaaaattcttgctactggcattaagactttgcacctttacacactaaacatggacaagtctgctataggaattttgatgaatcttggattaattgaggagtccaaggtttcaaggccattaccttggaggccggcaactaatgttttccgtgttaaagaggatgttcgacctatattctgggccaacagaccaaagagctatcttaaaaggacattaggttgggatcagtatccccatggacggtggggtgattctcgaaacccatcatatggagcacttactgaccaccagttcacaagaccacgtggacgtggtaaaaagctccaagaggaatgggctgttccacttaaatctgtggaggacattagtgagcgctttacaaacttctgtcaagggaaactcacaagcagcccatggtcagaattggatggtcttcaaccagagacaaagattattgatgaccagttggtgaagattaaccagaagggtttccttaccattaacagccaacctgctgtaaatggagagaaatccgactcgcctactgtcggttggggtggtcctggaggctacgtttatcagaaggcctacctcgaattcttctgcgcaaaagagaagttggaccaactaattgagaagatcaaagcattcccttctctcacttacattgctgtgaacaaggatggagaatcattctccaatattgcaccgaacgccgtgaatgctgtcacatggggtgttttccctggcaaggagattatccagcctacagttgttgatccagcaagttttatggtttggaaggacgaagcatttgaaatctggacacgggggtgggcttgcctgttccctgagggcgactcatctagggagctactagagaaggttcagaagagctactacctggtcagcctcgtcgacaacgactacgtccagggggatttgtttgctgccttcaagatctgatgatgctgttatgctctgtgttgttgtatggctgaatcacaatattcttgcttccccgactacaggtctgatcgcatgtgaaagcttctgttcatttgagctcgggggagtccgctagtcttacttttcctgatttcttttggcttactggaaccatacgatatatcaataagaaatgagttgtgttcactttacattttctccatgtgcaaatggcgcaatgggtagttttaagatgtaaaattcgtcctccaatacaggttggtattgtatcttagttagaaggatgcgctgcccgcgttgcgctgtatttgtgcttctgcttggtggaaataagattgatccaattctgatgttcaaaagtctccccca

SEQ ID NO: 1502 - DNA, 2264 bp, Sorghum bicolor
atctctgtataaacccacccgcacccacttcctcctacctgcgcacagccccctccctccgctcctcgcctcggctcgccattagagcgcgcgcgccaagctagtggcgaggttttcgagatgaaggtgatcgagaagattcaggaggccgcggggaatggccggacggcgttctcgttcgagtacttccctcccaagacggaggagggggtcgagaacctgttcgagcggatggaccgcatggtggcgcacggcccctccttctgcgacatcacctggggcgccgggggatccaccgccgaccttaccctcgaaatcgccaaccgcatgcagaacatggtgtgtgtggaaactatgatgcacctgacatgtacaaacatgccagtagagaagattgaccatgccttggaaactatcaaatccaatgggattcaaaatgttttggcccttcgaggggatcctccacatggacaagacaaatttgtgcaagttgaaggcggatttgcttgtgctcttgatttggtgcagcatattagagccaagtatggtgattattttggcataactgtagctggttatccagaggcacaccctgatgcgatacaaggcgagggaggtgctacattggaagcatatagcaatgatcttgcgtatttgaagagaaaggttgatgctggtgctgaccttattgttacacaacttttctatgatactgacatcttcctcaagtttgtgaatgactgccgccaaattggtattacttgtcccattgttcctggcataatgccaataaataactacaaaggtttcctgcgcatgactgggttctgcaaaactaagataccttctgagatcactgctgcactggatcctattaaagacaatgaggaggctgttaaacaatatgggattcaccttggaactgagatgtgcaagaaaattcttgctactggcattaagactttgcacctttacacactaaacatggacaagtctgctataggaattttgatgaatcttggattaattgaggagtccaaggtttcaaggccattaccttggaggccggcaactaatgttttccgtgttaaagaggatgttcgacctatattctgggccaacagaccaaagagctatcttaaaaggacattaggttgggatcagtatccccatggacggtggggtgattctcgaaacccatcatatggagcacttactgaccaccagttcacaagaccacgtggacgtggtaaaaagctccaagaggaatgggctgttccacttaaatctgtggaggacattagtgagcgctttacaaacttctgtcaagggaaactcacaagcagcccatggtcagaattggatggtcttcaaccagagacaaagattattgatgaccagttggtgaagattaaccagaagggtttccttaccattaacagccaacctgctgtaaatggagagaaatccgactcgcctactgtcggttggggtggtcctggaggctacgtttatcagaaggcctacctcgaattcttctgcgcaaaagagaagttggaccaactaattgagaagatcaaagcattcccttctctcacttacattgctgtgaacaaggatggagaatcattctccaatattgcaccgaacgccgtgaatgctgtcacatggggtgttttccctggcaaggagattatccagcctacagttgttgatccagcaagttttatggtttggaaggacgaagcatttgaaatctggacacgggggtgggcttgcctgttccctgagggcgactcatctagggagctactagagaaggttcagaagagctactacctggtcagcctcgtcgacaacgactacgtccagggggatttgtttgctgccttcaagatctgatgatgctgttatgctctgtgttgttgtatggctgaatcacaatattcttgcttccccgactacaggtctgatcgcatgtgaaagcttctgttcatttgagctcgggggagtccgctagtcttacttttcctgatttcttttggcttactggaaccatacgatatatcaataagaaatgagttgtgttcactttacattttctccatgtgcaaatggcgcaatgggtagttttaagatgtaaaattcgtcctccaatacaggttggtattgtatcttagttagaaggatgcgctgcccgcgttgcgctgtatttgtgcttctgcttggtggaaataagattgatccaattctgatgttcaaaa

SEQ ID NO: 1503 - DNA, 2214 bp, Saccharum officinarum
cccccctccctccgctcctcgcctcggctcgccattacagcgcgcgcgccaagctcgtgggaggttttcgagatgaaggtgatcgagaagattcaggaggccgcggggaatggccggacggcgttctcgttcgagtacttccctcccaagacggaggagggtgtcgagaacctgttcgagcggatggaccgcatggtggcgcacggcccctccttctgcgacatcacctggggcgccgggggatccaccgccgaccttaccctcgaaatcgccaaccgcatgcagaacatggtgtgtgtggaaactatgatgcacctgacatgtacaaacatgccagtagagaagattgaccatgccttggaaaccatcaaatccaatgggattcaaaatgttttggcccttcgaggggatcctccacatggccaagacaaatttgtgcaagttgaaggcggatttgcttgtgctcttgatttggtgcagcatattagagccaagtacggtgattattttggcataactgtagctggttatccagaggcacaccctgatgcgatacaaggcgaggaaggtgctacattggaagcatatagcaatgatcttgcgtatttgaagagaaaggttgatgctggtgctgaccttattgtcacacaacttttctatgataccgacatctttctcaaatttgtaaatgactgccgccaaattggtattacctgtcccattgttcctggcataatgccaataaataactacaaaggtttcctgcgcatgactgggttctgcaaaactaagataccttctgagatcactgctgcactggatcctattaaagacaatgaggaggctgttaaacaatatggaatccacctcggaactgagatgtgcaagaaaattctggctactggcattaagactttgcacctttacactctaaacatggacaagtctgctctaggaattttgatgaatcttggattaatcgaggagtccaaggtttcaaggccattaccttggaggccggcaactaatgttttccgtgttaaagaggatgttagacctatattctgggccaacagaccaaagagctatcttaaaaggacattaggttgggatcagtatccccatggacggtggggtgattctcgaaacccatcatatggagcacttactgatcaccagttcacaagaccacgtggacgtggtaaaaagctccaagaggaatgggctgttccacttaaatctgtggaggacattagtgagcgctttacaaacttctgtcaagggaaactcacaagcagcccatggtcagaattggacggtcttcaaccagagacaaagattatcgatgaccagttggtgaagattaaccagaagggtttccttaccattaacagccaacctgctgtaaatggagagaaatccgactcgcctactgttggttggggtggtcctggaggctacgtttatcaaaaggcctacctcgaattcttctgcgcaaaagagaagttggaccaactaattgagaagatcaaatcattcccttctctcacttacattgctgtgaacaaggatggagaatcagtctccaatattgcaacgaacgcagtgaatgctgtcacatggggtgttttccctggcaaggagattatccagcctacagttgttgatccagcaagttttatggtttggaaggacgaagcatttgaaatctggacacgggggtgggcttgcctgttccctgagggcgactcatctagggagctactagagaaggttcagaagagctactatctggtcagcctcgtcgacaacgactacgtccagggggatctgtttgctgccttcaagatctgatgatgctctttacggtctgtgttgttgttgtatggctgaatcacaatattcttgcttccccgactacagatctgatcgccgtgaaagcttctgttcatttgagttcgggggagtccgctagtctcatttttcctgatttcttttggtttactggaactatacgatatcaataagaaatgagctgtgttcactttccattttctccatgtgcaaatagcgcaatggctagtttcaagatgtaaaattggttgtctaatacacaggttgatattgtatgttagtctaggatgcgctgctcgcattacactataattgtgcttctgcttggtggaaataaagattgatcgaaatctgatgttc

SEQ ID NO: 1504 - DNA, 2233 bp, Zea mays
tccgcaccacctccccctgtcccccgctcctgcctcgcctcaccaccattagagcgcgcgcgccaagctcgtggtgaggttttcgagatgaaggttatcgagaagatcctggaggcggcgggggatggccggacggcgttctcgttcgagtacttccctcccaagacggaggagggggtcgagaacctgttcgagcggatggaccgcatggtggcgcacggcccctccttctgcgacatcacctggggcgccgggggatccaccgctgaccttaccctcgaaatcgccaaccgtatgcagaacatggtgtgtgtggaaaccatgatgcacctgacatgtacaaacatgccagtagagaagattgaccatgccttggaaaccatcaaatccaatgggattcaaaatgttttggccctcagaggggatcctccacatgggcaagacaaatttgtgcaagttgaaggcggatttgcttgtgctcttgatttggtgcagcatattagagccaagtacggtgattattttggcataactgtagctggttatccagaggcacaccctgatgcgatacaaggcgagggaggtgctacattggaagcatatagcaatgatcttgcgtacttgaagagaaaggttgatgctggtgctgaccttattgttacacaacttttctatgataccgacatctttctcaagtttgtgaatgactgccgccaaattggtattacttgtcccattgttcctggcataatgccaataaataactacaaaggtttcctgcgcatgactgggttctgcaaaactaagataccttctgagatcactgctgcactagatcctatcaaagacaatgaggaggctgttagacaatatggaatccaccttggaactgagatgtgcaagaaaattcttgctactggcattaagactttgcacctttacacactaaacatggacaagtctgctataggaattttgatgaatcttggattaattgaggagtccaaggtttcaaggccattaccttggaggccagcgactaatgttttccgtgttaaagaggatgttcgacctatattctgggccaacagaccaaagagctatcttaaaaggacattaggttgggatcagtatccccatggacggtggggtgattctcggaacccatcatatggagcacttactgaccaccagttcacaagaccacgaggccgtggtaagaagctccaagaggaatgggctgttccactgaaatctgtggaggacattagtgagcgcttcacaaacttctgtcaagggaaactcacaagcagcccatggtcagaattggacggtcttcaaccagagacaaagattatcgatgaccagttggtgaatattaaccagaagggtttccttacaattaacagccaacctgctgtaaatggagagaaatccgactcgcctactgttggttggggtggtcctggaggctacgtttatcagaaggcctacctcgaattcttctgcgcaaaggagaagttggaccaactaattgagaagatcaaagcattcccttctctcacttacattgctgtgaacaaggatggagaaacattctccaatatttcaccgaacgccgtgaatgctgtcacgtggggtgttttccctggcaaggagattatccagcctacggttgtggatcatgcaagttttatggtttggaaggacgaagcatttgaaatctggactcgggggtggggttgcatgttccctgagggtgattcatcgagggagctactagagaaggttcagaagacctactacctggtcagcctcgttgacaacgactacgtccagggggacctgtttgctgccttcaagatctgattatgctctcatggtctgtattgttgtatggttggacccaacaatattcttgcatccccgactacaggtctgatcgccatgaaagcttctgttcatttgagctcgggggagtccgctagtcttatttttcttgatttctcttggctttctggaaccatacgaatcaataagaaatgagctgtgttcactttccagttcctccatgtgcaagtggcgcaacggccaggttctagatgtaaaattcgtcctctaatacagaggttggtattgtatgttagtgtaggatgcgctgctcgcattgcactgttattgtgcttctgtttggtggaaataaagattggtcgaaatctgagggccagattga

SEQ ID NO: 1505 - DNA, 2345 bp, Setaria italica
atctcttcgtataaacccacccgcacccacttcccctacctgcgcactcccccttccctcctcgccattggagcgcgcgcgcagcggcgaagctacagagggttcgagatgaaggtgatcgagaagattcagcaggcggcggcggatggccggacggcgttctcgttcgagtacttccctcccaagaccgaggagggggtcgagaacctcttcgagcggatggaccgcatggtggcgcacggcccgtccttctgcgacatcacctggggcgccgggggatccaccgccgacctcaccctcgacatcgccaaccgcatgcagaacatggtgtgtgtggaatctatgatgcatctgacatgtacaaacatgccagtagagaagatagaccatgctttggaaaccatcaaatccaatgggattcaaaatgttttggcacttagaggggatcctccacacgggcaagacaaatttgtgcaagttgaaggcggatttgcttgtgctcttgacctggtgaagcatattagagctaagtatggtgattattttggcataactgtagctggttatccagaggcccaccctgatgcgatacaaggcgagggaggtgctacaccagaagcatataacaatgatctcgcctatttgaagagaaaggttgatgctggcgctgaccttattgtcacacaacttttctatgataccgacatctttctcaagtttgtggatgactgccgtcaaattggtattacttgtcccattgttcctggcataatgccaataaacaactacaaaggtttcatacggatgactggattctgcaaaactaagatacctgctgagatcactgatgcactggagcctattaaagaaaatgaggaagccgttaaagaatatggagtccaccttgggactgagatgtgcaagaaaattctagctagtggcatcaagactttgcacctttacacgctaaacatggagaagtctgctatagaaattttgaagagacttggattaattgaggagttcaaggtttcaaggccattaccttggaggccaccaactaacgttttccgtgttaaggaggatgttcgacctatattctgggctaacagaccaaagagctatattagaaggactctaggttgggatcagtatccgcatggacggtggggagattccaggaacccatcatatggagcacttactgaccaccagttcacaagactcgtgggcgtggtaaaaagctccaagaggaatgggctgttccactgaaatctgtggaggacattagtgagcgctttacaaatttctgtcgagggaagcttacaagcagcccatggtcagagttggacggtcttcaaccagagacaaagattattgatgaccagctggtgaagattaaccagaagggcttccttaccatcaacagccagcctgcagtaaatggagagaaatctgattcgcctactgttggttggggtggtccaggaggctatgtttatcagaaggcctaccttgagttcttctgtgcaaaagagaagttggatcaactagttgagaagatcaaagcattcccttctctcacatttattgctgtgaacaagtatggagtatcagcctccaatattccagcaaatgctgtgaatgctgtcacatggggtgttttccctggcaaggagattatccaacctacagttgttgattcgggaagttttatggtttggaaggatgaggcatttgaaatctggacagcaggatgggcctgtctgttccctgaggaggactcctcctctaaggagctactaaagaaggtccaggataactactatctggtcagccttgttgacaacgactacatccacggggatctgtttgctgccttcaaggagatctgatgacgctcttacacagtctgtgttgttgttgtatggctaaattcccacaaatattattgcttccccgacacagggtctgatcgcgacgaaagcttctgctcatttgaccttggaggagtcctctagtctgatttttcctgctttctttttggcttattcgaaccaaactttttcaataagagatagccatgctctttccattccctccatgaggaaatggcgcaatggctagattcatgatgtaaaattcgcttccgttatactcgctggatgctttcagtgatccacaagagaaatgtacccagaaaagggggaaaaggggggacgcgcggccggtattgtactgaatctgtgcctatgcttgtgatgggaataagatcgaccgaaaccagatgtttcacatcccgttttgaaccacttcgaatttcagaaaccatcctcacatgccac

SEQ ID NO: 1506 - DNA, 2279 bp, Pennisetum glaucum
ccgcgcccgctccttctccctctcggcgcccacttcccctcctacctgcgcactaccccccttccctcctcgccattggagcgcgcgcgcgcagcggcgacggcgaagctccagagcagaggggagggttcggttcgagatgaaggtgatcgagaagattcagcaggcggcggagaatggccggacggcgttctcgttcgagtacttccctcccaagaccgaggagggggtcgagaacctcttcgagcggatggaccgcatggtggcgcacggcccgtccttctgcgacatcacctggggcgccgggggatccaccgccgacctcaccctcgacatcgccaaccgcatgcagaacatggtgtgtgtggaaactatgatgcacctgacatgcacaaacatgccagtagagaagatagaccatgctttggaaaccattaaatccaatgggattcaaaatgttttggcccttagaggggatcctccacacgggcaagacaaatttgtgcaagttgaaggcggatttgcttgtgctcttgacctggtggagcatattagagccaagtatggtgattattttggcataactgtagctggttatccagaggcccaccctgatgcgatactaggcgagggaggtgctacaccggaagcatatagcaatgatcttgcctatttgaagaaaaaggttgatgctggcgctgaccttattgtcacacaacttttctatgatactgacatctttctcaagtttgtggatgactgccgtcaaattggtattacttgtcccattgttcctggcataatgccaataaataactacaaaggtttcataaggatgaccggattctgcaaaactaagatacctgatgagatcactaatgcactggagcctattaaagaaaatgaggaagccgttaaagaatatggagtccaccttgggactgagatgtgcaagaaaatcctagctagtggcatcaagactttgcacctttacacgctaaacatggagaagtctgctatagaaatattgaagagacttggattaattgaggagtccaagatttcaaggccattaccttggaggccaccaactaatgttttccgtgttaaggaggatgttcggcctatattctgggctaacagaccaaagagctatattagaaggactctaggttgggaacagtatccgcatggacggtggggcgattccaggaacccatcatatggggcacttactgaccaccagttcacaagacctcgtgggcgtggtaaaaagctccaagaggaatgggctgttccactgaaatctgttgaggacattagtgagcgctttacaagcttctgtcaagggaagcttacaagcagcccatggtcagagttggacggtcttcaaccagagacaaagattattgatgatcagctggtgaagattaaccagaagggcttccttaccatcaacagccagcctgcagtaaatggagagaaatctgattcgcctactgttggttggggtggtccgggaggctatgtttatcagaaggcctatcttgagttcttctgttcaaaagagaagctggatcaactagttgataagatcaaagcattcccttccctcacatttattgctgtgaacaagtatggagtatcggcctccaatattccagcaaatgctgtgaatgccgtcacatggggtgttttccctggcaaggagattattcaacctacagttgttgattcggcaagttttacagtttggaaggatgaggcatttgaaatctggacagcggggtgggcctgcctgttccccgaggatgactcatcctctaaggagctactaaagaaggtccaggataactactatctggtgagccttgttgacaacgactacatccacggggatctgtttgctgccttcaaggagatctgacggtgctcttgatagtctgtattgttgctgtactgctgaattcccacaaatatcatcgcttccccgaccgcagggttctgatggccacgaatgcctatgctcatctgacctcgggagggccctcttaagtctgatttttcctgatttcttttggcttgttcgaaccaaacttataccaataagaaatgagccatgctcttcccatttcctccacatggcgcaatggctagttttcatgatgtaaaattccttcccgttgtaattactggatgctttcagtgatccgcaagagaaatgtacgtgcccatcaaaaagaggaaaagaagggacgcgctgccggtattgtactgaa

SEQ ID NO: 1507 - DNA, 2261 bp, Musa acuminata
ctataggaacagggaagtggtgcggaggagcgaggatgaaggtgatcgacaagatacggggggcggcggagggcgatgggaggacggtgttctccttcgaattcttcccccctaagacggaggagggcgtggagaacctcttcgagcgcgtggaccgcatggtcgcccacaaccccaacttctgcgacatcacctggggcgccggcgggtccaccgccgacctcaccctcgacatcgccaaccggatgcagaacatgatctgtgtagaaactatgatgcacttgacctgcaccaatatgccggtggagaagattgaccatgctctggataccatcaaggccaatgggattcaaaatgttctggcactcaggggggatcccccacatggtcaggataagtttgttcaagttgctggcggatttgcatgcgccctcgatctcgtgcagcacattcgtgctaagtatggggactactttggtatcactgttgctggctatccagaggcacatcctgatatgatacaaggagatggaggtgctacacaggaagcctataacaatgatcttgcttatttgaagagaaaggtggatgctggtgctgaccttattatcactcagctattctatgatactgatatatttctgaagtttgtcaatgattgtcgtcaaattgggataacttgtccaattgtacctggcatcatgccaatcaacaactataagggcttcttgcgaatgactgggttttgcaaaactaaaataccacctgagattacagctgctttggatcctattaaagacaatgaagatgctgtcagggcatatggagttcacttagggactgaaatgtgcaagaagattttatctcatggaatcaaaacattgcatctttacacactaaacatggagaagtctgcattggccatattaatgaatcttggtttgatagaagagtctaaagtttcaagatccttgccttggagacgtccggcaaatgtttttcgtgtcaaagaggatgttcggcctattttctgggctaatcgtccaaaaagttacatctcaaggactgttggttgggatcaatatccacatgggagatggggtgattctaataacccatcatacggagctttaactgattaccagttcatgcgcccacgatcacgggacaagaaacttcaagaagaatgggcaaccccattgaaatctgtggatgatatcaacgagaggtttatgaaattctgcctgggaaaactgagaagcagcccatggtcggaattagatggtcttcaaccagagacaaagataatcaatgaacaactgtcacaggtcaacttgaagggttttctaactattaacagtcaacctcctgttaatggagagaaatccgactctcctgctgttggatggggtggaccagggggttatgtttaccaaaaggcgtatctggaattcttttgttcaaaagacaagctaatttcaatcactgaaaattgcaaggctttgccatctctcacatacattgctgtgaacaaagaaggggagtatgtctccaatgttgttctcaatgcagtcaatgcagtaacatggggtgttttccctggcaaagagatcatccaaccaactgttgtggaccctgctagcttcatgatctggaaggatgaagcttttgagatttggacaaggggatgggctcgattgtttcctgagggtgatccatcaagggagctactagctcaggtgcaaaaaagttgcttcttggttagccttgttgacaatgattatattcatggtgacatttttgctgctttcaaaggcgcgtgaaacgttttgactcaaaagtctactcgtctgtcgtagcaacattttgtctgtgatttatctagtaatgagcagacgagagtccacttatccgaatttgcgttctaatggatgcattagtttttcttttacaatcatttctagaacgattgtttaatttgcataaataaactgaattgccaggtgcggtcctgatgtttctttgtttgcatatcaatgtgcctgctcttggctgtggatgttctttctgttgcctcttgtcctgtttgtgctatgatttcttcacaaagcttgaaagcattttacagcttgagaacatgaaatcaactgtgtcattgactttgtaactaatgcagactctctctaaaatctttcataggttgtgatacacccaacactggctttgtcattgtgttgcagaagttatttgcacagaaaaat

SEQ ID NO: 1508 - DNA, 2101 bp, Elaeis guineensis
cgcttctcggacgacgctacagacgctattaacggcagcagagagagctccgaagagaagaagagatgaaggtgatagagaagatccgggcggcggtggagggggatggccggacggtgttctccttcgagtatttccccccgaagacggaggaaggggtggagaacctcttcgagcgcatggaccgcatggtcgcccacaaccccgccttctgcgacattacgtggggcgccggcggctccaccgccgatcttaccctcgaaatcgccaaccgcatgcagaacatgatctgcgtggaaacaatgatgcatttgacttgcaccaacatgccggtggagaagattgaccatgccctagacaccatcaagacgaatgggattcagaatgttttggctctaagaggggatcctcctcatggtcaggataagtttgttcaggttgctggtggatttgcctgtgcccttgatctggtgcagcacattcgatccaagtatggtgactactttggcataactgttgctggctatccagaggcacaccccgacatgatacaaggtgaaggaggtgctacattagaagcctacagcaacgatcttgcttatttgaagagaaaggtggatgctggtgcagattttattatcacccagttgttttatgacactgacatatttctgaagtttgtgaatgattgccgtcaaattgggataacttgtcccatagttcctggtataatgccaattaacaactataagggcttcttgcgtatgactggtttttgtaaaactaggataccacctgagattacagctgccctggagcctattaaagaaaatgaagaggctgtcaaggcatatggaatccaccttggaactgagatgtgcaagaagattttagctcatgggatcaagacattgcatctttacacactaaacatggagaagtccgcgttggccatattaatgaaccttggattaattgaggaatctaagatttcaaggtccttaccgtggaggcgaccaacaaatgtttttcgtgctaaagaagatgttcgacctatcttttgggctaatcgtccaaaaagctacattgcaaggactcttggttgggaacagtacccacatgggaggtggggagattctcgtaacccatcatatggagcccttacagactatcagtttatgcgcccacgagcacgggacaagaaacttcaagaggaatgggcaatcccattgaaatctctgaatgacatcaaagagaggttcatgaacttctgcctgggaaaacttagaagtagcccatggtcagagctagatgggcttcagccagagacaaagataattgatgaacatctcggagaaatcatcttaaaaggttttctcaccatcaatagccaacctgcaattaatggagagaaatccgattctcccactgttgggtggggtggaccagggggatacgtctatcagaaggcttatcttgaattcttctgttcaaaagagaagttaaatttactgattgaaaagtgcaagggatttccatctctcacatatgttgctgtgaacagagaaggggaatgtctctccaatattgccccaaatgctgtcaatgcagtgacatggggtgttttccctggcaaagagatcgtccaaccaactgttgttgatcctgcaagcttcatggtttggaaggatgaggcatttgagatctggacaaaaggatgggcatgcttgtttcctgacggtgacccatcaagcgaattattagagcaggtgcagagaaattactttttggttagtcttgttgacaatgattatgttcatggagatctgtttgctgctttcaaggatatatgaactaggacaattcttttactcgaggcccagcaacttccttcagttaccatgttgcgttacagttataacagatcgaaaggcagtttgaatgcctgaaatcacccttaccgtttgggtttgaatatccggttttcttctgcaaatggaatgaattgaattttcgagaacttacaagttcatgtcagtcatgctgtttaattcattaataaattcaatgagcagataagctcacgtttgcttcaaaaaaa

SEQ ID NO: 1509 - DNA, 2528 bp, Musa acuminata
gtgcgattaagacccgagcaagaagaaaaaggtggtgtagaaaatgtcgacggagatcaagtagaggtggtaggtgagccgagagcagatccgatcgagtggaatgtagtgtaacctattccctctggggtttataaggggagtcatgtagccaaacacaaagctgcgatcgagtgggagaggaaggcgaaggggaggagtgatgaaggtgatcgacaagatccgggcggcgaccgagggcgatgggaggacggtgttctccttcgagtttttccctccgaagacggaggagggcgtggagaacctcttcgaacgcatggaccgcatggtcgcccacaacccaaccttctgcgacatcacctggggcgccggcggatccaccgccgacctcacccttgacatcgccaaccggatgcagaacatgatctgtgtggaaactatgatgcatttgacttgcacaaatatgccggtagagaagattgaccatgctctggataccatcaaggccaatgggattcaaaatgttctggcactcaggggagatcctcctcatggtcaggataagtttgttcaagtggctggtggatttgcatgcgccctcgatctggtgcagcacattcgggctaaatatggagactactttggtatcacggttgccggctatccagaggcacatcctgacatgatacaaggagatggaggtgctacactggaagcctataacagtgatctggcttatttgaagagaaaggtggatgctggtgctgatcttattatcactcagctattttatgacactgataattttctgaagtttgtcaatgactgtcgtcaaattgggatcaattgcccaattgtacctggtatcatgccaatcaacaattataagggcttcttgcgaatgactgggttctgcaaaactaaaataccatcggagattacagctgctttggaaccaattaaggacaatgaagaggctgttagggcatatggaattcatttagggaccgaaatgtgcaggaagattttagctcatggaatcaaaacgttgcatctttacacattaaacatggagaagtctgcattggccatactaatgaattttggattgatagaagaatctaaagtttcaaggtccttgccttggagacgtccagctaacatttttcgtgtcaaagaagatgttcgacctattttttgggctaatcgaccaaaaagttacatttcaaggactgttggttgggatcagtatccacatgggagatggggtgattctaataacccatcatatggagctttaactgattaccagttcatgcgcccacgctcacgggacaagaaattccaagaggaatgggcaacaccattgaaatctgcggctgatattaatgagagatttatgaaattttgcctggggaaacttaggagcagcccttggtcagaattagatgggcttcagccagagacaaagataatcgatgaacaactgtcacaggttaacttgaagggttttcttaccattaacagtcaacctgcagttaatggagagaaatctgactcttctgctgtcggatggggtggaccagggggttatgtctatcaaaaggcctatctggaattcttttgttcaaaagacaagttaaatttaatcattgaaaagtgcaaaactttgccatcccttacatacattgctgtgaacaaagaaggggattccgtctccaatgttgcaccaaatgctgtcaatgcagtaacatggggtatttttcctggcaaagagataatccaaccaactgttgttgatcctgcaagcttcatgatttggaaggatgaagccttcgagatttggtcaaggggatgggcccgcttgttccctgagggcgatccatcaagggagttactagaacaggcacagcgaagttactacttggttagccttgtcgacaatgattacattcatggcgacatctttgctgctttcaaggacatatgaagtgattcaatccatcaagtctacccattaccattaccaacacttgtctgtgatttagcatgtgatgtcattacctcatatatggaaaccggggatggtaatcggtccactgctcatcgtgcattccactggatgcgctaaaatgcttccagtcattaccttgaactatcatttagttttcacaaataaaccgattgaccagatgtgttcctggagctgctctggttttgggtgtggatgttctttctgttgctattgttgtttactgagcttcttgttcctcgatgtcttcaaggaacttaaagttgaataccatgggtggaaatgttcaggagaaatgtcacaagaactggatgtctcgacattcaaccaagtctgagttttatgtcattttatgttcttccgaggaaactgaattagtagtgttaattgttagccttagttatttttttggaagttatatcatgcatattacatttatcgaacgatggatgagaggagattggagattggacggttgacgttgcaattggtgacg

SEQ ID NO: 1510 - DNA, 1725 bp, Pseudoroegneria spicata
  misc_feature (1630)..(1630): n is a, c, g, or t
cgccaaccgcatgcagaacatggtatgcgtggaaacgatgatgcacttgacgtgcaccaacatgccagtggagaagatcgataatgctttggataccattaagtccaatgggattcaaaatgttctggcacttagaggagatcctccacatggccaggacaaatttgttcaagttgctggtggattttcttgtgctctagatctggtgcagcacattaaagccaagtatggtgattactttggcataactgtcgctggctatccagaggcacaccctgaggtaatactaggcgaggaaggggctacggaggaagcatatagcaaagatcttgcttacttgaagagaaaggttgatgctggcgctgacgttatagtcacccagcttttctacgataccgatatctttctcaagttcgtgaatgattgccgtcagattggtataacctgccctatcgttcctggcataatgccaataaataactacaaaggatttgtgcgcatgactggattctgcaaaactaagataccagctgagattactgctgccttggatcctattaaagacaatgaggaggctgtgaaagcatatggaatccaccttggtactgagatgtgcaagaaaattttggctagtgggatcaagactttgcacctttacacactaaacatggaaaagactgctttagcaattcttatgaatcttggattaatagaggagtccaagctttcaagaacattaccttggaggccaccaactaatgttttccgtgtcaaagaggatgttcgccctatattctgggccaacagaccaaagagttacatttcaaggaccactggttgggatcaatacccacatgggcggtggggtgattccaggaacccatcatacggagcacttaatgaccaccagttcacacggccacgtggacgtggtaagaagctccaagaggaatgggctgttccactgaaatctgtgcaagacattagtgagcggttcgtgaacttctgtgaaggaaaacttaaaagcagcccatggtctgagttagacggtcttcaacccgagacgacgataatcgatgatcagctggtgaagattaactcgaagggtttccttaccatcaacagccaacctgctgtaaatgcagagaaatctgattctcctagtgttggatggggcggcccaggaggctatgtttaccagaaggcctacgtcgaattcttctgtgctaaggagaagctggaccaactcatcgagaagagcaaggcattcccttccctcacatacattgccgtgaacaaagaaggggaatcgatctcgaacatccctgcgaacgccgtgaatgccgtcacatggggtgtgttccccggcaaggagatcatccagcctaccgtcgtcgactcggcgagcttcatggtctggaaagatgaagcgtttgaggtctggtccaggggatgggcctgcctgttcccggagggcgactcgtccagggagttgctagagcaggttcagaagagctattacttggtcagcctcgtggacaatgactacatcaacggggacctctttgctgcattcaaggagatctaatttcgatgatcccttacagtatgccgtgtttgaccgcccttnggtagagtcctgtaatatgatttgtcgtgattgtgtcgatttatccaaaccactcaatacgaataagaattttcgatctgtgttcttcgtgtgca

SEQ ID NO: 1511 - DNA, 2252 bp, Phalaenopsis aphrodite
gggttggtaaggtggacgtagctggtgagtggcgaccaagaatggtaggtgtgtgattgggacgacgagagaacttcggtgggcgagtggcccccaactctccgcacccgggagaagaggactcttcttcttctccttcctcgctcatttaaaaacctaacaaatttctcctctcgcattcgcctttgcacgagtctataaaggcccattctcaagcggcctccttgtgaaacgagaggggagaggaaaaatgaaagttatcgagaagataagggaggccgtcgatggcgaagggaggacggtgttctcctttgagttctttccaccgaggacggacgaaggtgtggagaatcttttcgagcggatggatcgcatggttgcccacaacccaacattctgcgatatcacctggggtgcgggtggttccaccgcagacgtcaccttagaaattgccaatcggatgcagaacatgatctctgtggagacaatgatgcatttgacttgcacaaacatgccaattgagaagattgacaatgctttggataccatcaagaacaacggaattcaaaatgttttggcacttagaggggatcctcctcacggtcaggacaagtttgttcaagttgagggtggattttcatgcgctcttgatttggtaaagcacattcgagcaaaatatggtgattactttggtataactgttgctggttatccagaggcacatcctgatatgatccaagaaaatggtgctactttggaagcttacagtaatgatctcgcttatttaaagaaaaaggtggatgcgggtgcagatttgataatcactcagttattttatgatactgacgttttcctcaagtttgtgaatgactgccgtcaaattggaataagttgcccgatagttccgggcatcatgcctataaataactacaagggatttttgcgaatgactggattttgcaagactaagattccatccgatattactgctgccttggatccaattaaagacaatgaggaagccgtcaaggcatatggaatccacttaggaactgagatgtgcaagaaaattttatctcacgggattaaaacattgcatctctacacactgaacatggaaaagtcagcgctagccatattaatgaatcttggattaattgaggagtccaaggtcacaaggtctttgccatggaggcctcctgcaaatgtgtttcgagctaaagaagatgttcgaccaattttttgggctaatcgtccaaggagttacattttgagaacctcaggttgggatcagtacccacatggcaggtgggctgattctcaaaacccatcatatggagctcttactgaccatcagttcatgcgtccacgtgcacgagataagaaacttcaagaagaatgggctaccccaatcagatcaattgaagacgttcgtgagaggtttatgagttactgcctgggcaaacttaaaagcagtccatggtctgatctggatgggcttcagccagaaacaaagataatagatgaacatttaggtcaaattaacttgaaaggtttccttaccatcaacagtcaacctgcagtcaacggagtgaaatctgcttctcctactgttggatggggcggtccagggggctatgtttaccagaaggcctatattgaatttttttgctcttcagagaaactaaagcagctgattgaaaagtgcgaagcagttccatctctcacttacattgctgtgaacaaggaaggacacagtctctccaatgttggcactaatgcagttaatgcggtgacttggggtgttttccctgcaaaacaaatcattcaaccaactgttgttgatcctgctagctttatggtgtggaaagatgaagcttttgaaatctggacaagaggatgggcttatttgttccctgaatctgatccttcaagggctttgctggaggagatccagagaagttactacttggtcagcctcgttgacaatgatttcatccatggcgatctttttgctgcattcaaggacatctaaagctcggccatctgcttgagagccttaaaagttcagtttacctcagtagccattatcctcctcaacatctcctagctggaaaaagctgggaaattgggatgctatgttgttattcttttgcttttttattgccatgattttaattttatgaatccttggattaattatgttgcttaagctgtattacaggagatgatgcttttttgtataccaaaat

SEQ ID NO: 1512 - DNA, 2036 bp, Eschscholzia californica
ttcaagatctggttctgtgataaagagaagaacaccgtcagctatagagagagaaaatgaaggtgatagagaagattcaacaagcagcggctgatgatcgagtcgtcttctcgtttgagttctttccaccgaaaacagatgatggagttgagaatctcttcgaacgtatggatcgaatggttgctcataatccttccttctgtgacattacttggggagctggtggttcaacagctgatgttactcttgacattgctaatcgtatgcaaaatatgatctgtgttgaaacaatgatgcatttgacttgtacgaatatgcctgtggagaaaattgatcacgctcttactactattaagtctaatggaattcagaatgttttggctttgagaggtgatcctcctcatggacaagataagtttgttcaagttgaaggtggacttgcttgtgctcttgatttggtgaaacacatcagagagaaatatggtgattactttggcataactgttgctggttatccagaggctcatcctgatatgattcaaaccgacggtttggctaccccagaagggtacgagaaagatcttgcttatttgaagaagaaggtcgatgctggagctgatgtcattgtcacacaactcttctatgacactgataatttcttgaagtttgttaacgactgtcggcaaattggaattacttgtccaattgtccccgggattatgccaatcaataactacaagggtttcttgcgtatgactggcttctgcaaaactaagattccagctgaaatcatggctgctctagagcctatcaaggacaacgaggaagcagtcaaagcctacggaatccacctcggaacagaaatgtgcaagaagattttagcccatggaatcaaaactttgcatctgtacacacttaacatggacaaatcagctttggctatattactgaatcttggactgattgaagaatccaagatctcaaggcctttgccctggaggcgcccaacaaatgtcttccgtgtcaaagaagatgttcgaccaatattctgggctaatcgtccaaaaagttacatttcaagaaccatagggtgggatcaatacccacatggtcgatggggtgactctcgcaatccttcttatggagcattgaccgaccatcagtttatgcgacctcgttcacgtgacaagaaacttcaagaagaatggggagtcccactaaaatctgttgaagacatccaggagaaattctcaaaactctgccttggaaaagttaaaagcagtccttggtcagaacttgatgggcttcaagcagagacaaagatcataaatgaactgttgggaaacatcaatttgaagggataccttaccatcaatagccaacctgccgtcaatggagagaaatctgattcaactactgttggttggggtggaccaggtggatatgtctaccagaaggcataccttgaatttttctgttcagaggaaaggttgaaaggtctgattgagaaaagcaagggcttcccatctcttacatacatagcagtgaacaaagaaggaaaatccttgtcaaatgttggtccggctgacgtgaatgccgtgacatggggtgttttcccggcaaaggagattatccaaccaactgttgttgaccctgctagctttgttgtgtggaaggatgaggcttttgagatctggaccaaggtttgggcacgcatgtacccagaaggcgactcgacaaagagtttattggaatcggtacaaaacacttatttcttggtcagcttggttgataacgattatgtcaacggagatttgtttggtgtgtttaaggaactctaaattggtacttgctctatcatattaagagtattagtttggtgtttgtgccagaagtaatttttattgcggaatgatgtcagtgtaatttgccttatcagtttcattttatgttctcctcttgatgtgaattgcatctagagttgcagtcgttttgtagaaactgattcctatgtatgttcttattttcttgtatta

SEQ ID NO: 1513 - DNA, 2148 bp, Papaver somniferum
taacgagctcgttatcttcttctttctctccatttgatacccatttttctttcttctggatcttaattgcagaagaagaatttaaatagaaagagaaaatgaaggtaattgagaagatccaagaagctgctttaaatgacaaagtagttttctcattcgagtttttcccaccaaaaactgatgatggagttgagaatcttttcgaacgtatggatcgtatggtttctcataatccttcgttttgtgatattacatggggtgctggtggttctactgctgatctcactctcgacattgccaatcgtatgcaaaaccagatctgtgttgaaacaatgatgcatttaacatgtacaaatatgccagtggagagcattgatcaagctttgaattcaatcaagggtaatggaattcagaatgttttggctttaagaggagatcctcctcatggtcaagataaatttgttgctgttgagggtggatttgcttgtgctctcgatctggtgaggcatattaaaaagaattatggtgatttttttggaatcactgttgctggttacccagaggcacatccggaagtgattggagaggatggtgtggcatctcctgaagcttaccagaaggatcttgcttacttgaaagaaaaggttgatgctggagcagaagtcattgtcactcaactcttctatgatactgataatttcttgaagtttgttaatgactgccgacaaattggaattgcttgtcccattgtaccaggaattatgccaatcaataactataagggttttgtgcgcatgactggcttttgcaaaactaggataccagctgagattatggctgctctagaacctattaaagacaacgaagaagcagtcaaagcctacggtatccaccttggtacagaaatgtgcaagaaaatattagctagcggtatcaaaacattgcatctttatacactaaacatggacaaaacagcattggctatattgcagaatcttggtctaattgaagaatccaagatctcaaggactctgccctggaaacgcccaacaaatgtcttccgtgttaaagaagatgtccgaccaattttctgggctaatcgtccaaaaagctacatttcaaggaccagaggatgggagcaatacccccaaggtcgatggggtgattctcgcagccccgcttatggtgcgctgacagaccatcagtttttgcgaccacgatcaaaagacaagaagcttcaggaggagtgggctgtgccattgacatctgttgaagacattaacgagaaattttcaaaactatgcctgggaaaacttaaaaccagtccttggtcagaattggatggacttcagccagagacaaagatcataggtgaacagttgggaggcattaattcaaaggggttccttaccatcaatagccaacctgcagtcaatggggtgaaatctgattcaccatctgtcgggtggggtggacccggtggatatgtttaccagaaggcctaccttgagttcttctgctccaaggacaggttgagctcactggttgaaaaatgcaaggccttcccatctctcacctacatcgctgttaacaaagctggagaaaccttgtctaatgtgtcccctgctgatgtgaacgcggtgacatggggagtctttccagcaaaggaaatcatccaaccaactgttgttgaccctactagttttgttgtgtggaaggatgaggcttttgagatctggacaaggggatgggcacgtatgtaccctgaaggggattcttcaaggactgtattggagtcggtgcaaagcaattatttcttggtcagtttggttgataatgactatatcaatggggatctgtttggtgttttcaaggatctgtgaaaactacctacattatctcttccccactgttttatttaaagagtagcatattgtgattttacgggaagtgtcgtcttggtgcaaattatctgcacaatatcatactttatattgcattttagtttccgtttatattgcccttctcctgatgtgaaccacatctagagtgttggccctcagtcttgaaaatgaagctcttctcgtgttttctcttcttctttttacaatttgtatcaaataattaatttattatttagtaaaatgg

SEQ ID NO: 1514 - DNA, 2326 bp, Quercus alba
atgggggtcggctcctcgaccgcggggttgttgagctgagagttttgtaattgtggggtttctctctctataaaatgggaacagacaatcaatctctctgtgtgtcctttttctcactcctctctaatctctaatttctttcttacttataatagagtgaaatttaatctaattcatcatctttattatttttatttttattagtagagtgtcggtggtgatttcacagatctgagtgtgagtgggaaaaatgaaggtaatagagaagatccgggaggcaggggaagaaaaagtggtgttctcgttcgagttcttccctccgaaaactgaagatgcagtggacaacctgttcgagaggatggagcgtatggtggctcacaaccccacattctgcgacatcacttggggagccggtggttccaccgccgatctcactctcgacatcgccaacaggatgcagaacatgatctgcgtcgagtccatgatgcatctcacctgcaccaacatgcctgttgagaagatcgatcacgctcttcaaaccatcaaggttaatggtctccagaacgtcctcgctctccgtggtgatcctcctaaaggccaggacaagtttgttcagatcgagggtggctttgcttgtgctctcgatctcgtgaaacatatcagagcccaatatggtgactactttggcattaccgttgctggttatccagaggcacatcccgatgcgatcggagaaaatgggttggctacactcgaagcttatcacaaggatcttgcttatctcaagcagaaggtggatgccggagcagatgtaatcatcacacaattgttttatgacactgacatttacctcaaatttgtgaatgattgtcgccaaattggaattacttgccccattgttcctggaattatgcctattaataactacaagggcttcattcgcatgactggtttttgcaaaactaagatacctgctgaaattatggccgccttggagcctatcaaggacaatgaagaagctgtcaaagcctatggaattcatcttggaactgaaatgtgcaagaagattttagctcatgggattaagacagtgcatctttataccctaaacatggagaagtcagcattagctatattaatgaatcttggtctgattgaagagaccaaaatttcaaggtccctgccttggagacgcccgactaatgttttccgtgtgaaggaagacgttcgtccaattttctgggctaatcgtccaaagagctacatatcaaggactataggctgggaccagtacccacatgggcggtggggtgattcttgcaatccatcatatggagcattaagtgactatcagttcatgcggccacgagcacgtgacaagaaacttcttgaagaatgggctacacccttgacaaatgttgatgatattcaggagaaatttaagaaatactgccttggaaaattgagaagcagtccatggtcagagttagatgggcttcagccagagacacgaatcataaatgagcagctggggaagattaatacaaagggattcctcactgtcaatagccaaccagcagtcaatggggaaaaatctgattccccatctgttggatggggtggacctggagggtatgtttatcagaaggcatatgtagagtttttctgttccagggagaagttggatgcacttgttgccaaaagcaaggctttcccatctctaacctacatggctgtgaacaaagaagggaattggatatccaatgtccaccaaactgctgtgaatgctgtgacatggggagtcttccctgcaaaggagataatccaaccaactgttgtggatcctgccagctttatggtgtggaaggatgaggcctttgaaatctggtcaagggggtgggcttccttgttcccagagggtgatccatccagaaaactgcttgaagaggtccagagcagctattacttggtcagcttggtggataacgattacatccatggtgatctttttgctgtttttgcagatttctgagatgaactgtgatctcggtctctctttaattctgggttcaaggtggtttatataattgttgttggaatgtgtcaatttataatcttattggtttgtattaataattcattgggattttgataactcccccctccttcatgatgcaaattttatatttggaataacaagtaatcgcggttaggtaatagaagtatgccagtgtcccgctagttcaatgggatttcacggaagcaatctatattgaatttgtggaaaacaccgatctttgtacggtaatgctaggcccctgattct

SEQ ID NO: 1515 - DNA, 2177 bp, Aristolochia fimbriata
gaggatgaaagtgatcgagaagattagagcggcggaggcggaaggaaagacagtcttctcgttcgagtacttcccgccgaagactgaagatggagtggagaatttattcgagaggatggatcggatggtggcgcacggaccgcatttctgtgacattacgtggggcgccggcggatctactgcagatctcacgctggatatcgccaaaaggatgcagaacatggtgtgtgtagagaccatgatgcatttaacgtgcacaaacatgccagtggaaaaaatcgaccatgcacttgacaccattaaggcgaatggaattcaaaatgttctggcgcttagaggcgatcctcctcatgggcaggataagtttgtccaagtagagggaggatttgcttgtgctcttgatctggtgcaacatattcgttctaaatatggtgattactttggcataactgttgctggttatccagaggctcatcccgacatgatagaaggggaaggtgctactttagaagcatacagcaatgatcttgcttatttgaagagaaaggtggatgctggtgcagaccttattatcactcagctattttatgacactgacattttccttaagtttgtgaatgactgccgacaaattggaataacttgcccaattgtgcctggaattatgcctattaacaactacaagggcttcctacgtatgactgggttttgcaaaaccaaggtaccagctgacattatggctgccctggagccaataaaagaaaatgaggatgcagttaaggcttatggagtgcatcttggaactgaaatgtgtaagaagattttgtcacatggcatcaagaccctgcatctttacacactgaacatggaaaaatctgcattagctattttgaagaaccttggcttagttgacgagacaaagatctcaaggcctctaccatggcggcggccagcaaatgttttccgtgtcaaagaagatgttcgcccaattttctgggcaaaccgtccaaaaagctatatagcaaggactcttggctgggatcagtatccacgtggacgatggggtgattcttgtaatccatcatatggagcactgagtgaccatcaattcatgcgaccacgtgcacgtgacaagaaacttcaagaggagtgggctgtccccttaaagtctattgaagatatacgcgatagattcatgaacatctgtttgggtaagctcaaaacaagtccttggtcagagttagatgggctccagccagagacaaagatcattgatgagaaattaggacagattaacttgaatggtttccttactatcaatagtcaaccagctgtcaacggggagaaatccgactctccaacagtcggatggggtggtcctggtggatatgtgtatcagaaggcctatttggagttcttctgctccagagataagttagattcgctggtcagtaagtgcagtgctctaccggctcacaccttcatggctgtgagtaaagaaggccaatgcatgacaaacgttggcccagatgctgttaatgctgtcacttggggtgttttccctgcaaaggagattattcagccgactgttgtggaccctgcaagttttgttgtgtggaaggatgaggcattcgagatctggacaaagggatgggcgaacttgtacccagaagatgatccctcaaggaaattactggaagaggtgcaaagaagttatttcttggttagcctggtggataatgactacatcaatggagacatcttcgcagtattcaaggatatctgagttgctgctttttggttacacatcgtggcgcattgtctctcatgcaatggaatcaatattaaggacgtcagcaggagttgggtcttgttgtagtcagtaagagaaaaaaggcagtagtcaagagaagagcctgtttagtgttcaatcaaagttatgcatcctatttctagtttaattgcgtattgttaaggtgaaacaatatttctttcaccccgtctattgaactgctgctacacgaggaatgcactatgaaaggagcctgctatcaaatttgtttactcctgttgttgtctccccccagtgggaaatgaagtttaatttccaccggctttctttctccctttgcctgtcactgaagtttaatttccactggctttcttcgtttacttaa

SEQ ID NO: 1516 - DNA, 2395 bp, Platanus occidentalis
ggccttccacagttatttttaaaggagtcgggccaaccgtccggacataggagaatcaacataggaatccgaggctaaatcaagcgctaattcgggctctggagcggaatccacaggcgattcgggctcagaatcagaatcagaatcaggagcaatatagtcttcgtctgcgtcttctcctatagggatagagcaataagagtgccttgctcgctgtcaagatctctgttctgtttcttggtttatggtcggtggggaacgaggtgccgttggagaaaagagcgatctgtttcttggtttattgtcggtgggaaacgaggtgccgttagaaaaaaatgaaggtgatagagaagatccgagcagcgtctgagggagaagggagggtagtgttctccttcgagtacttcccacccaggacggaggatggggttgataacctgttcgaacgaatggatcggatggtggctcacaacccctcattctgcgacatcacttggggcgccgggggctcgactgccgatctcaccctcgagatagccaacaagatgcagaacacgatctgtgttgagacaatgatgcacctcacctgcaccaacatgccggtcgacaagatcgaccacgcccttgacaccatcaagttcaacggcattcagaacgttcttgcccttcgcggtgatccccctcacggccaggacaagtttgtccagatcaaaggaggattcgcttgtgccctcgatctggtaaatcacatccgagacaagtatggcgattactttggcattactgttgctggatatccggaggcacatccggacgtgatacagagtgacggtgtggctactttggaaggataccaaaatgatcttgcttatttgaagaggaaggttgatgctggagctgatctcatcgtaactcaactattctacgatactgatatttttctgaaatttgtgaatgactgtcgtcaaattggaataacttgtcccattgttccgggtattatgccaattaataactataagggcttcttgcgcatgactggtttttgcaagactaggataccatccgagattactgctgccctggagtctattaaggacaatgaggaagctgtcaaggcctatggaattcaccttggaactgaaatgtgcaagaagattttagctcatgggatcaagacattgcacctttacacgctaaacatggagaaatcagcactggctatattaatgaatcttgggttaatcgaagagaccaaaatttggaggtctctaccgtggagacgccctacaaatgttttccgggttaaagaagatgttcgaccaattttctgggctaatcgtccgaagagctacgtatcaaggactataggttgggatcaatacccaagtggacgatggggcgattcctgtaatccatcatatggagcactatctgactaccagttcatgcgaccacgctcacgtgataagaaacttcacgaggaatgggctgtcccattgaaatctgttgaagacattaatgagagatttataaattactgcctcgggaaacttagaagcagtccatggtcagagttagatgggctccagcctgagacaaagatcataaatgaacagttgcggaacattaactcgaagggtttccttaccgtcaatagccaaccagcagtcaatggggagaaatcagacagtccacttgttggatggggtgggccaggtgggtatgtttatcagaaagcctatctggagtttttctgctctcaggataagttgaattcacttgttgagaaatgcaaggctttcccatctctaacctacatggctgtgaacaaagaagggaaatggatagctaacattggttccagtcatgtgaatgcggtcacatggggagtcttcccagcaaaggagatcactcaaccgactatcgtggaccctgcaagttttgttgtttggaaggacgaggcatttgaaatctggacaagggtatgggcgtgcttgttccccgagggtgatccatcaagaaaattactagaagaggtgcaaaatggttacttcttggtcagcttggtagagaatgattatatccatggggatctgttcgctgtttttcaggatgtctgagatgagctgcttcttttgtttccctctctatattgaagctcgcctcattcactgatgtcaggcttttacaagtctagtagcaaggcctgcatagtaataagtcaatttagtatgactagtatgcgtgttatgttgggttattcatgttctcttattcaataccacaacatttggaaatttgatagttatccccttcctatatgtaacttgcataaaggggctgcctatttacttgtctaaaacaaattcatatctaatgcttccagcttttg

SEQ ID NO: 1517 - DNA, 2265 bp, Castanea mollissima
tttctccctctataaaatgggaagcacttaacatacaatctctctctgtgtccgtattctctctaatctctaatctctaatttctttcttacttataataatagagtgaaatttaatctaattcaccatctttattattattattattagtagagtgtcggtggtgatttcacagatccgagtgtgggagtgggaaaaatgaaggtaatagagaagatccgggaggcaggggaagaaaaagtggtgttctccttcgagttcttccctcccaaaactgaagatgcagtggacaacctgttcgagaggatggagcgcatggtggctcacaaccctgcattctgcgacatcacttggggagccggtggttccaccgccgatctcactctcgacatcgccaacaggatgcagaacatgatctgcgtggagtccatgatgcatctcacctgcaccaacatgcctgttgagaagatcgatcacgctcttcagaccatcaaggttaacggtctccagaacgtcctcgctctccgcggcgatcctcctaaaggccaggacaagtttgttcagatccagggtggctttgcttgtgctctcgatctcgtgaaacatatcagagcccaatacggtgactactttggcattaccgttgctggttatccagaggcacatcccgatgcgatcggagaaaatgggttggctacactcgaagcttatcacaaggatcttgtttatctcaagcagaaggtggatgccggagcagatgtaatcatcacacaattgttttatgacactgacatttatctcaaatttgtgaatgattgtcgccaaattggaattacttgccccattgttcctggaattatgcctattaataactacaagggcttcattcgcatgactggtttttgcaaaactaagatacctgctgaaattatggccgccttggagcctatcaaggacaatgaagaagctgtcaaagcctatggaattcatcttggaactgaaatgtgcaagaagattttagctcatgggatcaagacagtgcatctttataccctaaacatggagaagtcagcattagctatattaatgaatcttggtctgattgaagagaccaaaatttcaaggtccctgccttggagacgcccgactaatgttttccgtgtgaaggaagacgttcgtccaattttctgggctaatcgtccaaagagctacatatcaaggactataggctgggaccagtacccacgtggccggtggggtgattcttgcaatccatcatatggagcattaagtgactatcagttcatgcggccacgagcacgtgacaagaaacttcttgaagaatgggttacacccttgacaaatgttgatgatattcaggagaaatttaagaaatactgccttggaaaattgagaagcagtccatggtcagagttagatgggcttcagccagagacacgaatcataaatgagcagctggggaagattattacaaagggattcctcactgtcaatagccaaccagcagtcaatggggaaaaatctgattccccatctgttggatggggtggacctggagggtatgtttatcagaaggcatatgtagagtttttctgttccagggaaaagttggatgcacttgttgacaaaagcaaggctttcccatctctaacctacatggctgtgaacaaagaagggaagttgatatccaatgtccaccaaactgctgtgaatgctgtgacatggggagtcttccctgcaaaggagataatccaaccaactgttgtggatcctgccagctttatggtgtggaaggatgaggcctttgaaatctggtcaagggggtgggcttccttgtttccagagggtgatccatccagaaaactgcttgaagaggtccagagcagctattacttggtcagcttggtggataatgattacatccatggtgatctttttgctgtttttgcagaattctgagatgaactgtgatctcagtctcttcaattctgggttcaagttggtttatataagtgttgttggaatgtgtcaatttataatcttattggtttgtattaataattcattgggattttgataactccccctccttcatgatgcaaattttacatttggaataacaagaaatcgcggttaggtgatagaagtgtgccagtgtcccactagttcaatgggatttcacggaagcaatctatattgaatttgtaaaaaacaccgatctttgtacggtaatgctaggcccct

SEQ ID NO: 1518 - DNA, 2330 bp, Citrus sinensis
cacgcgtccgctcacctcacctcacacacccactctctttcactttcatctcgcatccattctttccatttttctttttcataaatcaccctcgcagatctgaactcaaccgacaactcactcgtaaacgacctgtcggtggcagcagtagctactctccgaaccaaaaatgaaggtaatagacaagattcaagagaaagtagcctccgacaaggtcgtcttctccttcgaattcttcccgccgaagacggaagatggcgtggagaacttgttcgagcggatggaccgtatggtggcccacaacccggcattctgcgacatcacttggggggcgggtggctccacggccgatctcacgctcgacatcgcgaacaggatgcagaacacgatatgcgtcgagacgatgatgcatttgacgtgcacgaacatgcccgtcgagaagatcgatcacgctcttcagactattaagtccaacggcatccagaacgttctcgctcttcgcggcgatcctcctcacggtcaggataagttcgttcagatccagggtggcttcgcctgcgctcttgatctcgtgaaacatattaggtctgcttatggtgattactttggcatcactgttgctggttacccagagggacatccggataccattggacctgatggcgtggccagtaatgaatcatatcaaagtgatcttctttatctgaagaaaaaggtggatgctggtgcagatctaattatcactcaactattctatgatactgacatgtttcttaagtttgtgaatgactgtcgccaaattggaattacctgccccattgttcctggaattatgcccattaataactataagggtttcttgcgcatgactggcttttgcaaaacaaagataccagctgagattactgctgccttggagcctataaaggacaatgaagaagctgttaaagcctatggaattcaccttggagctgaaatgtgcaagaaaattttagctcatgggattaagactctgcatctttatactctaaacatggagaaatctgcattagctatattattgaatcttggtttgattgaagagtccaaaatttccagatccttaccctggagaccccctactaatgttttccgcgttaaggaagatgttcgtccaatattttgggctaatcgtccaaagagctacttatcaaggacagttggttgggaccagtatccacgtggacgatggggtgattctcgtaacccatcatatggtgctttatctgaccatcagtttatgcggcctcgttcacgtgacaagaaacttcatgaagaatgggctgtccccttgaaaagtgttgaagatatctatgaaaaatttaagaattactgccttgggaaattgagaagcagtccttggtcagagttagacgggcttcagccagagaccaaaatcataaatgaacagcttggaaagatcaatgtgaaaggtttcctcactatcaacagccagccggcagtcaatggtgaaagatccgattcatcttctgttggttggggtgggccaggaggatatgtttatcagaaagcatatctagagtttttctgctcaccagagaagttgactgcacttgttgacaaaagcaaagctcttccattcataaccttcatggctgtcaacaaagaagggaactggaaagccaatgttaatcaaactgatgtgaatgccgtaacttggggggtcttcccagccaaggagattatccaaccgactgttgttgaccctgccagcttcaaggtgtggaaggatgaggcattcgaaatttggtcaagatcatgggcttcattgtaccctgagggagactcatcaagaaaattgcttgaagaggtgcagagcagctattatttggtcagcttggtggataatgattacatcaatggggatctttttgctgtttttgccgatctctaggttaagctgctgtactccatggaattacaacctgatttcatcaatggtcatcttgtaccctcactgaagccatttgaagtgttgccttctctcaagttaatttcaattgaaatttatccaaaattacaagcttactgattgtattaataagatgatagggattttgatacctccctgatgctccatgcaaattaaattggcagctttcattctattgaatcgctcctaattatttgtcaatggaagttgcaatctgaaaattgtagcgttacctaaatatatttaattccaataaagtgagtctttgtttttctgcctttaaaaaaaaaaaaaaaagggcggccccctctaaaaggatccaaacttaacttaaccc

SEQ ID NO: 1519 - DNA, 2158 bp, Orobanche aegyptiaca
atatccaaatccagtgatacaatatatcgctcccagagtccataccaatgcaatattgcacactacagatctgatctaacttcatctttttgagaatcaatcaaggtttaagatgaaggtgatagagaagatccatgaggcaactgccgccaatgacaatcgggtcgttttctccttcgaattcttcccgccgaagacggaggacggcgtcgacaacctgttcgagagaatggagcggatggtggcgcacaaccccacgttctgcgacatcacatggggcgccggcggatccacggcggatctgactctggagatcgccaaccgcatgcagaacatggtgtgcgtcgagaccatgatgcacctcacctgcaccaatatgcctgtcgagaagatcgaccacgccctcaccaccatcaagtccaacggcattcagaatgtcctcgctctccgtggtgacccaccgcacggccaggacaagttcgtccaggtggaagggggttttgcctgcgccctcgatctcgttaagcatatccgttctcaatatggggattactttgggattactgttgccggttatccagagggacatcctgatgttattcaggatggagcggcaccgcctgaggcatatcaaaatgaccttgcttatctcaagagaaaggttgatgctggagctgatgtcattgtaactcaactcttctatgatactgacatcttcctaaaatttgtcaatgactgccgtcaaattggaataacctgtcccatcgtacctggtattatgcccattaataattataagggcttcatccgcatgactggtttctgcaaaactaagattccacctgagattatggctgccttggacccaatcaaggacaatgaagaagctgtcagggcttatggagttcaccttggaacagaaatgtgcaagaagattatggctactgggatcaaaactttgcatctctatacattaaacatggagaaatctgcattggcaatattgatgaatcttgggctgattgaggagtctaaaatttcaaggtccttgccatggagaaaaccagcaaatgtttttcgggtaaaagaagatgtccggccaatattctgggctaatcgtcctaaaagctatatctcacggacccttggctgggaccagtacccacagggtcgatggggagattctcgaaatgcgtcatatggagcactcagtgattatcagttcatgaggccacgttcacgtgataagaaacttcgtgaagaatgggctgttcctttaagcaatgtcgaagatatttatgagaattttatgaagttctgccttgggaaacttagaaacagtccatggtccgacttagatgggcttcatccagagagcaaaatcatcaatgaacagcttggaatcattaattcgaaaggttttctcactatcaacagccaaccagccgttaatggagtgaagtctgactccccatctgttggatggggtggtccaggtggctatgtataccagaaggcttacctggaatttttctgttcgccggagaagttaaatgctctagtcgataaatgcaaagtgttcccatatcttacttatatggctgtgaataaaaaaggaagttggatatctaatgtgaacaaaagtgatgtgaatgctgtgacttggggagttttccctgcaaaggagattatccaacctactgttgtggacccagaaagctttcttgtatggaaggatgaagctttcgagctatggtcaaggggatgggctaatctctaccccgaaaccgacccttccagaaaattacttgagcaggttgagagcagctattacttggttagcttggttgacaatgattacattcatggagatttgtttgctgtttttaaggacatttgaaagagttattcaaagaacttactctcatgtgttcaaaagtaattcattgtacgaaatgtatactgccatgtggtaacattatataattgggattttgcaattttcaatttatgatgtaaaactatcaattaatttctgattgtattttataagtttacacgcaatggcagcatttgtgttgaaatctaatggttggactctgaagatcacgtttgcgaatgtaaatcaaattcgacaaatcgattcatttttaatatc

SEQ ID NO: 1520 - DNA, 2275 bp, Citrus sinensis
gtcccacaccctcatcccacctcacacacccactctctttcactttcatctcgcatccattctttccatttttctttttcataaatcaccctcgcagatctgaactcaaccgacaactcactcgtaaacgacctgtcggtggcagcagtagctactctccgaaccaaaaatgaaggtaatagacaagattcaagagaaagtagcctccgacaaggtcgtcttctccttcgaattcttcccgccgaagacggaagatggcgtggagaacttgttcgagcggatggaccgcatggtggcccacaacccggcattctgcgacatcacgttggggggcgggtggctccacggccgatctgactctcgacatcgcgaacaggatgcagaacacgatatgcgtcgagacgatgatgcatttgacgtgcacgaacatgcccgtcgagaagatcgatcacgctcttcagactattaagtccaacggcatacagaacgttctcgctcttcgcggcgatcctcctcacggtcaggataagttcgttcagatccagggtggcttcgcctgcgctcttgatctcgtgaaacatattaggtctgcttatggtgattactttggcatcactgttgctggttacccagagggacatccggataccattggacctgatggcgtggccagtaatgaatcatatcaaagtgatcttctttatctgaagaaaaaggtggatgctggtgcagatctaattatcactcaactattctatgatactgacatgtttcttaagtttgtgaatgactgtcgccaaattggaattacctgccccattgttcctggaattatgcccattaataactataagggtttcttgcgcatgactggcttttgcaaaacaaagataccagctgagattactgctgccttggagcctataaaggacaatgaagaagctgttaaagcctatggaattcaccttggagctgaaatgtgcaagaaaattttagctcatgggattaagactctgcatctttatactctaaacatggagaaatctgcattagctatattattgaatcttggtttgattgaagagtccaaaatttccagatccttaccctggagaccccctactaatgttttccgcgttaaggaagatgttcgtccaatattttgggctaatcgtccaaagagctacttatcaaggacagttggttgggaccagtatccacgtggacgatggggtgattctcgtaacccatcatatggtgctttatctgaccatcagtttatgcggcctcgttcacgtgacaagaaacttcatgaagaatgggctgtccccttgaaaagtgttgaagatatctatgaaaaatttaagaattactgccttgggaaattgagaagcagtccttggtcagagttagacgggcttcagccagagaccaaaatcataaatgaacagcttggaaagatcaatgtgaaaggtttcctcactatcaacagccagccggcagtcaatggtgaaagatccgattcatcttctgttggttggggtgggccaggaggatatgtttatcagaaagcatatctagagtttttctgctcaccagagaagttgactgcacttgttgacaaaagcaaagctcttccattcataaccttcatggctgtcaacaaagaagggaactggaaagccaatgttaatcaaactgatgtgaatgccgtaacttggggggtcttcccagccaaggagattatccaaccgactgttgttgaccctgccagcttcaaggtgtggaaggatgaggcatttgaaatttggtcaagatcatgggcttcattgtaccctgagggagactcatcaagaaaattgcttgaagaggtgcagagcagctattatttggtcagcttggtggataatgattacatcaatggggatctttttgctgtttttgccgatctctaggttaagctgctgtactccatggaattacaacctgatttcatcaatggtcatcttgtaccctcactgaagccatttgaagtgttgccttctctcaagttaatttcaattgaaatttatccaaaattacaagcttactgattgtattaataagatgatagggattttgatacctccctgatgctccatgcaaattaaattggcagctttcattctattgaatcgctcctaattatttgtcaatggaagttgcaatctgaaaattgtagcgttaccgaaatatatttaattccaataaagtgagtctttgtttttctgccttt

SEQ ID NO: 1521 - DNA, 2330 bp, Ocimum basilicum
ctgagaacattttgcggaattgaagcatctctgggtgctgcaaatatacatttatatatttctcaaaaattcataaatccacagcgttggagattatacaaaattaaaaacaagagaatgaatcaatcaaacggctaactgaatgtcgccaagatcaagctgcggcggctcagatctgatccgattcagctgtctgcagctcacatttgattatcctctacatttcattcgaattctactacttagtttactggtattattactattttttgttttcggtagcttaatttgttggaagtaagatgaaggtgatagagaagatccatgaggcgacttccgcgaacgacaaccgagtggtgttctcgttcgagttcttcccgccgaagacggaggacggcgtcgaaaacctcttcgagcgaatggaacggatggtggcgcacaaccccgcattctgcgacataacctggggcgccggcggatccacggcggatctgacgctggagatagccaaaaggatgcagaatatggtgtgcgtcgagacgatgatgcacctcacctgcaccaacatgcctgttgagaagatcgaccacgctctcaccactatcaagtccaatgggattcagaatgtgcttgctctccgcggcgacccccctcacggccaggacaagttcgtccaggttgagggaggttttgcgtgcgctcttgatcttgtcaagcatatccgctcccaatatggggaatactttgggattactgttgctggctatccagaggggcatcctgacgttattgagaatggtgtggcatcagaagaggcatatcagagtgaccttgcttatctcaagagaaaggttgatgctggagctgatctcattgtaactcaactcttctatgacactgatatcttccttaaatttgtaaatgattgccgtcaaattggaataaactgtccgattgtacctggaattatgcccattaacaattacaagggattccttcgcatgactggtttctgcaaaactaagatcccaactgagatcatggaggccttggaacctatcaaggacaatgaagaggctgttagggcctatggaattcacctaggaacagaaatgtgcaagaagattctggctagtggtatccgaactttacatctctatacactgaacatggaaaaatctgctttggcaatattggcgaatcttggactaattgaggagtccaaaatttcaaggtccctaccatggagacgtccaacaaatgcactccgggttaaagaggatgttcgcccaatattttgggctaatcgtcctaaaagctatatatcccgaactattggttgggaccaatacccacatggtcgatggggagattctcgaaatgcatcatatggagcactaacggattatcagttcatgcgaccacgctcccgtgataagaagctccaagaagaatgggctgttcctttgaagagtgttgaagatatttatgaaagattcatgtcgttctgccttgggaaacttagaagcagtccatggactgaactagatgggcttcagccagagactaaaatcatcaacgaacagcttggtaatattaatttgaaaggctttctcactatcaacagccaacctgctgttaatggagccaagtccgactctccaactgttggatggggaggaccaggcgggtatgtataccagaaggcgtacgtagaatttttctgttctccggagaggctgaatgctcttgttgataaatgcaagctcttcccatatctcacctacttggctgtgaataaagaaggaagcttgaaatctaatgtcagcaattctgacatcaatgcggtcacctggggagtctttcctgcaaaagagataattcaacctactgttgtcgatcctgctagctttctggtgtggaaggatgaagcatttgaaatctggtcgaggggatggggtaatctttaccctgaaacagaagtccaatccagaaaactaatcgaggaggtgcagagcaaatactacttggtcagtttggttgacaatgattacatccacggcgatctttttgctgtttttaaggacatttgaaatgatttcatgagtgttggcttttcgtccagtgtcatattcctacgttatcaaagacagcaattcatcattcttagccctgttgaggctattaagtaactgtcatgtagtatggttttcaaattggattttggctttcccaactcatgatgtaagcttaaataaattcccggtattatttagattttacacttaatgatatccatccatattccgagcttcaagcttgatttccgc

SEQ ID NO: 1522 - DNA, 2316 bp, Gossypium raimondii
aaaagagcaggggcataataattaaaccgtatggaattgaccattaatgggcaattactgaattgagaatgggataaggccattgggttgttgagtgggcaacagagtcatttcaaaagacaccaacccccatccgttcccttcctctctcaaatgcaaatactcccattgcaatgcctccacctcccatctctctcttaaccaaccacaaacccatttaagttggtgttggtgacaccgagagttcaagatccaattaaagatgaaggtgatagagaagatccaatctttgcaagaagggaaagtggtgttttcctttgagttcttccctccaaagactgaggatggagtagacaacctattcgagagaatggatcgtatggttgctcataacccgtccttctgtgacattacatggggtgcaggtggttccactgctgatctcaccctcgacattgctaacaagatgcagaatatcatctgtgtggagacgatgatgcacctcacttgcaccaatatgcccgtagagaagattgaccatgctcttcagaccatcaagtccaacggtattcagaatgttctcgccctccgaggtgatccccctcacggccaggataagtttgtccaggtcgaaggcggcttctcctgtgcccttgatctggtgaaacatatcagatctaaatatggtgactactttggcatcacagttgccggttatccagaggcacatcccgatgccataggaaatgacggtgtagccacacctgaagcttatcagaatgatcttgcctacttaaagagaaaggttgatgcaggagctgatctgattgttactcaactgttttatgataccgatatctttctcaaatttgtcaatgactgtcgccaaattggaattaattgtcctatcgtgccgggtattatgcccattaataactacaagggtttcttgcgaatgactggcttttgcaaaactaagataccagctgagattactgctgccttagaggctatcaaggacaacgaagaagctgtcaaagcctatggagttcaccttggaacagaaatgtgccgcaagattttagctcatggggttaagacattgcacctttatacattaaacatggagaaatctgcattagctatcctaatgaatcttggattgattgaagagtccaaaatttctaggtccttaccttggagacgccctgcaaatgtttttcgtgttaaagaagatgttcgtccaatattttggtctaaccgtcctaagagttacataaccaggactattggttgggatcagtacccatatgggcgatggggtgattctcgaaatccgtcctatggtgcactaacagaccatcagttcatgaggcctcgagcacgtgacaagaaacttcaagaagaatgggctaccccattgaaaagcattgatgatattcaagagaaatttaaaagttattgtctgggaaagttgagaagtagtccttggtccgaactggattcacttcagcctgagacaaagatcatacatgaacagctgggaaagatcaatttgaagggtttccttactatcaatagccaacctgctgtcaatggtgaacgctctgattctccatctgtcggttggggtggccctggagggtatgtttaccagaaggcttatcttgagtttttttgctcaaaggaaaaactagatgcacttgtcaataaatgcaagcccttgtcatctattacctacattgctgtcaacaaaaaagggaatttgatatcgaacattggcacgacagatgttaatgctgtaacttggggagtgttcccagccaaagaaatagtccagccaacagtggtggatcctgccagcttcatggtgtggaaggatgaagcattcgaaatctggtcaagagcatgggctgcactgtacccagaaggcgatccgtcgaaaaaattgctagaagaggttcagagcagctattatttggtgagtttggttgataatgattacattggtagtgatgtttttgctgtttttggagacctttgaagatgagattgctgccttcaagccctgaacttaccaaagctcttaagccccatatagtatcattatgtttgagttgtcaggttatttttttataatgatttcataaaaaaaaaaggagaaatttgtaataataattccttggaatttaaccattcccttcatcatgcaaattacaatatatcaagagattattattattaatccgatacatcaagttgttaaatgcttacatatattgttatttgaactataaccagaataatcttaaccaa

SEQ ID NO: 1523 - DNA, 2182 bp, Rosa hybrid cultivar
cgaagcggaggaggaggcggacgcgtgtggtgtcggtggacgtctgagggtggtgggaggtgagtgagtgagtacagatctaggagttgtagggccgactagtgtcatcttaatacagagagagagagagagagagagagagagggagagtcgagggttggggttcacaattcagagaagatagaaaaaatgaaggtgatcgacaaaatccacgaggcattggcggatgagaagaaggtggtgttctcgttcgagttcttccctccgaagacggaggatggggtggagaacctgctggagagaatggatcggatggtggctcacaatccggccttctgcgacatcacttggggcgccggtggctccactgccgatctcactctggacatcgccaacaaaatgcagaacatgatctgcgtcgagagcatgatgcatctcacctgcaccaacatgcccgtcgacaagatcgaccatgccctccagactatcaagtccaacggcctccagaacgttcttgctctccgcggcgacccaccccatggccaggacaagtttgttcagatccaaggcggctttgcctgcgccctcgacctggtcactcatatcagagccacatatggtgactactttggtatcactgttgctggttatccagaggcacatcccgatgccattgaagccgatggcctcgccactccagagtcctatcaaagtgatctggcttatctcaagagaaaggttgatgctggtgccgatttgatcgtcactcaattattctacgatactgatgtattcctcaaattcgtcaacgactgtcgccaaattggaatcacttgtcccattgttcctggaattatgcctattaataactacaaaggtttcatacgcatgactggtttctgcaaaacaaagatacctgctgaggttactgctgccttggaacctattaaggacaatgaagaagctgtcagagcttatggaattcaccttggaacagaaatgtgcaagaagattttagctcatgggattaggacattgcatctttatacactgaacatggagaaatcagcattggctatactaatgaatcttggtttgattgaagaggccaaaatatcaaggcccttaccttggagacgccctgcaaatgtttttcgtgttaaagaagatgttcgtccaattttctgggctaatcgtcctaagagctacatatcaagaaccataggctgggacctgtacccacatgggcggtggggtgattctcgtaatccttcatatggcgcgctaactgattaccagttcatgcgaccacgtgcacgtgacaagaaacttgttgaagaatgggttgtcccactgaaaagtgttgaagatattcatgagaaatttgagaaattctgccttggaaagttgagaagtagcccttggtcagaactcgatgggcttcagccagagacgaagatcataaatgaacagctggggaaaattaacacaaagggtttccttaccatcaacagccaaccagcaataaatggggaaagatctgattcaccatctgttggatggggtgggcctggaggatatgtttatcagaaagcctatgtggagtttttctgttccaaggagaagttgggtactcttgttgacaaatgcaaggcacttccatctcttacatacatggctgttaatagagaagggagttggatatctaatatcagtcaaactgatgtaaatgcggtaacatggggagtcttcccagcaaaggagataatccaaccgactgtcgtggatcctgctagttttatggtttggaaggatgaggcatttgaaatctggtcaagaggatggggtcgcttgtaccctgagagcgactcatctaggaaattacttgaagaggtgcagaatagctacttcttggtcagcttggtagataatgactacatccatggtgaccttttcactgtttttgctaatttctagaggggcttgcttgttgtctcttgcatcccatcagccattaggctggtgctttccttgcaagtccggtttcatttattgtcagtgggatgtgtaataataactcattgggattttgatacctcccctgcggccctgcttcagtgcaaattgcatctgtattctctgcttataccaaagttcgtcaacgtcccggtttcataattgg

SEQ ID NO: 1524 - DNA, 2073 bp, Chelidonium majus
gaaacaaaagaaacctagagagagaaaatgaaggtgattgagaagatccaacaagctgcggcagatgatcgagttgtcttctcattcgaattcttcccaccaaagacagacgatggagttgagaatctcttcgaacgtatggatcgtatggttgctcacaatccttcattctgtgacattacatggggagctggtggttctactgctgaactcaccctcgacattgcccatcggatgcagaacatgatctgtgttgaaacaatgatgcatttgacttgtacgaatatgcctgtggagaaaattgatcatgctctggaaaaaatcaagtctagtggaattcagaatgttttggctttgagaggtgatcctcctcatggtcaggataagtttgttcaagttgaaggtggatttggttgtgctcttgacctggtgcagcatatgcgagccaaatatggtgactattttggaatcacagttgctggttacccagaggcacatccggatatgattgaagccaatggtttggcttctcctgaatcataccagaatgatcttgcttatttgaagaaaaaggttgatgctggtgcagaagtcattgtcactcaactcttctatgacactgataatttctttaagtttgttgacgactgtcgacaaattggaattactattcccattgtcccgggaattatgccaatcaataactataagggcttcttgcgaatgactggattttgcaaaaccaagataccatccgagattatggatgctctagagcctattaaagacaacgaagaagcagtcaaagcctatgggattcaccttggaactgaaatgtgcaagaaaattttagctcatggaatcaaaacgttgcatctttatacactaaacatggacaaatcagcattggctatattactgaaccttggtctaattgaagaatccaagatttcgaggactctaccctggaggcgaccaacaaatatcttccgtgttaaagaagatgttcggccaatattctgggctaaccgtccaaaaagctacatatcaaggactatagggtgggaccaatacccgcgtggtcgatggggtgattccggcaatccctcttatggagcgttgactgaccatcagtttatgcgaccacgttcacgtgacaagaagcttaatgaggagtgggccgtcccattgaaatctgttgaagatatttatgagaaattctcaaaactctgcctggggaaacttaaaaccagtccttggtcagagttagatggtctccagccagagacaaagatcataaatgaacatctggggagcattaatttgaaggggtaccttacaatcaatagccaacctgcagtcaatggggagaaatctgattcaccggttgttggatggggtggacctggtggatatgtctaccagaaagcctatctggagttcttctgctctggggacaggctagcttcactggttgaaaaatgcaagggattcccatctcttacctacatcgccgtgaacaaagaaggtaaaatcttgtctaacgttggtacctctgctgtgaatgcggtaacctggggagtcttcccagcaaaggagatcatccaaccaactgtcgtagatcctgctagctttatggtgtggaaggatgaggcatttgagatctggacaaaggtatgggcacgtatgtacccagaaggcgactcttcgaggagtgtattggagtcggtacagagcagttattacttggtcagcttggttgataatgattacatcattggagatctgtttggcattttcaaggatatctgaaatgacatttcatctctcttacgttaaagagtagtaggcagtgttttactgaaagtgttatattttcggtgctaatgttgccactttatatttcgcattttagtatccatttatgttctcctcctgatgccaatcgcatctagggtggcagttgagttgtgtttgtttctacaaattgtattaataattgattgatttaagtatggcatggaaatcctttatagccaaaatacccgagtagttgctcctccttctgtcatt

SEQ ID NO: 1525 - DNA, 2142 bp, Solanum phureja
gtaccaattaccaccaagctgcttctactataaaaaagcttcaattttttttcaagattcttgccaaatcttgaatctaaaacaccatttttcactaatccaacacccccattttcaatttttcaagaaaatgaaggtaattgagaagattcaagaagcagccaagactgacaaagtgatattttccttcgaatttttcccaccaaagactgatgatggggttgaaaacctgtttgaaagaatggaaagaatggttgctcatagcccatctttttgtgatataacatggggtgctggtggttcaacagcagatctgacacttgatattgttaataggatgcagaatatggtgtgtgttgaatctatgatgcatttgacatgtacaaatatgcccgttgaaaaaattgatcatgctcttgatactattaaggctaatggtattcaaaatgttcttgctcttcgtggagatcctcctcatggtcaggataagtttgttcaggttgaaggtggatttgcttgtgctctggatctggtgaagcatatgcgtgccaagtatggggattactttgggataactgttgcaggttatccagaggcacatcctgatgttatacctgctaatggaatagctacaaaagagatttatgaaaatgaccttgcttaccttaaaaaaaaggttgatgctggagctgatgttattgtaactcaactcttctacgatactgatgttttcctaaaatttgtcaatgattgccgccaaattggaattaactgccccatcgttccgggtatcatgcccattaacaattataagggcttcttgcgcatgactggattttgcaagactaagattccggaagagataatggctgcgttggaacctattaaggacaatgaagaggctgtcaaagcctatgggattcaccttggaactgaaatgtgcaaaaagattttagccactggcattaagaccttgcatctttatacattgaacatggagaaatcagcattggccattttgatgaatcttggattaatcgaagagtccaaaatttctaggccattgccttggagacgtcctgcaaatgttttccgtgttaaggaggatgtgcgtcctatattctgggcgaatcgtccaaagagctacatctcaaggaccacaggttgggatgaatacccacatggtagatggagcaatgctcaaaatccatcatatggagcacttactgactatcagttcatgcgtgcacgctcaagagataagaagcttcaagaggaatgggctgtggctttgaatagcgtggaagatatctacgagaaattcaaggactactgtcttggaaagctgagaagctgcccgtggtctgagttagatggtcttcagccagagacaaagatcataaacgaaaagttgggtcaggtcaacacgaaaggtttcctcactattaacagccaaccagcagttaatgctgagaagtccgactctccttctgttggatggggtggccccggcggatatgtttatcaaaaggcatacttggagttattctgctctcaggagaagttgaacgccctcgttgagaaatgcaagtctttcccttacctaacttacatggctgtaaacaaggaaggaaactggatttccaacgtcaaccaaaccgacgtcaacgctgtgacatggggagttttcccagctaaggaaattatacaaccgactgttgttgatcccgccagcttcatggtatggaaggatgaggcatttgaaatctggtcaagaggatgggctcaattatacccagagactgatccatcaagaaaattgcttgaacaagttcagaacagttacttcttggtcagcctcgtcgataacgactacatcaatggtgatttgttttccatcttcaaggatatctgaaattaaccaagaaaactcagcttctcaacctttatagtcccatttatttcaagaatttttactggatgttgttactattattattgttgttgttctgtgttcttgtaataggaataatttaaagggatttgttcccttcaatttattcttttcctcttcaaatttgatgtactttgccttttatggcttcaatctttacaaatttataagcaaagcatacttccaca

SEQ ID NO: 1526 - DNA, 2295 bp, Vitis vinifera
atccaacaacccccaacaaaaacaggaccatcgttttgtgtgtggaagtgccaacccaaaatcacatttcttcgtaatgtaatcacattccattccgcccatatataaatacagtgggagtgtaagattcgttcatatcttgtatctttcatttatctcaccttccccgtgtcggtagtgaaggagaggaaaatgaaggtgattgagaagatccgcgatgcggccactgaggaaggaaaggtggtcttctccttcgaattctttcctcccaagacggaggatggagtcgacaacctcttcgagaggatggatcggatggtggcgcacggccccgccttctgcgacatcacctggggagctggtggctccacggcggatctcactctggagatctccaacaagatgcagaacatgatctgcgtggagacaatgatgcatctcacttgtaccaacatgcctgtggagaagatcgaccatgctctcgacaccatcaagtccaatggcatccagaatgtgctcgccctccgcggcgacccccctcatggccaggacaagttcgtccagatccaaggcggcttcgcttgtgctctagatctggtgcagcacatccgggcgaaatatggagattactttggaataactgttgcgggttatccagaggcacatcctgatgtgatactaaatggtgtggctacttcggaagcataccagagtgatttggcttatttgaagagaaaggttgatgcaggagcagatcttattgtcacgcaattattctatgatactgatattttcctcaaatttgtgaatgactgtcggcaaattggaataacctgccccattgtcccaggaattatgcccattaataactacaaaggattcttacgtatgactggtttttgcaaaacaaagataccatctgaggttactgctgccttggagcctattaaggacaatgatgaagctgtcaaagcctacggaattcaccttggaacggaaatgtgcaagaagattttagctcatgggattaagacagtgcatctttatacactgaacatggagaaatcagcattggctatattaatgaatcttgggttaattgaagaatccaaaatatcaaggcccttcccatggagacgcccgacaaatgtcttccgtgttaaagaggatgttcgcccaatattttgggctaatcgtcctagaagttatatatcaaggaccataggatgggaccaatatccacatggacgatggagtgattcttgtaatccatcatatggaggattaaccgactatcagtttatgagaccacgtgctcgtgacaagaaacttcaagacgaatgggttgtgcccttgaaaagcattgaagatgttcaagagagatttataaagttctgccttggaaaactgaaaagtagtccctggtcagaattagatgggcttcagccagagtcaaagatcatcaatgaacttctgggcaacatcaattcaaagggtttcctcaccatcaatagccaacctgcagttaatggggaaaaatctgactccctgtctgttggatggggtgggccaggtgggtatgtttatcagaaggcctatctggagttcttctgctcaagggaaaagctgaatgctcttgttgacaaatgcaagggtcacacatctctgacatacatggctgtgaacaaagaagggacctggatgtctaatgttggcccaggtgaggtgaatgcggtgacatggggagtattcccagcaagggagatcatccaacctactgttgtggatccttccagctttatggtgtggaaggacgaggcatttgaaatctggtcaagaggatgggctctcttatacccagaggatgacccatccagaaaattgcttgaagaggtacagaacagccatttcttggtcagcctggtggataatgattacatcaacggcgatttgtttgccatttttatggagttctgagacatgcacactcctccctctccctttgaggcttgctaaagacattgaaattgattcgttgtctcaagttggattagaatttcatttccatgggattttgttggttataacttgaatcataattctataatcttactattatgtaataattgttattcattgagctttgtatccccccacctcatgctgcaaaatgcatttgaagtgggagctgatttactgaagcaattgcatactgctgtattctgcagtagcgtaattcttactgagatatttctggtccaagaatcccataatgaatggtcatgattttcccta

SEQ ID NO: 1527 - DNA, 2140 bp, Gossypium hirsutum
atcttcttctatgatgttcaaattgtatcgttttttgctctgaaccatcggttattctttttagattcagattcggtcttggaagttggtgttggtgacaccgagagttcaagatccaattaaagatgaaggtgatagagaagatccaatctttgcaagaagggaaagtggtgttttcctttgagttcttccctccaaagactgaggatggagtagacaacctattcgagagaatggatcgtatggttgctcataacccgtccttctgtgacattacatggggtgcaggtggttccactgctgatctcaccctcgacattgctaacaagatgcagaatatcatctgtgtggagacgatgatgcacctcacttgcaccaatatgcccgtagagaagattgaccatgctcttcagaccatcaagtccaacggtattcagaatgttctcgccctccgaggtgatccccctcacggccaggataagtttgtccaggtcgaaggcggcttctcctgtgcccttgatctggtgaaacatatcagatctaaatatggtgactactttggcatcacagttgccggttatccagaggcacatcccgatgccataggaaatgacggtgtagccacacctgaagcttatcagaatgaacttgcctacttaaagagaaaggttgatgcaggagctgatctgattgttactcaactgttttatgataccgatatctttctcaaatttgtcaatgactgtcgccaaattggaattaattgtcctatcgtgccgggtattatgcccattaataactacaagggtttcttgcgaatgactggcttttgcaaaactaagataccagctgagattactgctgccttagaggctatcaaggacaacgaagaagctgtcaaagcctatggagttcaccttggaacagaaatgtgccgcaagattttagctcatggggttaagacattgcacctttatacattaaacatggagaaatctgcattagctatcctaatgaatcttggattgattgaagagtccaaaatttctaggtccttaccttggagacgccctgcaaatgtttttcgtgttaaagaagatgttcgtccaatattttggtctaaccgtcctaagagttacataaccaggactattggttgggatcagtacccatatgggcgatggggtgattctcgaaatccgtcctatggtgcactaacagaccatcagttcatgaggcctcgagcacgtgacaagaaacttcaagaagaatgggcttccccattgaaaagcattgatgatattcaagagaaatttaaaagttattgtctgggaaagttgagaagtagtccttggtccgaactggattcacttcagcctgagacaaagatcatacatgaacagctgggaaagatcaatttgaagggtttccttactatcaatagccaacctgctgtcaatggtgaacgctctgattctccatctgtcggttggggtggccctggagggtatgtttaccagaaggcttatcttgagtttttttgctcaaaggaaaaactagatgcacttgtcaataaatgcaagcccttgtcatctattacctacattgctgtcaacaaaaaagggaatttgatatcgaacattggcacgacagatgttaatgctgtaacttggggagtgttcccagccaaagaaatagtccagccaacagtggtggatcctgccagcttcatggtgtggaaggatgaagcattcgaaatctggtcaagagcatgggctgcactgtacccagaaggcgatccgtcgaaaaaattgctagaagaggttcagagcagctattatttggtgagtttggttgataatgattacattggtagtgatgtttttgctgtttttggagacctttaagatgagattgctgccttcaagccctgaacttaccaaagctcttaagccccatatagtatcattatgtttgagttgtcaggttatttttttataatgattttttaaaaaaaaaagagagaaatttgtaataataattccttggaattttaaccattcccttcatcatgcaaattacaatatatcaagagattattattattattattatttatgcgatgcatcaacgtatttct

SEQ ID NO: 1528 - DNA, 2145 bp, Olea europaea
tagatctgatcgaattctcagtaatttgtgagatttgttggcagcctgagcctacccagatcatattactgagcaattacttgaaattttgattgaatttgtaatagtaatcgtagaaaatgaaggttatagagaagatccgggatgcggcagctaatgatgcgaacagggttgtgttttccttcgagtttttcccgcccaagacggaggatggcgtcgacaatctcttcgagagaatggagcggatggtggtgcacaacccgtcgttctgcgatataacatggggagctggtggttccacggcggacctgacgctggagatttctaacaggatgcagaacatggtgtgtgtggagactatgatgcatcttacctgcacaaacatgcctgttgagaagattgacaacgcgctatctactatcaagtcgaaagggatacagaatgtccttgctttacgcggtgacccccctcacggccaggacaagttcgtcaaggttgagggtgggttcgcctgcgctctcgaccttgtgaagcatatccgtgcccagtatggtgattactttgggatcactgttgctggttatccagagggacatcctgatgtgattcaaaatggagtggttacggaagaggcgtatgagaatgaacttgcttatcttaagaaaaaggttgatgctggtggcgaagttattataacccaactcttctatgataccgatatttttcttaaatttgtcaatgactgtcgtcaaattggaattacctgtcccattgttccagggattatgcccatcaacaattacaagggcttcatccggatgactggtttttgtaaaactaagatacccgatgagattacagctgctttggatcccatcaaggacaatgaagaagctgttaaggcatatggaattcaccttggaacagaaatgtgcaagaagattttggctagtgggatcaaaacattgcatctttacacgttaaacatggaaaaatctgcactggcaatattgatgaatcttgggctgatcgaggaatcgaaaatttcaaggtccttgccttggagacgtcccacaaatattttccgtgtcaaggaagatgttcgtcctatattctgggctaatcgtccaaaaagctacatctcacggactataggttgggagcaatacccaaatggacgatggggagattctcgaaatgcatcatatggagccctcactgattatcagttcatgcgaccacgatcacgcgataagaaacttcatgaagaatgggttgttcctttgaaaaatgtcacagatatttacgagaaatttatgaagttctgtcttgggaaactgagaagtagtccttggtccgaactagacgggcttcagccagagacaaagatcattaacgaacaacttggtaacataaacttgaaaggttttctcaccatcaacagccaaccagcagttaatggtgcaaagtctgattctccaactgttggatggggtggacctggtggatacgtttatcaaaaggcatacttggaatttttctgttctccacagaagttgaacgctttggttgagaaatgcaaatctttcccgctcctcacctacatggccgtcaataaagacggaacctggttttccaatgtcaaccaaactgatgtgaatgcggtgacatggggagtctttccagcaaaggagattatacaaccaaccattgtggatcctgccagcttcattgtatggaaagatgaagcatttgaaacgtggtcaaaaggatgggcgaagctctatccagaaggcgatccatccgcaaaattacttgaagaggtgcaaagaaatttattttttggtcagcttggttgataacgattacatcaatggtgacatgttcgtggtgtttaaagatatttgaaataattgaagtttctctcttgaaagccctgcttcatccattaatgcttcctctttactttgtctggttatcattcgtatgatttactcaaaaagagtaattggttgccgtaccttgtgttcagactgattttattgcattgtaataacttaatccattggattttgatatctctatcttaggatgtagaactgcacacatttatcgagttctggcaatttggtttttaaaataatc

SEQ ID NO: 1529 - DNA, 2306 bp, Malus domestica
gaattgccatttgccaccacacacgttgttagttttacattttctggcaaattgccggtcctttgatttgctaatcgggatctaaatctgaaattaaattccataatccccggttatttacatatatctatatatattacaacaattgtgccgtgtgtcggtgcagactcacatacttgcaagcgcagcaaggatgaaggtgatagagaagatccaggagtctttggtggatgagaagaaggtggtcttctccttcgagttcttccccccaaagaccgaggatggcgtcgagaatctcttggagaggatggatcggatggtcgcccacggccccgccttttgcgacattacctggggtgccggtggctccaccgccgatctcactctcgacattgccaacaagatgcagaacctcatctgcgtcgagagcatgatgcacctcacctgcaccaacatgcccgtcgacaagatcgaccacgccctccaaaccatcaagtccaacggcctccagaacgttcttgctctccgcggcgaccctccccatggccaggacaagtttgttcagatccaaggaggctttgcctgcgccctcgacctggtcacccatatcagagccaaatatggcgactacttcggcgtcactgttgctggttatccggaggctcacccggacgccattgctgccgatggcctcgcctctccagaagcatatcagagtgatctcgcttatttgaagagaaaggttgatgctggcgccgatttcatcgtcactcagttgttctacgacactgatattttcctcaaattcgtgaatgactgtcgccaaattggaattacttgccccattgttcctggaattatgcccatcaataactacaagggtttcatacgcatgactggcttctgcaaaaccaagataccagctgaggttaccgctgccttggagcctatcaaggacaacgaagaagctgtgagattgtacggaattcaccttggaaccgagatgtgcaagaagattttggcttccgggattaggactttgcatctttatactctcaacatggagaaatctgcgttggctatattgcagaatcttggtctgattgaagagtccaaaatatcaaggcccttaccttggagacgccctgcaaatgttttccgtgttaaagaagatgttcgtccaattttctgggctaatcgtcccaagagctacatatcaagaaccataggctgggaactatacccacatgggcggtggggtgattccggtaacccttcatatggagcactgactgattatcagttcatgcggccgcgtgcacgtgacaagaaacttgtcgaggaatgggttgtcccattgaagagcgttgaagatatctgcgagaaatttaagaaattctgccttggaaaattgaaaagcagcccttggtctgaactagatgggcttcagccagagacggggatcataaatgaatcgctaggaaaaattaacactaagggtttccttaccatcaacagccaaccagcggtaaatggggaaagatctgactcgctgtctgttgggtggggtggtcctggaggatatgtttatcagaaagcctatctagagtttttctgttcgaaggaaaagttggatgctcttgttgaaaaatgcaaggctcttccatctctaacttacatggccgtgaacaaagatgggagctgggtatctaatactggccagactgctgtgaatgcggtaacatggggtgtctttcgagcaagggagattatccaaccaactgtcgtagatcctgccagttttatagtttggaaggatgaggcatttgaaatctggtcaagaggatgggcccgcttataccccgagggcgactcatctaggaaattgcttgaagaggtgcagagcagctactatttggtcagtttggtagataatgactacatccacggtgatgttttcgctgtttttgccgatgtttgaatgagctgttttgtcaactcttccgtttcttaaatcccttgaaaatggtgctttcagtgcaagtcggattataaatttgatgtcattaagttgtgtaataataactcgttgggatttttgaatatcccctgtttcaattccatggtgcaaattgcgcgtatatcatacctgatcagtgtctggcgtaatggatacgatctggttctttgttggttcgcttctcgtatgtagtttgtggcaatgtaatccacagtatatgatttgtacttgatgttgtctctttgatctttataaatttatattgtcgcgtatcatatattccgct

SEQ ID NO: 1530 - DNA, 2279 bp, Citrus clementina
gtcccacaccctcaccccacctcacacacccactctctttcactttcatctcgcatccattctttccatttttctttttcataaatcaccctcgcagatctgaactcaaccgacaactcactcgtaaacgacctgtcggtggcagcagtagctactctccgaaccaaaaatgaaggtaatagacaagattcaagagaaagtagcttccgacaaggtcgtcttctccttcgaattcttcccgccgaagacggaagatggcgtcgagaacttgttcgagcggatggaccgtatggtggcccacaacccggcattctgcgacatcacttggggggcgggtggctccacggccgatctcacgctcgacatcgcgaacaggatgcagaacacgatatgcgtcgagacgatgatgcatttgacgtgcacgaacatgcccgtcgagaagatcgatcacgctcttcagactattaagtccaacggcatccagaacgttctcgctcttcgcggcgatcctcctcacggtcaggataagttcgttcagatccagggtggcttcgcctgcgctcttgatctcgtgaaacatattaggtctgcttatggtgattactttggcatcactgttgctggttacccagagggacatccggataccattggacctgatggcgtggccagtaatgaatcatatcaaagtgatcttctttatctgaagaaaaaggtggatgctggtgcagatctaattatcactcaactattctatgatactgacatgtttcttaagtttgtgaatgactgtcgccaaattggaattacctgccccattgttcctggaattatgcccattaataactataagggtttcttgcgcatgactggcttttgcaaaacaaagataccagctgagattactgctgccttggagcctataaaggacaatgaagaagctgttaaagcctatggaattcaccttggagctgaaatgtgcaagaaaattttagctcatgggattaagactgtgcatctttatactctaaacatggagaaatctgcattagctatattattgaatcttggtttgattgaagagtccaaaatttccagatccttaccctggagaccccctactaatgttttccgcgttaaggaagatgttcgtccaatattttgggctaatcgtccaaagagctacttatcaaggacagttggttgggaccagtatccacgtggacgatggggtgattctcgtaacccatcatatggtgctttatctgatcatcagtttatgcggccccgttcacgtgacaagaaacttcatgaagaatgggctgtccccttgaaaagtgttgaagatatctatgaaaaatttaagaattactgccttgggaaattgagaagcagtccttggtcagagttagacgggcttcagccagagaccaaaatcataaatgaacagcttggaaagatcaatgtgaaaggtttcctcactatcaacagccagccggcagtcaatggtgaaagatccgattcatcttctgttggttggggtgggccaggaggatatgtttatcagaaagcatatctagagtttttctgctcaccagagaagttgactgcacttgttgacaaaagcaaagttcttccattcataaccttcatggctgtcaacaaagaagggaactggaaagccaatgttaatcaaactgatgtgaatgccgtaacttggggggtcttcccagccaaggagattatccaaccgactgttgttgaccctgccagcttcaaggtgtggaaggatgaggcattcgaaatttggtcaagatcatgggcttcattgtaccccgagggagactcatcaagaaaattgctcgaagaggtgcagagcagctattatttggtcagcttggtggataatgattacatcaatggggatctttttactgtttttgccgatctctaggttaagctgctgtactccatggaattacaacctgatttcatcaatggtcatcttgtaccctcactgaagccatttgaagtgttgccttctctcaagttaatttcaattgaaatttatccaaaattacaagcttactgattgtattaataagatgatagggattttgatacctccctgatgctccatgcaaattaaattggcagctttcattctattgaatcgctcctaattatttgtcaatggaagttgcaatctgaaaattgtagcgttacctaaatatatttaattccaataaagtgagtttgtttttctgcctttcggaaaa

SEQ ID NO: 1531 - DNA, 2188 bp, Gossypium hirsutum
aaatacaaatactcccattgcaatgcctccactcccatctctctctttaccaaccacaaacccatttaagttggtgttggtgacaccgagagttcaagatccaattaaagatgaaggtgatagagaagatccaatctttgcaagaagggaaagtggtgttttcctttgagttcttccctccaaagactgaggatggagtagacaacctattcgagagaatggatcgtatggttgctcataacccgtccttctgtgacattacatggggtgcaggtggttccactgctgatctcaccctcgacattgctaacaagatgcagaatatcatctgtgtggagacgatgatgcacctcacttgcaccaatatgcccgtagagaagattgaccatgctcttcagaccatcaagtccaacggtattcagaatgttctcgccctccgaggtgatccccctcacggccaggataagtttgtccaggtcgaaggcggcttctcctgtgcccttgatctggtgaaacatatcagatctaaatatggtgactactttggcatcacagttgccggttatccagaggcacatcccgatgccataggaaatgatggtgtagccacacctgaagcttatcagaatgatcttgcttacttaaagagaaaggttgatgcaggagctgatctgattgttactcaactgttttatgatactgatatctttatcaaatttgtcaatgactgtcgccaaattggaattaactgtcctatcgtgccgggtattatgcccattaataactacaagggtttcttgcgaatgactggcttttgcaaaactaagataccagctgagattactgctgccttagaggctatcaaggacaacgaagaagctgtcaaagcctatggagttcaccttggaacagaaatgtgccgcaagattttagctcatggggttaagacattgcacctttatacattaaacatggagaaatctgcattagctatcctaatgaatcttggattgattgaagagtccaaaatttctaggtccttaccttggagacgccctgcaaatgtttttcgtgttaaagaagatgttcgtccaatattttggtctaaccgtcctaagagttacataaccaggactattggttgggatcagtacccatatgggcgatggggtgattctcgaaatccgtcctatggtgcactaacagaccatcagttcatgaggcctcgagcacgtgacaagaaacttcaagaagaatgggctaccccattgaaaagcattgatgatattcaagagaaatttaaaagtttttgtctgggtaagttgagaagtagtccttggtccgaactggattcacttcagcctgagacaaagatcatacatgaacagctgggaaagatcaatttgaagggtttccttactatcaatagccaacctgctgtcaatggtgaacgctctgattctctatctgtcggttggggtggccctggagggtatgtttaccagaaggcttatcttgagtttttttgctcaaaggaaaaactagatgcacttgtcaataaatgcaagcccttgtcatctattacctacattgctgtcaacaaaaaagggaatttgatatcgaacattggcacgacagatgttaatgctgtaacttggggagtgttcccagccaaagaaatagtccagccaacagtggtggatcctgccagcttcatggtgtggaaggatgaagcattcgaaatctggtcaagagcatgggctgcactgtacccagaaggcgatccgtcgaaaaaattgctagaagaggttcagagcagctattatttggtgagtttggttgataatgattacattggtagtgatgtttttgctgtttttggagacctttaagatgagattgctgccttcaagccctgaacttaccaaagctcttaagccccatatagtatcattatgtttgagttgtcaggttatttttttataatgattttttaaaaaaaaagagagaaatttgtaataataattccttggaattttaaccattcccttcatcatgcaaattacaatatatcaagagattattattattaatccgatacatcaagttgttaaaatgcttacatatattgttatttgaactataaccagaataatcttaaccaaaaaagaaaaaagtaccgactgcg

SEQ ID NO: 1532 - DNA, 2365 bp, Fagus grandifolia
acacattctctcttgtgtcttcattctcccctttctttctcacctttccaaaatctgaatcatcttcacgtgtcggtggtggtgaaaaaatgaaggtgatagagaagatccgcgaagcagacgaaggcaaagttgttttctccttcgaattccttccccccaaagacagaagatgcagtcgacaacctcttcgagagaatggagcgcatggttgctcacaacccttcattctgcgatatcacatggggagctggtggctccactgcagatctcactctcgacatcgctaacaggatgcagaacatgatctgcgttgagtccatgatgcatctcacctgtactaacatgcctgttgataagatcgaccatgctctccaaactatcaaggcgaatgggctccagaatgttcttgctctccgtggagatcctccgaaaggacaggacaagttcgttcagatccagggcgggttcgcttgcgcgctcgatctcgtgaaacatattcgagctcaatatggtgattactttggcattacggtggctggttatccagaggcgcatcctgaggtgatcggagagaatggattggctacgctcgaagattatcataatgaacttgtttatctcaagaagaaggtggatgcaggagctgatgtgatcatcacgcagctattttatgatactgacatttatctgaaattcgtgaatgattgtcgtcaaatgggaataacttgtcccattgttccgggaattatgcctattaataactacaagggcttcagaaggatgaccggattttgcaaaactaggatacctgctgaaattatggccgccttggagcctatcaaggacaatgaagaagctgtcaaagcctatggaattcatcttggaactgaaatgtgcaagaagattttagctcatgggattaagcaagtgcatctttatacactcaacatggaaaagtcagcattagctatattaatgaatcttggactgattgaagagaccaaaatttcaaggcccttgccttggagacgcccaacgaatgttttccgtgtcaaggaagatgttcgtccaattttctgggctaatcgtccaaagagctacatatcaaggacaataggctgggaccagtacccacatgggcggtggggtgattcttgtaatccatcatatggagcattaagtgaccatcagttcatgcggccacgtgcacgtgacaagaaacttcttgaagaatgggctacacccttgaaaaatgttgaagatattcatgagaaatttaagaaatactgccttggaaaattgaggagcagtccttggtcagagttagacgggcttcagccagagacaagaatcataaatgaacagctggggaagattaatattaagggtttccttaccatcaatagccaaccagcagtcaatggggaaaaatctgattcctcatctgtcggatggggtgggcctggagggtatgtttatcagaaggcatatgtagagtttttctgttcaagggagaagttggatgcacttgttgacaaatgcaaggcttccccatctctaacctacatggctgtgaacaaagaagggaattggatatctaatgtccgccaaactgctgtgaatgccgtgacatggggagtcttccctgcaaaggagatcatccaaccaactgttgtggatcctgccagctttatggtgtggaaggatgaggcatttgaaatctggtcaaggggatgggcttccttgttcccagagggtgatccatccagaaaactgcttgaagaggtccagagcagctattacttggtcagcttggtggataacgattacgtccacggtgatctttttgctgtttttacagatttctaagatgagctgtgtttcttccgttcatttttaaagcccacataagccatataagtggtgctttcctaagttggatttatataatcgctgttggaatgtgtcaatttataatcttattggtttgtattaataattcattgggattttgattcctcccttgctttataatccaaactaataattgttaggtaacagaagtatgccagtgtcgggcaacttcaatgtgtttgcttttatttttttgggtgtgtggatttcgtagaagcaatctgttaaatttgtagaaaacacctatcttcgtacaattctgctgtgccactgattctcttctcgtagtgtaattccttgggcattagtggtagctaatttatttacctcggcttcccattagattttcatgttattagtttgaacatcacagcattccatccatattgtcagttctaatcttgtgtgctaatgacgcatgtgcggttgacggggaactgtctcagaa

SEQ ID NO: 1533 - DNA, 2146 bp, Arachis hypogaea
tgggggggcgcttttgccatctgcctctgcctcattgtctcccttcctcataagtttcatcctagaggataaaatttgaagagacaaaaagaagcaaaatgaaggtgatagagaaaatacgagcagctgcggcagctgatccagacagggtggtcttctcattcgagttctttccacccaagaccgaagatggggtagataatttgtttgagaggatggaccggatggtggcacataatccttcgttttgcgatatcacttggggcgcaggaggatccacagctgatctaacacttgaaattgcaaacaagatgcaaaacatggtatgcgtggagaccatgatgcacctcacctgtaccaacatgcctgtagagaagatcgaccatgctctccagaccatcaagtccaatggtctccagaatgttcttgctcttcgtggtgatcccccccacggtcaggacaaattcgtccagattgaaggtggctttgcctgcgctcgggacttggttaaacatataagagccaagtatggtgactactttggcatcacagttgctggttatccagaggcacatccagatgttataggaagtgatggcttggctactccagaaggttatcaaaatgatcttgcttacctcaagagcaaggttgatgctggagcggatctgatcgttacccaattattttatgatacagatatattccttaaatttgtgaatgactgtcgccaaattggaataacttgtcctattgtgcctggaattatgccgattaataattataaaggttttctccgcatgactggcttttgtaaaacgaagataccagctgacatttttgctgctttagagcctatcaaggacaatgaagaagctgtcaaatcttatggaattcacctgggaactgaaatgtgcaaaaaaattttagctcatggaattaagacactacatatgtatactctaaatatggagaaatcagcattagcaatactaatgaatctcggcttaattgaagagaccaaaattaataggtcattaccttggcgacgccctgcaaatgtgtttcgtgttagagaagatgttcgtccaatattttgggcaaatcgtccaaaaagctacatatcaaggacaataggatgggatcaatacccacatgggcgttggggtgattctcgtaatccatcatatggtgcactaactgattaccagttcatgaggccacgtgcacgggacaaaaagcttgttgaagaatgggtggttcccctgaggagcattgaggatatttatgagaggtttaaacagtattgccttggaaagttgagaagcaatccttggtcagaattagatggtcttcagccagagacgaggattataaatgagcagctggaaaagattaacttgaagggatttctcaccatcaatagccagccagcagtcaatggggagaaatctgattctcctactgtaggctggggtggacctggtggatatgtatatcagaaggcatatgtggagttcttttgctctaaggaaaagctggatgcacttgttgagaaatgcaagaatagatcatctctaactttcatggctgtgaataaagaaggaagttggagatctaatgtaggccaaaccgatgtgaatgctgtgacatggggggtcttcccagccaaggaaataatccaaccaaccattgtagatcctgttagcttcatggtatggaaggatgaggcatttgaaatttggtcaagaggatgggcatgcttgtaccctgagggtgatgcttccaggaaattggttgaagaggtgggcaacagctacttcttagtcagcttagtagacaatgattatgtcaatggcgatctttttgctgtttttgcagatttctgagatgaacttcatatattagctcttttaagtattgttcggttgtttgtcaagctttttccttttatttttcttcatgaagatttgaattatttagatggctctaaagttcgtatggcacatcatcgtttgtagtaaacatatactaaagacgtgttattcttcagaattgcaccggtaacgtgtcatttaatgaaatcgattgtaagataatttgtagacaataattactctttgaatttgatggtcgtttgtatttt

SEQ ID NO: 1534 - DNA, 2057 bp, Petunia hybrida
actttagtacatacattgtttgtttcctaacaaaaaacaatgaaggtaatcgagaaaattcaagaagctgagaaaaatgacagaatagtgttctcatttgaattctttccaccaaaaacagaagatggagttgacaatttatttgaaagaatggaaagaatggtatcatataacccatcattttgtgatataacatggggtgcaggtggttcaacagctgatttaactcttgaaattgctaatagaatgcaaaatatggtttgtgttgaaaccatgatgcatttaacttgtactaatatgcaagttgacaagattgatcatgctttacaaactattaaatcttatggtattcaaaatgttcttgctttaagaggtgatcctcctcatggtcaagataaatttgttcaagttgatggtggttttgcttgtgccttggatctggtaaagcacatgagggccaagtatggggactactttgggataactgttgccggttacccagaggcacatcctgatgttatacctgctaatggaatagctacacaagagacatatgaaaatgacctagactatctcaaaagaaaggttgatgctggagctgatcttattgtgactcaactcttctatgatactgatattttcctcaaatttgtcaatgattgccgccaaatgggaattactgtccccattgttccgggtatcatgcccattaacaattataagggcttcttacgcatgactggattttgtaagactaagattccagaagagataatggctgccttggaacctattaaggacaacgaagaggctgtcaaagcctatggaattcacctaggaactgaaatgtgcaaaaagattttggccagtggcattaagaccgtgcatctctatacactaaacatggagaaatcagcactggccatcttgatgaatcttggattaatagaagagtccaaaatttccaggccattgccttggagacgtcctacaaatgttttccgtgttaaagaagatgttcgtcctatattctgggcaaatcgtccaaagagctacatctcaaggaccataggttgggatgaatacccacatggtagatggggaaatgctcaaaatccatcatatggagcacttagtgactatcagttcatgcgtccacgttcaagagataagaagcttcaagaggaatgggctgtggctctgaatagtgtggaagatatcaatgagaaatttttgaactactgtcttgggaagctgagaagctgcccttggtctgaactagatggtcttcagccagagacaaagatcataaatgaacagttaggttctatcaacacaaaaggtttcttgactattaacagccaaccagcagttaatgctgcaaagtctgacgctccttctattggatggggtggcgccggtggatatgtttatcagaaggcttacctggaatttttctgctctggggaaaagttgaacacccttgttgaaaagtgcaaggcttatccctacctaacctacatggctgtaaacaaggagagaaactggatttccaacgttaaccaaactgatgtcaatgcagtgacatggggagtgttcccagctaaggaaattatacaaccaacagttgttgatcccgccagcttcatggtctggaaggatgaagcatttgagatctggtctagaggttgggctcaattatacccagagactgatccatcaagaaaattgcttgaacaggttcaaaacagttacttcttggtctgtcttgtcgataacgactatgtcaatggtgatctgttttccatcttcaaagatatctgaaagcaaccacactaagcttcttcttatcctttatagtcccaatttagaaccatgaaatttcgtcttggttctagtggaatttattactattattattgttagttctatggtcctgtaacaggaataattttaaagggatctgttccctttcattttgtttcctctgcaaaaatttgatgtacgttgccttgaggcttcaatctttgcaaatttcaccttcacacgtcttcgaa

SEQ ID NO: 1535 - DNA, 2055 bp, Gossypium hirsutum
agtcatttcaaaagacaccaaccccgatccgttccgttcctctactcaaaatacaaatactcccattgcaatgcctccacctcccatctctctctttaccaaccacaaacccatttaagttggtgttggtgacactgagagttcaagatccaattaaagatgaaggtgatagagaagatccaatctttgcaagaagggaaagtggtgttttcctttgagttcttccctccaaagactgaggatggagtagacaacctgttcgacagaatggatcgtatggttgctcataacccgtccttctgtgacattacatggggtgcaggtggttccactgctgatctcactctcgacattgctaacaagatgcagaatatcatctgtgtggagacgatgatgcacctcacttgcaccaatatgcccgtagagaagattgaccatgctcttcagaccatcaagtccaacggcattcagaatgttcttgccctccgaggtgatccccctcacggccaggacaagtttgtccaggtcgaaggcggcttctcctgtgcccttgatctggtgaaacatatcagatctaaatatggtgactactttggcatcacagttgccggttatccagaggcacatcccgatgccataggaaatgatggtgtagccacacctgaagcttatcagaatgatcttgcttacttaaagagaaaggttgatgcgggagctgatctgattgttactcaactgttttatgatactgatatctttatcaaatttgtcaatgactgtcgccaaatgggaattaactgtcctatagtgccgggtattatgcccattaataactacaagggtttcttgcgaatgactggcttttgcaaaactaagataccagctgagattactgctgccttagaggctatcaaggacaacgaagaagctgtcaaagcctatggagttcaccttggaacagaaatgtgccgcaagattttagctcatgggattaagacattgcacctttatacattaaacatggagaaatctgcattagctatcctaatgaatcttggattgattgaagagtccaaaatttcaaggtccttaccttggagacgccctgcaaatgtttttcgtgttaaagaagatgttcgtccaatattttggtctaaccgtcctaagagttacataaccaggactattggttgggatcagttcccacatgggcgatggggtgattctcgaaatccgtcctatggtgcactaacagaccatcagttcatgaggcgtcgagcacgtgacaagaaacttcaagaagaatgggctaccccattgaaaagcattgatgatattcaagagaaatttaaaagtttttgtctgggtaagttgagaagtagtccttggtccgaactggattcacttcagcctgagacaaagatcatacatgaacagctgggaaagatcaatttgaagggtttccttactatcaatagccaacctgctgtcaatggtgaacgctctgattctctatctgtcggttggggtggccctggagggtatgtttaccagaaggcttatcttgagtttttttgctcaaaggaaaaactagatgcacttgtcaataaatgcaagcccttgtcatctattacctacattgctgtcaacaaaaaagggaatttgatatcgaacattggcacgacagatgttaatgctgtaacttggggagtgttcccagccaaagaaataatccagccaacagtggtggatcctgccagcttcatggtgtggaaggatgaagcattcgaaatctggtcaagagcatgggctgcattgtacccagaaggggatctgtcgaaaaaattgctagaagaggttcagagcagctattatttggtgagtttggttgataatgattacattggtagtgatgtttttgctgtttttggagacctttgaagatgagattgctgccttcgagccctgaacttaccaaagctcttaagccccatatagtatcattatgtttgagttgtcaggttatttttttataatgatttcataaaaaaaaag

SEQ ID NO: 1536 - DNA, 2221 bp, Prunus persica
tcgagcggttggtgggtgggtttctttctctaaaacaaaaacaaacaaaagcaaaaacaggtcattgcagatctatccgaaaggtaagagagagagagagagaatgaaggtgatagagaagatccaggaggcgttgttggaggagaagaaggttttgttctcgttcgagttcttcccgccaaagacggaggatggggtggagaacctgttggagaggatggagaggatggtggcccacaacccggcgttctgcgacataacgtggggtgcgggtgggtcgacggcggatctgacgctggacattgcgaacaagatgcagaacatcatctgcgtggagagcatgatgcacctcacctgcaccaacatgcctgtcgacaagatcgaccacgccctccaaaccatcaagtctaacggcctccaaaacgttcttgctctccggggcgacccgccccatggccaggacaagtttgttcagatccaaggaggctttgcctgcgccctcgacctggtcacccatatcagagccaaatatggtgactactttggcgtcactgttgctggctatccagaggcacacccggacgccattggaacggatggcctcgcctctcccgaagcctatcaaagtgatctggcttatttgaagagaaaggttgatgctggtgccgatttgattatcactcagttattctacgacactgatgttttcctcaaattcgtccacgactgtcgccaaattggaattacttgtcctattgttcctggaattatgcccattaataactacaagggattcatacgcatgactggtttctgtaaaaccaagataccagctgaggttactgctgccttggagcctatcaaggataatgaagaagctgtcaaatcttatggaattcaccttggaaccgagatgtgcaagaagattttggctcatgggattaggacgttgcatctttatacactgaacatggagaaatcagcgttggctatattaatgaatcttggtttgattgaagagaccaaaatatcaaggcctttaccttggagacgtcctgcaaatgttttccgtgttaaagaagatgttcgtccaatattctgggctaatcgtcccaagagctacatatcaaggaccataggctgggacctttatccacatgggcgatggggtgattctcgtaacccttcatatggagcactaactgattatcagttcatgcggccacgtgcacgcgacaagaaacttgttgaagaatgggttgtcccattgagaagcgttgaagatatccatgagaaatttaagaaattctgccttggaaaattgagaagcagcccttggtccgaactagatgggcttcagccagagacgaagatcataaacgaacttctaggtaaaattaacacgaaaggtttccttaccatcaacagccaaccagcggtaaatggggaaagatctgattccacgtctgttggctggggcgggcctggaggatatgtttatcagaaagcctatctagagtttttctgttcgaaggagaagttgaatgctcttgttgagaaatgcaaggctcttccatctctaacctacatggccgtgaacaaggatgggagatggatatctaatattggtcagactgatgtgaatgctgtgacatggggagtctttcccgcaagggagataatccaaccaactgttgtggatcctgctagttttatggtttggaaggatgaggcatttgaaatctggtcaagaggatgggcctgcttataccctgagggtgactcatctaggaaattgcttgaagaggtccagaacagctacttcttggccagtttggtagataatgactatatccagggtgatgtttttgctgtctttgctgatttctgaatgaagctattttgtcaactcttccatttcttaaagcctcataagccattaaactggtgctttcattgtaagtcgggttataaatttattgtcactgggatgtgtaataatactcattgggattttgatatcaccccccatgtgcaaatcgcatctgcgttcgtgattgattaccggtctgtatcagagttcatcaatgtctggcttaattgatacgatcatcttgtgtgtttgcttccagtatgtgctttgtggcaatggaatccgcattttaatgacatataaattaataggtggtgttttctctttatttgtatcatttgtcaaagt

SEQ ID NO: 1537 - DNA, 2228 bp, Glycine max
attctatgtgaagaagggagcaccagtagccagttgccacctaccatccttactcactttctataaataaataatcacattaccactcctcacattccgcgctctctacctgacctcacaaggattgagtgttggatctagtcatctagatttaaaaaaaaaatgaagatcattgagaaaattcgcgcagcttctgctgatccaaacagggtggtgttctcatttgagttcttcccccccaagactgaggatggtgtggacaatctgtttgagaggatggaccgcatggtggctcacaacccctctttttgcgacatcacttggggcgctggagggacaacggctgatcttacattggaaattgccaacaagatgcagaacattgtctgtgtggagaccatgatgcacctcacctgcaccaacatgcctgtcgaaaagattgaccatgctctccacaccatcaaatccaatggcctccaaaatgtgcttgcacttcgtggtgatccgcctcatggtcaggacaaattcgtccaggtcgaaggcggctttgcctgcgcacgcgacttggtgcaacatatcagagctaaatatggtgactactttggcattacaatcgctggttatccagaggcacatccagatgttatagaaagtgatgggttggctacaccggagggttatcgaaatgatcttgcttacttgaagagcaaggttgatgctggagcagatctgattgtcacccaattattttatgatacggatatattcctcaaatttgtgaacgactgtcgccaaattggaataacgtgtcctattgtacctggaattatgcccattaataattacaagggctttatccgcatgactggattttgcaaaacaaagataccagctgacattatggctgctttagagcctatcaaggacaatgaagaagctgtcaaggcttatggaattcacctgggaactgaaatgtgcaaaaagattttagctcatggaattaagacattgcatctttatacactaaatatggagaaatctgcattggcaatactaatgaaccttggcctaattgaagagtccaaagtttctaggtccttaccttggagacgccctgcaaatgttttccgtgttaaagaagatgtccgtccaatcttttgggcaaatcgaccaaaaagctacatatcaaggaccataggatgggatcaatacccacatgggcgttggggtgattcctgtaatccatcatatggtgcattatctgattatcagttcatgcggccacgtgcacgggacaagaagcttgttgaagaatgggcagttcccttgaaaagcgttgaagatatatatgagaggtttagactgtattgccttggaaagttgagaagcaatccttggtcagaacttgatggtcttcagcctgagacaaagatcataaatgagcagctggagaagattaacacaaagggcttcctcaccatcaatagccagccagctgtcaatggggaaaagtcagattctcctactgtaggctggggtggacctggtgggtatgtttatcagaaggcatatgtagagttcttctgctctaaggaaaagctggatgcacttgttgataaatgcaaggatcgaacatctttaacttatatggctgtgaataaagatgggagctggaaatctaatgtgggtcaaactgacgttaatgctgtgacatggggtgtcttcccagctaaggagataattcaaccaaccattgtagatcctgtcagcttcaatgtatggaaggatgaggcatttgaaatttggtcaagaggatgggcaagcttgtaccctgaggatgaggcatccaggaaattggttgaagaggttgggggcagtcacttcttggttagtttggtcgacaatgattacatcaatggtgatctttttgccgtctttgcagatttctgacatgagcttattatttattagtactttagctatgtcacttctgttggttgtcatgttcttttcctttcttttgttttcttctcagtatgatgattcatattacacatggttctaagttgaagtgccaaattatttttctgggctatgtccctaacgtctttatattttcattcttcaaagtcgcatgggtaacctgtacgttgacataaggacaagttactccttcctctgaattggatgtttcttaatatatataatgagtgaactgtgaaagcaga

SEQ ID NO: 1538 - DNA, 2435 bp, Glycine max
attccgcgcttcgtgtatctctcacccataaattcattctaatgcgaagaaaaaattgaaaaagtgacaagggaccaccggtagccagttgccaccaaccatcctcactcagatctcagatctacctgtgtcgtttcctctataaataaacaaataaccacattaccgctcctcacattccgcgctttgtgtatctctgtctaccttaccttacctcacctcacaagggacaaagataaaaaatgaagatcattgagaaaattcacgcagcctcggctgatccaaacagggtggtgttctcatttgagttcttcccgcccaagactgaggatggggtggacaatctgtttgagaggatggaccgcatggtggtgcacaacccctcgttttgcgacatcacttggggtgctggagggacaacggctgatcttacattggaaattgccaacaagatgcagaacattgtctgtgtggagaccatgatgcacctcacctgcaccaacatgcctgttgagaagattgaccatgctctccacaccatcaagtccaatggcctccaaaatgtgcttgcacttcgaggtgatccaccgcatggtcaggacaaattcgtccaggtcgaaggcggctttgcctgtgcacgcgacttggtgcaacatatcagagctaaatatggtgactactttggcattacagtcgctggttatccagaggcacatccggatgttatagaaagtgatgggttggctacatcagagggttatcaaaatgatcttgcttacttgaagagcaaggttgatgctggagcagatctgattgtcactcagttattttatgatacggatatattcctcaaatttgtgaacgactgtcgccaaattggaataacgtgccctattgtacctggaattatgcccattaataattacaagggctttatccgcatgactgggttttgcaaaacaaagataccagctgacattatggctgctttagagcctatcaaggacaacgaagaagctgtcaaggcttatggaattcacctgggaactgaaatgtgcaaaaagattttagctcatggaattaatacattgcatctttatacactaaatatggagaaatcggcattagcgatactaatgaaccttggcctaattgaagagaccaaagtttctaggtccttaccttggagacgccctgcaaatgttttccgtgttaaagaagatgtccgtccaatcttttgggcaaatcgtccaaaaagctacatatcaaggacaataggatgggatcaatacccacacgggcgttggggtgattcctgtaatccatcatatggtgcattatctgattatcagttcatgcggccacgtgcacgggacaagaagcttgttgaagaatgggcagttcccttgaaaagcattgaagatatatatgagaggtttagactgtattgtcttggaaagttgagaagcaatccttggtcagaactagatggtcttcagccagagacaaagataataaatgagctgctggaaaagattaacacaaagggcttcctcaccatcaatagccagccagctgtcaatggggaaaagtcagattctcctactgttggctggggtggaccaggcgggtatgtttaccagaaggcatatgtagagttcttctgctctaaggaaaagctggatgcacttgttgataaatgcaaggatcgaacatctttaacttatatggctgtgaataaagacgggagctggaaatctaatgtgggtcaaactgatgttaatgctgtgacatggggtgtcttcccagctaaggagataattcaaccaaccattgttgatcctgtcagcttcaatgtatggaaggatgaggcatttgaaatttggtcaagaggatgggcaagcttgtaccctgagggtgatgcatccaggaaattggttgaagaggttgggggcagctacttcttggtgagtttggtcgacaatgattacatcaatggtgatcttttcaccgtctttgcagatttctgacatgagcttattatttattagttctttagttatgtcacttctgttcgttgtcatgttcctttcctttcttttgttttcttctcagtaggatggttcatattacacgtggttctaagttgaagtaccaaattatttttctgggctttgtcccaaacatctttattttttcattcttctgagtcgcatgagtaacctgtacgttgacttaaggacaagttactccttcctttgaattcgatgtttcttaactgtgaaagtagaatatcgaagtcttgtgtgttatattttgcttttatttcttttctctgagaaccttgtcatcattggcatttgagaaaaaaaaatcatgtatattacaatctctctctctctatatatataacacaatagttgcaaccgtgttta

SEQ ID NO: 1539 - DNA, 2158 bp, Solanum lycopersicum
tttgtaccaatcaccaccaagctgcttctactataaaaaagctgcaattttttttcaagattcttgccaaatcttcaatctcgaacacaatttttcactaatccaacacccccattttcaatttttcaagaaaatgaaggtaattgagaagattcaagaagcagccaagactgacaaagtgatattttcgttcgaatttttcccaccaaagactgatgatggggttgaaaatctgtttgaaagaatggaaagaatggttgctcatggtccatctttttgtgatataacatggggtgctggtggttcaacagcagatctgacacttgagattgttaataggatgcagaatatggtgtgtgttgaatctatgatgcatttgacatgtacaaatatgcctgttgaaaaaattgatcatgctcttgatactattaaggctaatggtattcaaaatgttcttgctcttcgtggagatcctcctcatggtcaggataagtttgttcaggttgaaggtggatttgcttgtgctttggatctggtgaagcatatgcgtgccaagtatggggattactttgggataactgttgcaggttatccagaggcacatcctgatgttatacctgctaatggaatagctaccaaagagatttatgaaaatgaccttgcttaccttaaaaaaaaggttgatgctggagctgatgttattgtaactcaactcttctacgatactgatattttcctaaaatttgtcaatgattgccgccaaattggaattaactgccccatcgttccgggtatcatgcccattaacaattacaagggcttcttgcgcatgactggattttgcaagactaagattccggatgagataatggctgcattggaacctattaaggacaatgaagaggctgtcaaagcctatggaattcaccttggaactgagatgtgcaaaaagattttagccactggcattaagaccttgcatctttatacattgaacatggagaaatcagcattggccattttgatgaatcttggattaatcgaagagtccaaaatttctaggccattgccttggagacgtcctgcaaatattttccgtgttaaggaggatgtgcgtcctatattttgggcgaatcgtccaaagagctacatttcaaggaccacaggttgggatgaatacccacatggtagatggagcaatgctcaaaatccatcatacggagcacttaccgactatcagttcatgcgtgcacgctcaagagataagaagcttcaagaggaatgggctgcggctttgaatagcgtggaagatatctacgagaaattcaaggactactgtcttggaaagctgagaagctgcccatggtctgagttagatggtcttcagccagagacaaagatcataaacgaaaagttgggtcaggtcaacacgaaaggcttcctgactattaacagccaaccagcagttaatgctgagaagtccgactctccttctgttggatggggtggccccggcggatatgtttatcaaaaggcatacttggagttcttctgctctcaggagaagttgaacgccctcgttgagaaatgcaagtctttcccttacctaacttacatggctgtaaacaaggaaggaaactggatctccaacgtcaaccaaaccgacatcaacgctgtgacatggggagttttcccagctaaggaaattatacaaccaactgtcgttgatcccgccagcttcatgatatggaaggatgaggcatttgaaatctggtcaagaggatgggctcaattatacccagagactgatccatcaagaaaattgcttgaacaagttcagaacagttacttcttggtcagcctcgtcgataacgactacatcaatggtgatttgttttccatcttcaaggatatctgaaactaaccaagaaaactcagtttctcaactttttttagtcccattttattccaagagtttttactggatgttgttactattattattgttattattgttgttgttctatgttcttataataggaataatttaaagggttttgttcccttcaatttattcttttcctcttcaaatttgatgtactttgccttttaaggcttcaatctttacaaatttataagcaattatccttccacacct

SEQ ID NO: 1540 - DNA, 2241 bp, Zostera marina
gggggtgtgctctaacgtccgatccacagagagaagaagagcatccaagatgaaggtgatagagaagatcagggaggcggtggagggaaatggccagacggtgttctccttcgagtactttcctccgaagacggaggagggcgtcgagaatctgttcgaaagaatggaccgtatggttaaacacaaccctactttctgtgatatcacttggggagccggtggatccaccgctgatgtcactcttgaaatcgcaaatcgtatgcagaatatggtatgtgtggagactatgatgcacctcacttgcacgaacatgccggtggaaaagatagatcatgctcttaccacaatcaagaacaatggcatccagaatgtgcttgcacttaggggagatcctcctcacgggcaggataaatttgttcaagttgaaggaggatttgcttgtgctcttgatttggtgaagcatatgcgtgcccagtatggcgattactttggtataactgtggcaggttatccagaggcacaccctgatcaaatacaaggtgaatgtgctgcacatgatgcataccaaaatgaccttgtctatctaaagcaaaaggttgatgctggtgcagatgttattgtcactcagctattttacgataccgatatttttctaaagttcgtagatgactgccgacagattggaataacatgtccaattgtccctggaataatgccaataaacaactataggggttttatccggatgactggattctgcaaaaccaaaattcctgcagaattgactgctgctttggaacccattaaagataacgaagaggctgttagggcttatggtattcattttggaactgagatgtgcaaaaagatattagcttctggtatcaaaaccttgcatctttatacgttaaacatggagaagtctgcacttgctatattaacgaatcttgggttgatcgaagaatctaagattacaagatctttaccttggaggcccccgactaatgtcttccgtgttaaagaagacgtccgaccaattttctgggctaatcgtccaaagagctacatctcaaggactgttggttgggaacaatatccccgtggtcgttggagtgattcaaaaaatccttcatatggagcacttactgaccaccagttcttgcgtccacgttcccgggataagaagcttcagaaagactgggcagttcctttgaaatgtgttgaagatatttacgagaggttcgcaaacttctgtttggggatactttctagcagtccatggtcagatttggagggacttcaacccgaatcaaaaatcatcgatgcacaattgggaatgattaaccagaaaggtttccttagtatcaacagccagccttctgttaatggggagaaatctgactctccatccataggatggggaggttcaggtggatacgtgtatcagaaggcatatttggagttcttctgcagtgaagaaaaactaaagtcacttgttgagaaatgcaagagcataccatctcttacttttaccgcagtgaacaaagatggcaaatctattacgaacataggtgatccaagtgaagttaatgcagtgacatggggtgttttccctggaaaagagattatccaaccaaccgtggttgatcctgatagtttcatggtctggaaagacgaggcatttgaactatggaccaaggcttgggcatgtttgtttcctgatggtgacctatccaagcaattacttgaacaggttcagaaaacttacttcttggtgagtctggttgacaatgactatgtccatggagatatatttgcggtatttaaagatctctgaaagaatacgacgacagattgatattgaattccgtattattaattaaaaatagattgatcattcgtacgaataaataattttcgatttctcctctccctactttttattttcttccatttatttttaatattaatttgaatttcgtactctattgagtatttgagtatagtgtttaatgaactaaataaaatcttaaaagatagatatactattctttaaggttagatgaggttgtgttatcttttcaactttttatttgagtcgtcgctcatgtaatatggtttgagattattctttttatttatgttagccaaagtactggctctgaaaattgtaaaggacattgttagccaaagtatcttaaatcttttgtatcaacaagatataatggatgtttccattcc

SEQ ID NO: 1541 - DNA, 2116 bp, Capsicum annuum
ctccaaaaaaaagcttcaatttttattcaagattcttggcaaaatcttgaatcttgaacacccatttccccagaaatcaacaaaaaatgaaagtaattgagaaaatccaagaagcaatcaagaatgacaaagtaatattttcctttgaatttttcccaccaaaaacagaagatggtgttgagaatctatttgaaagaatggaaagaatggttacacatggtccatcattttgtgatataacatggggtgcaggtggttcaactgcagatctaacacttgaaattgttaaaagaatgcagaatatggtgtgtgttgaaagtatgatgcatttaacatgtactaatatgcctgttgagaaaattgatcaggctcttgatactattaagagtgatggtattcaaaatgttcttgcacttcgtggtgatccacctcatggtcaagataagtttgttcaggttgaaggtggttttgcttgtgcgttggatctggtgaagcatatgcgtgccaagtacggggattactttggaataactgttgcaggttatccagaggcacatcctgatgttatacctgctaatggaatagctacaaaagagatttatgaaaatgaccttgcttacctcaagaaaaaggttgatgctggagctgatcttattataactcagctcttctatgatactgatattttcctcaaatttgtcaatgattgccgccaaattggaattaattgccccattgttccgggtatcatgcccatcaacaattataagggcttcttgcgcatgactggattttgcaaaactaagattcccgaagagataatggctgccttagaacctattaaggacaacgaagaggctgtcaaagcttatggaattcaccttggaaccgaaatgtgcaaaaagattctagccaatggcattaagcaattgcatctttatacattgaacatggagaaatcagcattggccattttgatgaatcttggattaatcgaagagaccaaaatttctaggcctttgccttggagacgtcctgcaaatgttttccgtgtaaaggaggacgttcgtcctatattctgggcgaatcgtccaaagagctacatctcaaggaccataggttgggatgaatatccacatggtagatggagcaatgctcaaaatccatcatatggagcacttaccgactatcagttcatgcgtgcacgctcaagagataagaagcttcaagaggaatgggctgttgctttgaatagcgtggaagatatctatgagagatttaaagactactgtcttggaaagctgagaagctgcccgtggtctgaattagaaggtcttcagccagagacgaagatcataaacgaaaagttgggtcatgtcaacaccaaaggtttcttgactattaacagccaaccagcagttaatgctgagaagtccgactctccttccgttggatggggtggccctggcggatatgtttatcaaaaggcttacttggagttcttctgctctcaggagaagttgaatgcgcttgttgaaaaatgcaaatctttcccttacctaacttacatggctgtaaacaaggaaggtaactggatctccaatgtcaaccaaactgatgtcaatgcggtgacatggggagttttcccagctaaggaaattatacaaccgacagtcgttgaccctgccagcttcatggtatggaaggatgaggcatttgagatctggtcaagaggatgggctcaattatacccagaggctgatccatcaagaaaagttcttcaacaagttcagaacagttacttcttggtcagccttgtcgataatgactacatcaatggtgatttgttttccatcttcaaagatatctgaactaagcaacaaaactcagcttctcatcctttatagtccccattcaaacacaagaatttttcttgttttttattggatgttatcattattttataattgttgttgttttatggtcttgtaataggaataatttaaagggatttgtgcccattcaattatttgtaactctgcatatttgatgtatgttacccgtcaaggcttcaatcattgcaaatttataatgaaatatccttccacaaaaaaaa

SEQ ID NO: 1542 - DNA, 2127 bp, Capsicum annuum
ctgtaacccccctccaaaaaaaagcttcaatttttattcaagattcttggcaaaatcttgaatcttgaacacccatttccccagaaatcaacaaaaaatgaaagtaattgagaaaatccaagaagcaatcaagaatgacaaagtaatattttcctttgaatttttcccaccaaaaacagaagatggtgttgagaatctatttgaaagaatggaaagaatggttacacatggtccatcattttgtgatataacatggggtgcaggtggttcaactgcagatctaacacttgaaattgttaaaagaatgcagaatatggtgtgtgttgaaagtatgatgcatttaacatgtactaatatgcctgttgagaaaattgatcaggctcttgatactattaagagtgatggtattcaaaatgttcttgcacttcgtggtgatccacctcatggtcaagataagtttgttcaggttgaaggtggttttgcttgtgcgttggatctggtgaagcatatgcgtgccaagtacggggattactttggaataactgttgcaggttatccagaggcacatcctgatgttatacctgctaatggaatagctacaaaagagatttatgaaaatgaccttgcttacctcaagaaaaaggttgatgctggagctgatcttattataactcagctcttctatgatactgatattttcctcaaatttgtcaatgattgccgccaaattggaattaattgccccattgttccgggtatcatgcccatcaacaattataagggcttcttgcgcatgactggattttgcaaaactaagattcccgaagagataatggctgccttagaacctattaaggacaacgaagaggctgtcaaagcttatggaattcaccttggaaccgaaatgtgcaaaaagattctagccaatggcattaagcaattgcatctttatacattgaacatggagaaatcagcattggccattttgatgaatcttggattaatcgaagagaccaaaatttctaggcctttgccttggagacgtcctgcaaatgttttccgtgtaaaggaggacgttcgtcctatattctgggcgaatcgtccaaagagctacatctcaaggaccataggttgggatgaatatccacatggtagatggagcaatgctcaaaatccatcatatggagcacttaccgactatcagttcatgcgtgcacgctcaagagataagaagcttcaagaggaatgggctgttgctttgaatagcgtggaagatatctatgagagatttaaagactactgtcttggaaagctgagaagctgcccgtggtctgaattagaaggtcttcagccagagacgaagatcataaacgaaaagttgggtcatgtcaacaccaaaggtttcttgactattaacagccaaccagcagttaatgctgagaagtccgactctccttccgttggatggggtggccctggcggatatgtttatcaaaaggcttacttggagttcttctgctctcaggagaagttgaatgcgcttgttgaaaaatgcaaatctttcccttacctaacttacatggctgtaaacaaggaaggtaactggatctccaatgtcaaccaaactgatgtcaatgcggtgacatggggagttttcccagctaaggaaattatacaaccgacagtcgttgaccctgccagcttcatggtatggaaggatgaggcatttgagatctggtcaagaggatgggctcaattatacccagaggctgatccatcaagaaaagttcttcaacaagttcagaacagttacttcttggtcagccttgtcgataatgactacatcaatggtgatttgttttccatcttcaaagatatctgaactaagcaacaaaactcagcttctcatcctttatagtccccattcaaacacaagaatttttcttgttttttattggatgttatcattattttataattgttgttgttttatggtcttgtaataggaataatttaaagggatttgtgcccattcaattatttgtaactctgcatatttgatgtatgttacccgtcaaggcttcaatcattgcaaatttataatgaaatatccttccacaaaaaaaa

SEQ ID NO: 1543 - DNA, 2462 bp, Cannabis sativa
caccaacaaccgagggagattaattattaatatgagcgaagtaataataatctttataaggcaaagggaaaggcaaacatcttcatttaccaaagataagctataaataaataaagccattctcttccctcccaacaatctcctctcttcatattctttctttctttcttctggaactgcaactatagaaccagaaggaaggaaggaaggaagaagatgaaggtcatagacaagatccggtgtgaggctaacaatgacaacgtcgtcttctccttcgagttcttcccacccaagacggaggaaggagtcgagaacctcttcgagaggatggagaggatggtagctcacaacccagccttctgcgacatcacttggggcgctggaggctccaccgccgatctcactctcgacatcgctaaccgaatgcagaacacagtctgcgtcgagagcatgatgcatctcacttgcaccaacatgccactggacaagatcgaccacgctctctccactatcaagtccaacggcctccagaacgtcctcgctctccgcggcgaccctcctcacggccaggacaagtttgtccaaatccaaggtggcttcgcatgtgctcttgatctcgtcaagcatatccgggctaagtacggtgactacttcggcatcaccgtcgccggctatccagaggctcatccggacgcaatcggccccgacggcctcgcctcacccgaagcataccaggtcgatcttgcttatttgaagagtaaggtcgatgctggagctgatttaatagtcactcaactattctacgacactgacattttcctcaagttcgtcaatgactgtcgccaaattgggattaattgtcccattgttcccggaattatgcctatcaataactacaaaggcttcatacgcatgaccggtttttgcaaaacaaggattccatctgaggtcaccgctgccctggagcctattaaggacaatgatgaagctgtgagagcgtatggaattcaccttggaactgaaatgtgcaagaagattttaggcagtggcataaaaacattgcacctttacactcttaacatggagaaatcagcattggccatactaacgaatcttgggttgattgaagaacgtaaaatatccagaccccttccttggagacgtcctgctaatgttttccgagtcaaagaagatgtccgtcccatattctgggcaaaccgcccaaagagctacatatcaaggactactggctgggaccagtacccacaaggacgatggggagattctcgcaatcctgcatatggggctttaactgattatcagtttatgcgaccacgttcacgtgacaaaaaacttgtggaagaatggagcattcctttgaagagcgttgaagatattcatgagcaatttaagaaattatgccttggaaagttgaaaagcagtccttggtctgaattagatggacttcagcctgagacaaagatcataaatgaacaactagtgaaaataaacggaaaaggtttcctgactgtgaatagccaaccagcagtaaatggggaaagatctgattccccagtagttggatggggtgggccaggaggatatgtttatcaaaaggcgtatttagagttcttttgcactaaggatttgttggacgcccttgttgaaaaatgcagcaggggtttctcatctttcacctacatggctgtgaacaaacaagggcattggttggcaaatgttgatcaaacttttgtcaatgccgtaacatggggagtgttcccaggaaaggagatcatccagccaactgttgtggatcctgctagctttacggtatggaaagatgaggcatttgaaatctggtcaagaggatgggctcgcttgtaccctgaggttgacccttctaggaaagtacttgaagaggtggagaacagctatttcttggtcagcttggtcgataatgattacatccatggtgatctttttgcagtttttaatgagttctgagttgtgttgtcctttctattagctattattgaaaatgaaaattatgctttgctctttagttggtttgtaattgttattgtcctttgtgaattgtgtaataataagatgagttttggaacctcctcccctgctgcgatccagaaatatggagcagtaacagtaactgcagacccaaagccgatttctgtaattgttgtctaccttattcattgtcgttacaatttttatttatttatagggtgattccatacaaagtctataagttgcactgtatcttaagtcactctccattgttattctattcgttatttcgtgacagtagctctcaaaatgccaaagagaatgaattggacaagataaagtgcatcataattttaccagtgtttaatgtattctatcaaatactttatgttgaacgataaaaaaaaaaaagaataaataaatttattattatttca

SEQ ID NO: 1544 - DNA, 2261 bp, Lippia dulcis
cagagatttcgcatcatatctcaagcattcttcgtatcaaatctatagcacccgccacagatctgatccaaattcgtcgtgtgggagttcgcattgagctcctgttggttgaggattggtgttttaggcaacccacattcccgtttcagcggtttgtttccccaatttctgtgagttgtagtgtgcattcgtgattctgggataatttgtttgcgttgaatttggtggtgttttattgagagagcgaggatgaaggtgattgagaagatccaggaagcagctgcggccaatgacgaccgggttgtgttctctttcgaattctttccgccgaagacggaggatggtgtcgataatctgttcgagagaatggatcggatggtggcgcataacccctcgttctgcgatataacgtggggtgctggaggatccaccgccgatctgacgctggagatcgctaatcgcatgcagaacatggtgtgtgttgagaccatgatgcatctgacctgcacaaatatgccggttgagaagatcgaccacgccctcgagactatcaagtccaatggcattcagaatgtccttgctctcagaggagatccacctcacggtcaggacaagtttgtccaggttgaaggaggcttcgcttgcgctctcgacctagtccagcatatccgttcccagtacaatgactactttgggataactgtggctggttatccagaggcgcatcctgatgtgattcaggatggagtggcgccgccagaggcatatgcgagtgaccttgcttatctcaagaaaaagattgatgctggaggtgaggtcattataactcagctgttttacgacactgatatctttcttaagtttgtcgatgactgtcgtcaaattggaataacgtgtcctattgtacctggtattatgcccattaacaattacaagggcttcctccgcatgactggtttctgcaaaactaagattccagctgagattatggctgccttggaccctatcaaggacaatgaagaagctgttagggcctacggcattcacctagggacagaaatgtgcaagaagattattgctagtgggatcaaaacaatacatctctatacattaaacatggagaaatccgcattggcaatattgatgaatctcgggctaattgaggagtccaaaatttcgaggcccttgccatggagacgcccgacaaatattttccgtgtaaaagaagatgttcgtccaatattctgggctaatcgtcctaaaagttatatctcccgaactgttggctgggagcaatatccacgcggtcgatggggagattctaaaactgcatcatatggtgcactcactgattatcagtttatgcgtccacgttcacgcagtaagaaacttaatgaagagtgggcaactcctttgaaaagtgttgacgatatttatgagaaatttacaagtttttgccttgggagacttaaaaccagtccatggtctgagctagatgggcttcagccagagaccagaatcatcaatgagcagcttggtagtattaatttgaaaggttttcttactatcaacagccaaccggctgtcaatggagctaagtctgactctccatctgttggatggggtggtccaggagggtatgtttaccaaaaggcgtacttagaatttttctgttctgctgagaagttgaatgctctagttgagaaaagcaaactcttcccacttcttacctacatggctgtgaataaagaaggaagtttggtatccaatgtcagccaaactgatgtgaatgctgtgacatggggagttttcccagcaaaggagattatacaacctactgttgtggatcctgcaagctttgtggtttggaaggatgaagcctttgaaatatggtcaaggggatgggctaagctctaccccgaatctgatccatccagaaaattacttgaggaggtgggaagcagctattatctggtcagcttggttgataatgactatgtccagggagatctatttgctgttttcaaagacctttgaaatggtttatgatatttgcttttcaatttaatatgcttgctctgatgtattcgcaatagtcatcaagtattcttatttctgttcaagcattaatttacagcgatgtaataacattatccatttgggattttgggataccctattcatcatgtaacctcaaggtcctcagcatatttgctacattgtatttgattattacacaaacaggctgtgtttgtgataaa

SEQ ID NO: 1545 - DNA, 2263 bp, Populus trichocarpa
tctcatctctctctatctgtttataaatagaaaaaaaataaaatcaatgaactacaactacaactgctacttgtaggtgtgggtttgctcttaactctttcattctatctgcgatcctctctccctcccccttggcacttgtcaagcagcagagaatgaaggttattgataagataagggcggcagcagcagcaggagattcaaatggaggagatagcagcagcaataataaggttgttttctccttcgaattctttcctccaaagaccgatgatggagtggacaacctgttcgagagaatggacaggatggtctctcacaatccttccttctgtgacatcacttggggtgctggtggctccaccgcagatctgaccttagacatcgccaacaagatgcagaacatcatctgtgtcgagactatgatgcatctcacctgcaccaacatgcccgttgagaagatcgatcacgccctcgaaaccatcaaatccaatggaatccagaatgttcttgctcttcgtggtgatcctcctcacggtcaggataaattcgtccagatccaaggcggcctcgcttgcgctctcgacctcgtcaaacatatcagatccaaatatggtgattacttcggcattactgtcgctggctatccagaggcacatcctgatgtgattggaagtgatggatttgctacgcttgaggattaccataaagatcttgcttatttgaagcagaaggtggatgctggggctgatctaattgttactcaactcttttatgatactgatattttcttgaaatttgtgaatgactgccgccaaatcggaatcaattgtcccattgtccctggtattatgcctattaataactacaagggcttcatacgtatggctggtttttgcaaaaccaagataccagccgaggttactgcggcattggagcctatcaaggataatgaagaagccgtcagagcctatgggattcaccttggaactgaaatgtgcaagaagattttagctcatggaatcaagacgttgcatctttatactctgaacatggagaaatctgctttagctatattaatgaatcttggtttgattgaagagtccaagattacaaggccgttaccatggcgccccccgacaaatgttttccgtgtaaaagaagatgtccgtccgatattttgggctaatcgtccaaagagctacctaacaaggacaataggttgggaccagtaccctcatggccgatggggtgattctcgcaatccatcctatggtgctttatctgactatcagtttatgcgaccccgggcacgtggcaagaaacttcttgaagagtgggctgcccccttgaaaagtgttgaggatatatacgagaaattcaaggtatactgccttgggaagttgaaaagtagtccttggtcagaactagatggccttcagccagagactaaaatcattaatgaacagctgggtaagatcaacttgaagggattcctgactatcaatagtcaaccagctgtcaatggggaaaaatctgattctccatctgttggttggggtgggccaggagggtatgtatatcagaaggcttatctagaatttttctgctccaaggacaagctgaatgctcttgttgacaagtgcaagtctttcccttttgtaacttacattgctgtgaacaaaggagggagttggatctctaacgttgccctgactgatgtgaatgctgtaacctggggagtcttcccaggaaaggagattatccaaccaactgttgtggatcccactagcttcagtgtgtggaaggatgaggcatttgaaatctggtcaagaggatgggcttccttgtacccagagggtgacccatccagaacgctacttgaagaggtgcagagcagctactttttggtcagcttggtagataatgattacatccatggggacatttttgctgtcttcgcggatttatgatgctaggggccctttgcagcccctgcactttctaagagtctatccaagtccccaaaaaatggtgctttatcctaagttgaatcccagctttaatcttcttatggcatacattgtttttgaaattatttccgtattgaaatgtaataataattcattgtgattttgctactcccctctccattatatgctgcaaatttgtatttggagtggcaactaattgtaagcttaaagaaaatatgattgcctctttttcttgaacttttcaattgagctgcgtgcctcgtttttta

SEQ ID NO: 1546 - DNA, 2432 bp, Fragaria vesca
ggcaccaccagtttgttactactcggctcctcattttggatctgaatccaaaaaaatatccgagagagcggagaggaggcgacgtcgtgtggtgtcggtgagtgtgagctgtagtagtgtgtaggtcctagtctctagtctcatcttaaatacagggagtgagtgttgggctgaaaaaagaaagaaaaatgaaggtgatcgacaaaatccttgaggcatcggcggatgagaagaaggtggtgttctcgttcgagttcttccctccgaagacggaggatggggtggagaacctgctggagaggatggatcggatggtggctcacaatccggccttctgtgacatcacttggggcgccggtggctccaccgccgatctgactcttgacattgccaacaaaatgcagaacgtcatctgtgtggagagcatgatgcatctcacctgcaccaacatgcccgtggacaagatcgaccacgccctccagaccatcaagtccaacggcctccagaacgttcttgctctccgcggcgacccaccccacggccaggacaagtttgttcagatccaaggcggctttgcctgcgccctcgacctggtcactcatatcagagccacatatggcgactactttggtatcactgttgctggttatccagaggcacatccagatgccattgaagccaatggccttgccactccagaatcctatcaaagtgatctcgcttatctcaagagaaaggttgatgctggtgctgatttgatcgtcactcagttattctacgatactgatgttttcctcaaattcgtcaacgactgtcgccaaatcggaatcacttgtcctattgttcctggaatcatgcctattaataactacaaaggtttcatacgcatgactggtttctgcaaaacaaggataccagctgaagttactgctgccttggaacctattaaggacaatgaagaagctgtcagagcttatggaattcaccttggaacagagatgtgcaagaagattttagctcatgggattaggacattgcatctttatacactgaacatggagaaatcagcattggctatactaatgaatcttggtttgattgaagaggctaaaatatcaaggcctttaccttggagacgccctgcaaatgtttttcgtgttaaagaagatgttcgtccaattttctgggctaatcgtcctaagagctacatatcaagaaccataggctgggacctgtacccacatgggcggtggggtgattctcgcaatccttcatatggcgcactaactgattaccagttcatgcgaccacgtgcacgtgacaagaaacttgttgaagaatgggttgttccactgaaaaatgttgaagatattcatgagaaatttgaaaaattctgcctcggaaagttgagaagtagcccgtggtcagaactagatgggcttcaaccagagacgaagatcataaatgagaagctggggaaaattaacacaaagggtttccttaccatcaacagccaaccagcaataaatggggaaagatctgactcaccaactgttggatggggtgggcctggaggatatgtttatcagaaagcctatgtggagtttttctgttccaaggagaagttaggtactctcgttgacaaatgcaaggcacttccatctctgacatacatggctgtcaacagagaagggagttggatatctaatatcggtcaaactgatgtgaatgcggtaacatggggagtcttcccagcaaaggagataatccaaccgactgttgtggatcctgctagttttatggtttggaaggatgaggcatttgaaatctggtctagaggatggagccgcttgtaccctgagggtgactcatctaggaaattactagaagaggtgcagaatagctacttcttggtcagcttggtagataatgactacatcaacggtgaccttttcactgtttttgctgattcctagaggggcttgcttgttgtcacttgcatccctcagccattaggctgttgctttccttgcaagtctggtttcatttattgtcaatgggatgtgtaataataactcattgggatttttatacctcccctgcggccctgctttacgatgcaaattgcatccgcgttctcttgcttataacaaagttcatcaacgtcccgtcttctaaattggtttattatggatttgcagcatttgcttataccaagttgtggaatttacgttttattgaaatgtattagatcgatggtcattctgtatttaatataatttgttgggtatggttttcaagatgccattgacagagcagtcaacagtttaacacatttgtgtaaagtaatcactgcctcagtgattggcactctcagaaatcattctacagtacactttggacctttattgtggaagtaccattatgaaatc

SEQ ID NO: 1547 - DNA, 2995 bp, Amborella trichopoda
ggcattccgagtccttctccgtcgtcttggttggtgctgagagtgggagagaaagatcagcaatttcgtttgtagctgtagagagagaaagagagggacggtctgggatctgcaaattttgtagcatagcattggcgttttagagagagagagagagaatgaaggtgattgagaagatcagggaagcagcgaaggaggacaggacggtgttctcctttgagtttttcccaccgaagacagaggatggcgtcgagaatttgtttgagaggatggagagaatggcgtctcacaacccttccttctgcgacatcacttggggcgctggcggatccaccgccgatctcaccctcgacatctccaacaagatgcagaacatgatttgtgtggagactatgatgcatctgacttgcacgaacatgccagttgagaagatcgatcacgcattggatacgattaagcaaaacgggattcagaatgttcttgctcttaggggagatcccccacacggccaagacaaatttgtccaagttgctggtggatttgcctgtggtcttgaccttgtggcgcatattcgagcaaaatatggtgattactttggcatcactgttgctggttatccagaggcccatcctgatatgatatctagtgaaggtggagtcactttggaaaactatctaagtgatcttgcttatttgaaaagaaaggttgatgctggtgctgatcttattgtcactcaattattttatgacacagatatatttcttaagtttgtccatgattgtcgtcaaattggaataacttgtcctattgtgcccggcatcatgcccattaataactacaaaggcttcgtgcgcatgactgggttttgcaaaactaagattcctgatgaaattacaaaagccttggagcctattaaagataatgaagaggctgttagggcctatggcgtacaccttggaactgaaatgtgcaagaaaattctttctcatggaatcaagacattacatctatacactcttaatatggagaagtcagcactggccattttaatgaatttggggctaattgacgagtcaaagatatccaggccatttccatggcggcgtcctgcaaatgtttttcgtgtcaaagaggatgttaggcccatcttttgggccaatcgtccaaaaagctacctatcaaggactctgggttgggaacaatatcctcatgggagatggggtgattcatgcaatccatcttatggagcacttactgattaccagttcatgagacggcggtcgcgcaacaagaaaattctggaagaatgggctgttccattgaaatctgttgaagatgttaaggagaaatttacgaactactgtttggggaaagttaaaagccatccgtggtcagagttagatgggcttcagccagagactttgatgattaatgagaaactgggacaggttaactcgaagggattttttactattaacagtcaacctgctgtcaacggggaaaaatctgattctccttctgttggatggggaggaccagggggatatgtatatcaaaaggcttacttggaattcttctgctcaaaagagaagttggatgctcttgttgagaactgcaagggtcttccttctgtcacctacattgcagtcaataagcaaggggaaagagtgtcgaacgttggccccattgcggtgaatgcggtgacatggggtgtcttccctgcaaaagaggtcctccaacccactgtagtggaccctgttagcttcatggtttggaaggatgaggcttttgagatctggaacaagggatggggggtcttgtacccagaaggggatccttcaaagcagatcctaaacgaggtgcagaactcttacttcctggtcagcttggttgataacgattatgtccatggtgatctttatgcgatgttcagtgacatttaagaacaaatactggtttttattacattaagcaaccccaaaaaagcctgttctttttgtttttcgtgatgtattttcgtttctcatgcgaggtctatctagggggtagctgtattcttggatgttaagatcaagttgtttgataccttgatcagtgtattatgattcacagttattttttaaaccgcatgagtgggatgttcaatgaagcatgcgcttgaaatactttctggtccacaaagatcatggaatgtatttcatgtttttatatttttcaaagttaaataatgcatttttatacctattgacgtcgttattaaccataaaatgacggttatatatgctaagatttcatatatggcagacttcaatgggtaaaacttgtctcaggtatccatattgagtatgtcgattgagattatatgtaacacgcattgttttatttgttggtcatcgttctcagctcgtaagttatttgcactttctgtgaatttttttgaaaaggaaaaagatctcttagcatatatgccagaaggcctgacttgggacgtttgttccgaacgaaactcttctaaacttgattaaccaacattcaattggaagaaaaaaagggagaaaaaaaagagcaagcataatagagaggtccggggcccgagaaatcatcttttgtatgtctttgttttccctcgaaaatcagtctttggggtatttttctcaccaaatgttgatttttacaaaaaaaaaagaaatcaacaaaaagaatccatgctatctctctcacctctttggcgagtctctacttgttttttttttccctcgccttttcctctctcatttccttctcttactttgtcaagagtttctgagaatcgaaaaaaagagatttttttatcaaagaggtacaagctctttttgcagggtcccaacaattgttagaaaaaccgggggatctaaccagtaaccgttcaattagattggaaccagccctttgccagttttggtttcgaacgattttggtgatcggtcggtatttaaaaaaaataaataaaaataaa

SEQ ID NO: 1548 - DNA, 2422 bp, Cajanus cajan
aaaatttgaattactggccagtatccggtagccagtagccaccaaccaccttactatccatcatcctcatttcctcactcacagatctacctttgtctcgtttcgtctataaataaccagatttctgctccttttatcgtgcgcttcggttgtctctccctacctcacctcacaaggattgagtgttggatccagctgatctactgcttgagggataaagatgaaggttatagacaaaattcactcggctgatccaaacagggtggtgttctcattcgagttcttcccgccgaagactgaagatggggtggacaatctgtttgagagaatggagcgcatggtggctcacaatccctcgttttgtgatatcacttggggtgctggaggatcaacggctgatctaacattggaaattgccaacaagatgcagaacattgtctgtgtggaaaccatgatgcacctcacctgcaccaacatgcctgttgagaagattgaccatgctctccacaccatcaagtccaatggcctccagaatgtgcttgcacttcgaggtgatcccccacatggtcaggacaaatttgtccaggtcgaaggcggctttgcctgcgctcgcgacttggtgaaacatatcagagctaaatatggtgactactttggcattacggtcgctggttatccagaggcacatccggatgttatagaaagcaacgggttggcttccccggaaggttatcaaaatgatcttgcttacctgaagagcaaggttgatgctggagcagatctgattgtcacccagttattttatgatacagatatattcctcaaatttgtgaatgactgtcgccaaattggaataacttgtcctattgtccctggaattatgcccattaataattacaagggttttctccgcatgactgggttttgtaaaacaaagataccagctgagattatggctgctttagagccgatcaaggacaacgaagaagctgtcaagtcttatggagttcacctgggaactgaaatgtgcaaaaaaattttagctcatggaattaagacagtgcatctttatacactaaatatggagaaatcagcattagcaatactaatgaaccttggcttaattgaagagaccaaaatttctagggccttaccttggagacgccccgcaaatgttttccgtgttaaagaagatgtgcgtccaatcttttgggcaaatcgtccaaaaagctacatatcaagaaccataggatgggatcaatacccacacgggcgttggggttattcctgcaacccatcatatggtgcattaactgattatcagttcatgcggccacgttcgcgggacaaaaagcttatcgaagaatgggcagttcccttgaaaagtgttgaagatatatatgagaggtttagactgtattgccttggaaagttgagaagcaatccttggtcagaactagatggtcttcagccagagacaaagatcataaatgaattgctggagaagattaacatgaagggcttcctcacaatcaatagccagccagctgtcaatggggaaaaatcggattcccatactgtaggctggggtggacctggtgggtatgtttatcagaaggcatatgtagagttcttctgctctaaggaaaagctggatgcacttgttgataaatgcaaggatcgaacatctttaacttatatggctgtgaataaagaagggagctggaaatctaatgcgggtcaagctgatgtcaatgctgtgacatggggtgtcttcccagctaaggagataatacaaccaaccattgtagatcccgtcagcttcaatgtatggaaggacgaggcatttgaaatttggtcgaggggatgggcgtgcttgtaccctgaaggtgatgcatccaggaaattggtcgaagaggtggggggcagctacttcttggtcagtttggtggacaatgattacatcaatggtgatcttttcgctgtctttgctgatttctgacacgagcttcttatttattagttctttagctgtgtcagttctgatggttgtcaagttcatttccttatttttattttcttcttaatatcatgattcatatgattctatgttaaaatggaaattactttcctgggctatgttcgaaaagcctttgttttgtcattcttcagagtcgcatgagtaaaatctgtcgtttccatgaatcacctgaacgtggacttgaggacaagttactccctcttaatttgatggttgtatcggacccaattcccgtttcttaaaatatgagtgaactgtgaaagtagaagattgaagtctcgtgccttatattttacttctatgtatctgaaaacctcgttctgtattgacttttgagaaaaatttcaaatatattgcaattactaattatttgatagcctc

SEQ ID NO: 1549 - DNA, 2131 bp, Euonymus alatus
cggccgggggtgcatttcagcatttgtgccattctctctaattttctggttattactgatctgtctctgagatcttgagatccagatcgtagtaggtgtttggatctgagaaggaaaatgaaggtgatagataaaatcagagccggaacagagggaggagaagggaaagtggtgttctccttcgagtacttccctcccaagactgaagatggcgtggacaatctctttgacagaatggaccgaatggtggctcacaatcctaccttctgcgacatcacttggggcgccggtggctccaccgccgatctcaccctagacatcgctaacaagatgcagaacgtcatctgcgtcgagaccatgatgcacctcacctgtaccaacatgccagtcgacaagatcgaccacgctctcaccaccatcaagtccaatggcatccagaatgttctagctctccgtggagatccccctcatgggcaggacaagttcgtccagatcgaaggaggcttctcctgcgctttagatcttgtgaaacacataagatccgcatatggtgattactttggcatcactgttgctggttatccagaggcacatcctgatgccattggacctgatggggttgctactctggaatcttacacaaacgatcttacttacttaaagaaaaaggtagatgctggggctgatcttatcgtcacccaactattctatgacactgatatcttcctcaagtttgtgagtgactgtcgccaaatcggaattacttgtcccattgttcctggaattatgcccattaataactacaagggcttcttgcgtatgactggcttttgcaagactaagataccggccgaagttactgctgccttggagcctatcaaggataatgaagaagctgtcaaggcctacgggattcacctaggaactgaaatgtgcaagaagattttagctcatgggataaagaccgtgcatatttataccctgaacatggaaaaatcagcattagctatattaatgaatcttggtgtcattgaggagtccaaagtctcaaggcccttgccttggagaccccctaccaatgttttccgtgttaaagaagatgttcgcccaatattttgggctaatcgtccaaagagctacttatcaagaacccttggctgggaccagtacccacatggaagatggggtgactctggtaatccgtcgtatggtgcactgactgactaccagttcatgcggcctcgttcacgagataagaaacttcatgaagaatgggcggttcccctgaagagcattgatgatatttatgagaaatttaagcaattctgccttgggaagttgagaagtagtccttggactgagttagatgggcttcagccagagacgaagatcataaatgaacagctggggaagattaacttgaagggcttcttaactattaatagccagccagctgtcaatggtgaaagatccgattccgcaactgttggttggggaggcccaggagggtatgtttatcagaaggcatatctggagttcttctgctccaaagagaaactgaatttgcttgttgaaaagtgcaaggctttcccctctataaccttcgtggctgctaacaaagctggggtttggatatcaaacactagcaaaagtgacgtgaatgcggtaacctggggagtcttcccagcaaaggagattatccaacctactgttgtggatcctgccagtttcatggtgtggaaggatgaggcattcgagatctggtcaagaggatgggccatcgtatatccagagggtgatctgtcaagaaaattgttagaagaggtccaaagcagctactttttggtcagtctggtagataatgattacatcaacggtgatatatttgctgcatttgcagatttctgagagttctgcttctctcaagctacttctcgtctctctcaaaccccattgatgccactaaaagtgatgcttctctatatttaatcgcagttttcttcccttttcaatgtattgaatcataatcttattattttgcaataatcgcagttttctcttttcacttcatgctgcaaattacaattgaagttgtttgtgatctgctcatataaagttgccgctttgtact

SEQ ID NO: 1550 - DNA, 2039 bp, Papaver somniferum
gctttaaatgacaaagtagttttctcattcgagtttttcccaccaaaaactgatgatggagttgagaaccttttcgaacgtatggatcggatggtttctcataatccttcgttttgtgatattacatggggtgctggtggttctactgctgatctcactctcgacattgccaatcgtatgcaaaaccagatctgtgttgaaacaatgatgcatttaacatgtacaaatatgccagtggagagcattgatcaagctttgaattcaatcaagggtaatggaattcaaaatgttttggctttaagaggagatcctcctcatggtcaagataaatttgttgctgttgaaggtggatttgcttgtgctctcgatctggtgaggcatatcaaaaagaattatggtgatttttttggaatcactgttgctggttacccagaggcacatccggaagtgattggagaggatggtgtggcatctcctgaagcttaccagaaggatcttgcttatttaaaagaaaaggttgatgctggagcagaagtcattgtcactcaactgttctatgatactgataatttcttgaagtttgttaatgactgtcggcaaattggtattgcttgtcccattgtaccgggaattatgccaatcaataactataagggtttcgtgcgcatgactggcttttgcaaaactaggataccagctgagattatggctgctctagaacccattaaagacaacgaagaagcagtcaaagcctacggaatccaccttggtacagaaatgtgcaagaaaatcttagctagcggtatcaaaacattgcatctttataccctaaacatggacaaaactgcgttggctatattacagaatcttggtctaatcgaagaatccaagatctcaaggactctgccctggaaacgcccaactaatgtcttccgtgttaaagaagatgtccgaccaattttctgggctaatcgtccaaaaagctacatatcaaggactagaggatgggagcaatacccccaaggtcgatggggcgattctcgcagcccgcttatggtgcgctgactgaccatcagtttttgcgaccacgttcaaaagacaagaagcttcaggaggagtgggctgtgccattgacatctgttgaagacattaatgagaaatttttcaaaactatgcctggggaaacttaaaaccagtccttggtcagaattggatggacttcagccagagacaaagatcataggtgaacagttgggaggcattaattcaaaggggttccttaccatcaatagccaacctgcagtcaatggggtgaaatctgattcaccatctgtcgggtggggtggacccggtggatatgtttaccagaaggcctaccttgagttcttctgctccaaggacaggttgagctcactggttgaaaaatgcaaggccttcccatctctcacctacatcgctgttaacaaagctggagaaaccttgtctaatgtgtcccctgctgatgtgaacgcggtgacatggggagtctttccagcaaaggaaatcatccaaccaactgttgttgaccctactagttttgttgtgtggaaggatgaggcttttgagatctggacaaggggatgggcacgtatgtaccctgaaggggattcttcaaggactgtattggagtcggtgcaaagcaattatttcttggtcagtttggttgataatgactatatcaatggggatctgtttggtgttttcaaggatctgtgaaaactacctacataatctcttccccactgttttatttaaagagtagcatattgtgattttacgggaagtgtcgtcttggtgcaaattatctgcacaatatcatattattttgcattttagttttcgtttatattgcccttctcctgatgtgaaccacatctagagtgttggccctcagtcttgaaaatgaagctcttctcgtgttttctcttctttttacaatttgtatcaaataattaatttattatttagtaaaatggcaaagggaaacactctatattagt

SEQ ID NO: 1551 - DNA, 2413 bp, Catharanthus roseus
ttgttgattctgattcatccaacatctccttgcctattcaattctaaagaaagaaggttcgtcggatgatggcttgcaggttttgttggattgttggacccactataaatgcataaatctcaaatattaattaatgtttattataatgtattttagaattagcagtcccacttgggttggtgaagttggttggtgaggcctctgcatatatatcaatcccattctccgaaatagatctcgccacaccccaaccatcactcctcctctttcctctgcaaatcctccttgtggctgtaggcggaggcgccacccccgtcaaccactctctcaactaccaccagccgaactcaattttcccttctttgagccaaaatgaaggtgatagagaagatcaacgatgccattgccgctgacaaggtggtcttctcgttcgagttttttccaccgaagactgaggacggagtggagaatctgttcgagagaatggaccgtatggtagctcacaatccttccttctgtgatatcacttggggagctggaggatccactgcggatctgactttggagatcgctaacagaatgcagaacatggtttgtgtggaaactatgatgcatctcacttgcaccaatatgcctgtggagaagatcgaccacgctctcgatagtattaaatccaatggcatccagaacgtgctcgctcttcgaggtgatcctcctcatggtcaggataagtttgttcaggtggaaggtggatttgcctgtgctcttgacttggtgaggcatattaggaagaagtacggggattattttgggatcactgttgctggctatccagaggctcatcctgatgttatacctgacaatggagttgcaccgctcgatgcttaccagagcgaccttgcttaccttaagcgaaaggttgatgctggtgcagatctcattgttacccagctcttctatgatacagatatcttcctgaagtttgtcaatgactgtcgtcaaattggaatagattgtccaatagttcctggaattatgcccatcaacaattacaagggcttcttgcgcatgactggattctgcaaaactaagattccagcagagatcatggctgctttggagcctatcaaggataatgaagaagctgtaaggaactatggcattcacttggggacagaaatgtgcaaaaggatattggctagtggaatcaagacattacatctctatactctaaatatggagaagtctgccttagcaatattgatgaatcttggactaatagaggagtctaaggtttcaaggccattgccttggaggcgtcctacaaatgtcaatcgtagcaaagaagatgtccgcccaattttctgggccaatcgtccgaagagctacatctctaggaccttaggctgggagcaatatccacgtggccggtggggtgattcacgatctgctcagtatggagcactcagtgactaccaattcatgaggccacgtgctcgtgataagagacttcatgaggaatgggttgtcccactgaaaaatactgaagacatttatgagaaatttaggcagtattgtcttggaaaattgagaagctgtccttggagtgatctagatgggcttcagccagagacaaagatcataaatgaacatctcggtaatgttaatctgaaaggtttcctcactatcaacagccaaccagcagttaatggagcaaagtctgactccccatctgttggatggggtggcccaggcggatatgtttaccagaaggcataccttgaatttttctgctccaaagagaagttgaatgccgttgttgagaaagccaaagcttatccatctcttacctacatggcagtaaacaaaggaggagattggatttcaaacataacctcaactgatgtgaatgcagttacttggggagtgttcccagctaaggagattatccaaccaacagtagttgatcctgccagctttgcagtatggaaggatgaagcttttgaaatttggtcaagaggatgggcacaattgtacccagaagctgatccatccagaaaattacttgaagaggtgcaaaacagttactatttggtgagcttggtcgataatgactatgtgagtggtgatatctttgctgcttttaaagacatttgaaagccagtaagatgccgttaagtcaagtcccacaatcaatacttcaataagtcgtaggcctttcttctttaggcttgggtaaagttgttgttattcatcattgtatttcctaatatgtagactaggcttttttaattatgttataattacaataacgatttaattgattgggattttggaattcttccctgataattagagttgtgtatttgatttgaagctgatatatgtatttattcgtattagttattgtgtt

SEQ ID NO: 1552 - DNA, 2101 bp, Gossypium hirsutum
catttaatagttgtatttttgcccccatgattttgggacaatgtaacttctgttgccggaactgagagtcccagatccgattaaaaaaaatgaaggtgatagataagatccagtctttctcacaggaccaagggaaagtggttttttcctttgagttcttccctccaaagactgaggatggagtggacaacctgtttgagagaatggatcgaatggtggctcataatccatctttttgtgacatcacatggggtgctggtggttccactgcggatctcactttggacattgctaacaagatgcaaaacatgatatgtgtggaaacaatgatgcatctcacttgcaccaacatgcctgttgagaaaattgaccatgctcttgagaccattaagtctaatggcattcaaaatgttcttgcccttagaggtgaccctcctcatggtcaggacaagtttgttcaagtcgaaggcggcttctcttgtgccctcgatttggtgaaacatattagagctaaatatggtgacttctttggtataacagttgctggttatccagaggctcatcctgatgctattggaagtaatggtgtagcaacaccggaagcttatcagagtgatcttgcttacttgaagaagaaggttgatgcgggagctgatcttattgttactcaactgttttatgatactgatatctttctcaaattcgtcaatgattgtcgccaaattggaattacatgtcccattgtgcctggtattatgcccattaataactacaagggtttcgtgcgaatgactggcttttgcaaaactaagataccggatgaggtcactgctgccttagagcctatcaaggacaatgatgaagctgtcaaatcctatggaatccacctcggaacagaaatgtgccgcaagattttagcccatgggattaagacgttgcacctttatacattaaacatggagaaatctgcattagctatactaatgaaccttggactgattgaagagtccaaaatttctaggtctttaccttggagacgccctgcaaatgtcttccgtgttaaggaagatgttcgcccaatattttgggctaaccgtccaaagagttacttatctaggactattggttgggatcagtacccacaggggcgatggggtgattctcgaaatccatcgtatggtgcactatccgactatcagttcatgaggccccgtgcacgtgacaagaaacttcaggaagaatgggctactcctttgaaaagcattgatgacattcaagagaaatttaaaaaccattgtctgggtaagttgagaagtagcccttggtccgagttggatggtcttcagccagagacaaagatcatacatgagcaactaggaaagatcaatttgaagggcttccttaccatcaatagccaaccagccgtcaatggggaacgctctgattctccatctgtcggttggggtggcccaggagggtacgtttaccagaaggcttacctcgagtttttctgctcactggataaattagatgtactagtgaaaaagtgcaattccttttcatcattgacctatgttgctgtcaacaaaaaggggaatttgttatcaaacattggcctcacagatgtgaatgcagtaacttggggagtcttccctgctaaagaaataatccaaccaactgtggtggatcctgccagttttgtggtgtggaaggacgaagcatttgaaatctggtctcgatcatggtccaccttgtacccagatggtgatccttctaagaatttgctcgaagagattcagagcagctactatttggtgagcttggtagataacaattacatggatggtaatatttttggtgtttttgaagatctttgaagatgagatttgagatattattatgctgcagtgcagtgttccacttatgcttatgatttaatgtttatggtgtctttctcctttattattgtctcttcgtggttgaattttcaattgtaactttatttgtaataatgactatataaagagaatttatatcttcagatagagatcgtaaattttgctgtacattaaatgtttatgtttattttcgacattttaga

SEQ ID NO: 1553 - DNA, 2424 bp, Populus trichocarpa
tggttttatagaaaaacacatgtactccatcccatttgtttactggaatatattttatcttggaaagtacgtagatttcatagatagatcgagcgtattaatttagcatgactgttttataaaacaatgttgtattcaacctctctcaccaggaatctccaacaagagtgacacccgtttcttattaagtattattattattatttgctatcgcaaaccggacccctcctctttctttcgctgctatcggtgtgtttccacctttcagttttactcattttatacccctctccctccccgcatttgtcggagtgagaccgagagagaacagacagagaaacagaaaatgaaggtgattgataagattagggaagcagcaggaggaggtggagatgcaaatggcaatggaggagataatagcagcagcaataaggttgttttctccttcgagttctttcctccaaagacagaagatggagtggacaacctgtttgagagaatggacagaatggtggctcacaatccttccttttgtgacatcacttggggagctggtggttccaccgcagatctcaccttagacatcgccaacaagatgcagaacattatttgtgtcgagactatgatgcatctcacctgcaccaacatgcctgttgagaagatcgatcacgctctcgaaacaatcaaatccaatggaatccagaatgttcttgctcttcgtggtgatcctcctcatggccaggataaattcgtccagatccaaggcggcttcgcttgcgctctcgacctcgtcaaacatatcagatccaaatatggtgattacttcggcattactgttgctggttatccagaggcacatcctgatgccattggaagtgatggatttgctacgcctgaggattaccagaaagatcttgcttatttgaagcagaaggtggatgctggagctgatctaattgtcacacaacttttctatgatactgatatcttcctgaaatttgtaaatgactgccgccaaattggaatcacttgtcccatcgttcctggtattatgcctattaataactacaagggcttcttacgtatgactggcttttgcaaaaccaagataccagcagaggtcactgctgcattggagcctatcaaggacaacgaggaagctgtcagagcctatggaattcaccttggaactgaaatgtgcaagaagattttagctcatggaatcaagacattgcatctatataccctgaacatggagaaatctgctttagccatattaatgaatcttggtttgattgaagagtccaagattacaagggcattgccgtggcgcccccctacaaatgttttccgtgcaaaagaagatgtccgtccaatattctgggctaatcgcccaaagagctatctatcaaggacaataggctgggaccagtaccctcatggccgatggggtgattctcataacccatcctatggtgctttatctgattaccagttcatgcgaccccgagcacgtggcaagaaactctttgaagagtgggctagccccttgaaaagcgtcgaggatatatatgagaaattcaaggtatactgccttgggaagttgaaaagtagtccttggtcagaactggaaggccttcaacctgagacaaaaatcattaatgaacagctgggtaggatcaacttgaagggattcctgactatcaatagtcaaccagcagtcaacgctgaaaaatctgattctccatctgttggttggggagggccaggagggtatgtatatcagaaggcttatctagagtttttctgctccaaggaaaagttgaatgctcttgttgagaggtgcaaggctttccctttagtaacttacatggcagtgaacagaggagggagttggatatctaatgttgctctgactgacgtgaatgctgtaacctggggagtcttcccagcaaaagagatcatccaaccaaccgttgtggatcctaccagcttcagtgtgtggaaggacgaggcatttgaaatctggtcaagaggatgggcctccttgtacccagagggtgacccatccagaacactgcttgaagaggtgcagaacagctactttttggtcagcttggtagataacgattacatccatggggatatttttgctgtcttcgcagaattatgagactaggtgctctttgcagctcctccatttgcttagagtccatcgaagtcgcacaaacaggtgctttatcccaagttgaattctagctttattcttcttattggcacacgatgtttttgaaattatttccttattgacatgtaataataattgattgggatttttctactctccattatggtgcaaattgtatctggagtggcaactaatttactaaagcctaaagcaaatatgattactttatttaaaca

SEQ ID NO: 1554 - DNA, 2110 bp, Tabernaemontana elegans
tgcactgcaaatctttgtggctgtaggcggaggcgccaccaccctcacccaaccccaccaccaccactaccaccctaccaacgcggttgctcaattttcgttttcattgagaagaaatgaaggtgatagagaagatcaatgatgccattgccactgacaaggtggttttctcgttcgagttctttccaccgaagacggaggacggagtggagaatttgttcgagagaatggaccgtatggtagctcacaatcctagcttctgtgatatcacctggggagctggaggatccactgctgatctgactctggagatcgccaaccgaatgcagaacatggtgtgcgtggagaccatgatgcatctcacctgtactaacatgcctgtggagaagatcgaccacgctctggataccattaaatccaatggtctccagaacgtccttgccctccgcggtgaccctcctcatgggcaggacaagtttgttcaggttgaaggtggctttgcctgtgctctcgacttggtgaggcatattaggaaaaagtacggggattattttgggattacagttgctggctatccagaggctcatcccgatgttatacctaacaatggagtagcttcgcttgaggcttaccaaagcgaccttgcttaccttaagcgaaaggttgatgctggtgctgatctcattgttacccagctcttctacgatacagatatcttccttaagtttgtccatgactgtcgccaaatgggaataaattgtccaatagttcctggcatcatgcccatcaacaattacaagggcttcctgcgcatgtctggattctgtaaaactaagattccagctgagattatggctgccttggagcctattaaggataatgaagaagctgttaggaactttggcattcacctggggacagaaatgtgcaagaagatattggccagtggaatcaagacgctacatctctatacactaaacatggagaagtctgccttggcgatattgatgaatcttggactaatagaggagtctaaggttttaaggtcattgccttggaggcctcccacaaatgttaatcgtaccaaagaagatgtccgccctattttctgggctaatcgtccaaaaagctacatctcaaggaccataggctgggagcaatatccacatggccgatggggtgattcccgatctgctgaatatggagcactgagcgactatcaattcatgagaccacgtgcacgtggtaagaaacttcatgaggaatgggttgtcccactgaaaactgtggaagacatttatgagaaatttaggcagtattgtcttggaaaattgagaagctgtccatggtctgaactggaggggcttcaaccagagacaaagatcataaatgaacagcttggcaatgttaatttgaaaggtttcctcactatcaacagccaaccagcagttaatggagcgaagtctgactccccatctgttggttggggtggcccaggtggatatgtttaccagaaggcctaccttgagtttttctgctcggaagagaggttgaatgctatcgttgagaaagccaaagcttatccatctcttacctacatggctgtgaacaaagagggagattgggtttcaaacataagctcaactgatgtgaatgcagtgacttggggagtcttcccagcaaaggagattatccaaccaactgttgttgatcctacgagcttcgcagtatggaaggatgaagcttttgaaatttggtcaagaggatgggctcaattatacccagaagctgatccatccagaaaaatacttgaagaggtgcaaaaaagtttctatttggtaagcttggttgataatgactacatcggtggtgatctgttcgctgtctttaaagatatctgaaaccaataatattattcagaggtccttttgccaagtcccacattccacgttaatgtggcctttgttccttggctggtataattgttgtcattcatcgttattcgtaatgcttagactaggtttatttttatgttataatcacaataacgattcacttcattgggattttggtattcttcccttcgtaatgctaattgtgtttgatttcg

SEQ ID NO: 1555 - DNA, 2187 bp, Plantago ovata
actaatctcaccaaccactgccttgttgttcatcaccgtcacctacatatatcaacttgcgagcttttcatctcaaagtacactacacacagctgagactgagatcagatcagatctgatccatttcataatcaatcaaatcaaagctccaagcaggaagaagaagaaacctaattacgtacattgtgcatttcactcggaaaggataagatgaaggtgatagagaagatcttggaggcgaccgctgccaatgacgccaacaaggttgtgttctcctttgagttctttccacctaagaccgatgatggtgtggaaaacctgtttgagcgtatggagcgcatggtggcacacaaccctactttctgcgacataacgtggggtgctggtggaaccactgccgatctgacactggagattgccaatcgcatgcagaacatggtatgcgtcgagacaatgatgcatctcacctgcactaatatgcctgtcgacaagattgaccatgcccttgccactattaagtctaatggaatccagaacgtcctggcactccgtggagatcctcctcacggtcaggacaaatttgtccaggtggagggaggctttgcctgtgcacttgacctcgtcaatcatatgcgctccaaatatggcgattactttgggatcacagtcgctggttatccagaggggcatcctgaagttattttggaagatgggttggcttctgcggaggcataccagaacgagcttgcttatctcaagaaaaaggttgatgctggtggcgaagtaattgtaactcaactcttctatgatacagacatctttctcaagttcgtgaatgactgtcgtcaaattggaataacctgtcctatagtgccgggtattatgcccattaacaattacaagggctttctgcgaatgaccggtttctgcaaaactaagataccagctgagattatggctgccttggaacctatcaaggacaatgaagaagccgtcagggcctatggaattcacctaggaacagagatgtgcaagaagattatggctagtgggatcagaacgatacacctttatacattgaatatggagaaatctgcactggctatattagcgaaccttggtctgattgacgattcgaaaatttcaaggtccttgccatggaggcgcccagcaaatgttttccgggtaaaagaggatgttcgtccaatattctgggccaatcgtcccaaaagctacatttcacggactataggctgggaccaatacccacatggtcgatggggagactctagaaatgcttcatatggagcactcggtgatcatcagttcatgcgcccgcgttcacgcaacaagaagctgcaagaagaatgggttttacctttgacaaatgttgaagatatttatgagaaatttatgaacttctgccttgggaaactgaaaactagtccgtggtctgaacttgatgggcttcagccagagacaaaaatcattaatgagctgcttgttaatattaacatgaaaggctttctcaccatcaacagccaaccagctgtcaatggagccaagtctgactccccatctgttggatggggaggaccaggagggtacgtataccagaaggcatacttggaatttttctgctctccccagtcgctgaacacactggttgagaaatgcaagactttctcatatcttacctacatggctgtgaacaaagaaggaaacttgatatctaatgctaaaaagactgatataaatgctgtaacatggggagttttccctgcaaaggaggtaattcaacccactgttgttgatcctgccagttttgtagtatggaaggatgaagcatttgaaatttggtcaagaggttgggctaagctctacccagatgctgatccatccgcaaaattacttgaagaggtgcaaagcagttattacttggtcagcttggtcgataatgattatattcatggagatttgttcgctgttttcagagatatttgatcagcttggtcaaaatttgcattttgcgggtgctgaaactaatctaatattgttttcatgtggtattcataatagtactgcaattcccgatttatgatgtaaactgatgataaatttttatcgaattttgagcttgcttcccttatatttattgttatgcaatcatgcttctagctcctcaag

SEQ ID NO: 1556 - DNA, 2142 bp, Plantago ovata
actaatctcaccaaccactgccttgttgttcatcaccgtcacctacatatatcaacttgcgagcttttcatctcaaagtacactacacacagctgagactgagatcagatcagatctgatccatttcataatcaatcaaatcaaagctccaagcaggaagaagaagaaacctaattacgtacattgtgcatttcactcggaaaggataagatgaaggtgatagagaagatcttggaggcgaccgctgccaatgacgccaacaaggttgtgttctcctttgagttctttccacctaagaccgatgatggtgtggaaaacctgtttgagcgtatggagcgcatggtggcacacaaccctactttctgcgacataacgtggggtgctggtggaaccactgccgatctgacactggagattgccaatcgcatgcagaacatggtatgcgtcgagacaatgatgcatctcacctgcactaatatgcctgtcgacaagattgaccatgcccttgccactattaagtctaatggaatccagaacgtcctggcactccgtggagatcctcctcacggtcaggacaaatttgtccaggtggagggaggctttgcctgtgcacttgacctcgtcaatcatatgcgctccaaatatggcgattactttgggatcacagtcgctggttatccagaggggcatcctgaagttattttggaagatgggttggcttctgcggaggcataccagaacgagcttgcttatctcaagaaaaaggttgatgctggtggcgaagtaattgtaactcaactcttctatgatacagacatctttctcaagttcgtgaatgactgtcgtcaaattggaataacctgtcctatagtgccgggtattatgcccattaacaattacaagggctttctgcgaatgaccggtttctgcaaaactaagataccagctgagattatggctgccttggaacctatcaaggacaatgaagaagccgtcagggcctatggaattcacctaggaacagagatgtgcaagaagattatggctagtgggatcagaacgatacacctttatacattgaatatggagaaatctgcactggctatattagcgaaccttggtctgattgacgattcgaaaatttcaaggtccttgccatggaggcgcccagcaaatgttttccgggtaaaagaggatgttcgtccaatattctgggccaatcgtcccaaaagctacatttcacggactataggctgggaccaatacccacatggtcgatggggagactctagaaatgcttcatatggagcactcggtgatcatcagttcatgcgcccgcgttcacgcaacaagaagctgcaagaagaatgggttttacctttgacaaatgttgaagatatttatgagaaatttatgaacttctgccttgggaaactgaaaactagtccgtggtctgaacttgatgggcttcagccagagacaaaaatcattaatgagctgcttgttaatattaacatgaaaggctttctcaccatcaacagccaaccagctgtcaatggagccaagtctgactccccatctgttggatggggaggaccaggagggtacgtataccagaaggcatacttggaatttttctgctctccccagtcgctgaacacactggttgagaaatgcaagactttctcatatcttacctacatggctgtgaacaaagaaggaaacttgatatctaatgctaaaaagactgatataaatgctgtaacatggggagttttccctgcaaaggaggtaattcaacccactgttgttgatcctgccagttttgtagtatggaaggatgaagcatttgaaatttggtcaagaggttgggctaagctctacccagatgctgatccatccgcaaaattacttgaagaggtgcaaagcagttattacttggtcagcttggtcgataatgattatattcatggagatttgttcgctgttttcagagatatttgatcagcttggtcaaaatttgcattttgcgggtgctgaaactaatctaatattgttttcatgtggtattcataatagtactgcaattcccgatttatgatgtaaactgatgataaatttttatcgaattttgagcttgct

SEQ ID NO: 1557 - DNA, 1810 bp, Solanum phureja
ctacattgtttttttgaaaaatgaaggttattgagaaaattcaagaatctgtgaaagatgacagagtagttttctcttttgagttttttccaccaaaaactgaagatggggttgataatttgtttgaaagaatggaaagaatggtgtcacataacccatctttttgtgatattacatggggtgctggtggttcaacagcagatctgactcttgaaatttcaaataggatgcagaatatggtgtgtgttgagacaatgatgcatttgacttgtacaaatatgcctgttgagaaaattgatcatgctcttgaaactattaagtctaatgggattcaaaatgttctcgctcttcgtggagatcctcctcatggacaagataagtttgttcaagttgaaggtggttttgcttgtgctttagatctggtaaagcacatgcgggccaagtatggggattactttgggatcactgttgcgggttaccctgaggcgcatcctgatgttatacctgcaactggactagctacacttgagacatacgaaaacgaacttgcctatctcaaacaaaaggttgatgctggagctgatctcattgtaactcaactcttctatgatactgataatttcctcaagtttgtcagtgattgtcgtcaaattgggataacttgtcccattgttccaggaatcatgcccatcaacaattataagggcttcttgcgcatgactggattttgcaaaactaggatcccggcagagattacagctgccttggaacctattaaggataacgaagaggctgtcaaagcatatggaattcaccttggaactgaaatgtgcaagaaaattatggccagtggcattaagacattgcatctttatacattaaacatggagaaatcagcattggccattttgatgaatcttggattgattgaagagtccaaaatttcaaggccattaccttggagacgtcctacaaatgttttccgtatcaaagaagatgtccgtcctatattctgggccaaccgtccgaagagctacatctcaagaaccattggttgggatgagtttccacatggccgatggggcaatgctaaaaatccgtcatatggagcacttagtgattatcagttcatgcgggcacgctcacgtgataagaaacttcaagaggaatgggctattgctctcaatagtgtggaagacatctatgagagatttatgaactactgtctcgggaagctgagaagttgtccttggtctgagttagatgggcttcaggcagagacaaagatcatcgatgatcacttgggtaatataaactcgaaaggtttcctgactattaacagccaaccatcagttaatggtgcaaagtccgacgctcctttagttggatggggtggtcctggtggatttgtttatcaaaaggcatacttagagttcttttgctcgcgtgagaagttaaatgctgttatcgaaaaatgcatggctttccccttccttacctacatggctgtgaacaagaaaggaaactggatgtccaacgtcaaccaagtcgacgtcaatgcagtgacatggggcgtcttcccagctaaggagattgtacaaccaaccgtcgttgatcctgccagcttcatggtatggaaagacgaggcatttgaaatctggtcacgaggttgggctcaattataccccgagaatgatccatctagaacattactcgaacaggttcaaaacagttacttcttggtcagccttgtcgataacgattacatcaatggagatttgtttgccatcttcaaggatatgatctggaa

SEQ ID NO: 1558 - DNA, 2124 bp, Tripterygium wilfordii
agagctgtgattgtgctgtgcgctcagtggcctattcctattctctctcattttctggtttctctctgggatcttgagatccagcaagctcgtagtaggttttgggatctgagaaggaaaatgaaggtgatagataaaatcagagccggaacagagggagtaggagaagggaacgtggtgttctccttcgagtacttccctcccaagactgaggatggcgtcgacaatctgttcgagagaatggaccgtatggttgctcacaatcctaccttctgtgacatcacctggggcgccggtggctccaccgcagatctcaccctcgacatcgctaacaagatgcagaacgtcatctgcgtcgagactatgatgcatctcacctgtaccaatatgcctgttgacaagatcgaccacgctctaaccactattaagtctaatggaatccagaatgttctagctctccgtggagatccacctcatggacaggacaagttcgtccagatcgaaggaggcttctcctgcgctctagatcttgtgaaacacatcagatccgaatatggtgattactttggcatcactgttgctggttatccagaggcacatcctgatgccatcggacctgatggggttgctactccggaatcttacacaaacgatcttacttatttaaagaaaaaggtagatgctggagctgatcttatcgtcacccaactattctatgacactgatatcttcctcaagtttgtgaatgactgtcgccaaatcggaattacttgtcccattgttcctggaattatgcccattaataactacaagggcttcttgcgtatgactggcttttgcaagactaagataccagccgaggtcactgccgccttggagcctatcaaagataatgaagaagctgtcaaggcgtacgggattcacctaggaactgaaatgtgcaagaagattttagctcatgggataaagaccgtgcatctttacaccctgaacatggaaaaatcagcattagctatattaatgaatcttggtgtcattgaggagtccaaagtgtcaaggagcttgccttggagaccccccaccaatattttccgtgttaaagaagatgttcgtccaatattttgggcaaatcgtccaaagagctacttatcaagaaccctcggctgggaccagtacccacatggaagatggggtgactctggtaacccgtcatatggtgcactgtctgactatcagttcatgcgtcctcgttcacgagataagaaacttcatgaagaatgggctgttcccctgaagaatattgatgatatttacgagaaatttaagcaattctgccttgggaagttgagaagtagtccttggactgagttagatgggcttcagccagagacgaaaatcataaatgaacatctggggaagattaacttgaagggcttcctaactattaatagccagccagcggtcaatggagaaagatctgattccccaactgttggttggggaggcccgggagggtatgtttatcagaaggcatatctggagttcttctgctccaaagagaaactgaatttgcttgttgaaaagtgcaaggctttcccctctatatccttcgtggctactaacaaagttggggtttggatatcaaacgttagtaaaaccgatgtgaatgcggtaacctggggagtcttcccggcaaaggagattatccaacctactgttgtggatcctgctagtttcatggtgtggaaggatgaggcatttgagatctggtcaagaggatgggctaacatgtatccagagggtgatctgtcaagaaaattgatagaagaggtgcaaagcagctactttttggtcagtctggtggataatgattacatccatggtgatatatttgctgtatttgcagatttctgagagtttttcttctctcaactcttcctttctcaaatcccattgtaagccgctcaaagtgatgcttctccatatttaattgctgttgctgtttcattcccttctcaatgtactgaattataatcttttgtaataacaactcaattgggatttttatacaccctagtcttcatggtgcaaaattgcaaattacatttgaagttgcatttgatc

SEQ ID NO: 1559 - DNA, 2164 bp, Gossypium hirsutum
ttgatccccccttttgtgagttttcctttctctttgatattttccgggaaaatttcttgatcacatttatgatgtattttcgctccatgattttgggacaatgcaacttctgttgctggtactgagagtcccagatccaattaaaaaaaatgaaggtgatagataagatccagtctttgtcacaggaccaagggaaagtggttttttcctttgagttcttccctccaaagactgaggatggagtggacaacctgtttgagagaatggatcgaatggtggctcataatccatctttttgtgacatcacatggggtgctggtggttccactgcggatctcactttggacattgctaacaagatgcaaaacatgatatgtgtggaaacaatgatgcatctcacttgcaccaacatgcctgttgagaaaattgaccatgctcttgagaccattaagtctaatggcattcaaaatgttcttgcccttagaggtgaccctcctcatggtcaggacaagtttgttcaagtcgaaggcggcttctcttgtgccctcgatttggtgaaacatattagagctaaatatggtgacttctttggtataacagttgctggttatccagaggctcatcctgatgctattggaagtaatggtgtagcaacaccggaagcttatcagagtgatcttgcttacttgaagaagaaggttgatgcgggagctgatcttattgttactcaactgttttatgatactgatatctttctcaaattcgtcaatgattgtcgccaaattggaattacatgtcccattgtgcctggtattatgcccattaataactacaagggtttcgtgcgaatgactggcttttgcaaaactaagataccggatgaggtcactgctgccttagagcctatcaaggacaatgatgaagctgtcaaatcctatggaatccacctcggaacagaaatgtgccgcaagattttagcccatgggattaagacgttgcacctttatacattaaacatggagaaatctgcattagctatactaatgaaccttggactgattgaagagtccaaaatttctaggtctttaccttggagacgccctgcaaatgtcttccgtgttaaggaagatgttcgcccaatattttgggctaaccgtccaaagagttacttatctaggactattggttgggatcagtacccacaggggcgatggggtgattctcgaaatccatcgtatggtgcactatccgactatcagttcatgaggccccgtgcacgtgacaagaaacttcaggaagaatgggctactcctttgaaaagcattgatgacattcaagagaaatttaaaaaccattgtctgggtaagttgagaagtagcccttggtccgagttggatggtcttcagccagagacaaagatcatacatgaacagctaggaaagatcaatttgaagggcttccttaccatcaatagccaaccagccgtcaatggggaacgctctgattctccatctgtcggttggggtggcccaggagggtacgtttaccagaaggcttacctcgagtttttctgctcactggataaattagatgcactagtgaaaaattgcaattccttttcatcattgacctatgttgctgtcaacaaaaaggggaatttgttatcaaacattggcctcacagatgtgaatgcagtaacttggggagccttccctgctaaagaaataatccaaccaactgtggtggatcctgccagttttgtggtgtggaaggacgaagcatttgaaatctggtctcgatcatggtccaccttgtacccagatggtgatccttctaagaatttgctcgaagagattcagagcagctactatttggtgagcttggtagataacaattacatggatggtaatatttttggtgtttttgaagatctttgaagatgagatttgagatattattatgctgcagtgcagtgttccacttatgcttatgatttaatgtttatggtgtctttctcctttattattgtctcttcgtggttgaattttcaattgtaactttatttgtaataatgactatataaagagaatttatatcttcagatagagatcgtaaattttgctgtacattaaatgtttatgtttattttcgacattttagattt

SEQ ID NO: 1560 - DNA, 2341 bp, Theobroma cacao
aaatatctctgggaaattgtaatttacctgatcgatattgtagtcgtagacctttgagggaagcaagggggcaaagtgggccttgaattcgatattgagcaacccaaaaacttgggtctgccgattactatcttagattcaagcctagtccaagagtggttggtggcagtgtactggctattgggttgttgagtggcaactttgtcatttcaatcgcaccaacccccacccgctctctcatatactctttctgcgttcccaacccattctcgcccctccctctatcttttcatcgataacccatttctgttggtggcactgacagtcccagatctaattaaaaatgaaggtgatagagaagattcggactttgcaagaggagcaagggaaagttgtgttttcgtttgagttcttccccccaaagactgaggatggagttgacaacctgtttgagaggatggatcgcatggttgctcataatccatcattctgtgacattacatggggtgcaggtgggtccaccgcagatctcaccctggacattgctaacaagatgcagaatatcatctgtgtggagaccatgatgcacctcacttgcaccaacatgcctgtggagaagatcgaccatgcccttcagaccattaagtccaatggcattcagaatgttcttgccctccgaggtgaccctcctcatggccaggacaagtttgtccaggtcgaaggtggctttgcctgtgcccttgatctggtgaaacatattagaagcaagtatggtgactactttggcatcacggttgctggttatccagaggcacatcctgatgccataggaagtgacggtgtagctacacctgaagcttatcagaatgatcttgaatacttgaagagaaaggttgatgcgggagctgatctgattgtcactcaattgttttatgatactgatatctttctcaaatttgtcaatgactgtcggcaaattggaattacatgtcctatcgtgccgggtattatgcccattaataattacaagggtttcttgcgtatgactggcttttgcaaaaccaagatcccagctgacattactaatgccttagagcctatcaaggacaatgacgaagccgtcaaatcctatgggattcatcttggaacagaaatgtgccgcaagattttagctcatggaattaagacattgcacctttatacgttaaacatggagaaatctgcactagctatactaatgaatcttggattgatagaagagtccaaaatttccaggtttttaccttggagacgccctgcaaatgtttttcgtgttaaagaagatgttcgtccaatattttgggctaaccgtccaaagagttacatatccaggactattggttgggaccagtacccacatgggcgatggggtgattctcaaaacccatcatatggtgcgctaactgactatcagttcatgaggccccgtgctcgtggcaagaaacttcatgaagaatgggctaccccattgaaaagcattgatgatattcaagagaaattcaagagttattgtttgggcaagttgaaaagtagtccttggtcagaattggatgggcttcagccagaaacaaagatcatacatgaacagctgggaaagatcaatttgaagggtttccttaccatcaatagtcaaccagctgtcaatggggaacgatctgattccacatctgttggttggggtggccctggagggtatgtttaccagaaggcttatcttgagtttttctgctcaaaggaaaaattagatgcacttattgccaagtgcaaggccttgtcatttatcacctacttggccgtcaacaaaaatggggatttgatatcaaacataggcgtggcagatgttaatgcggtaacgtggggagcgttcccagctaaagaaacaatccagccaactgtggtggatcctgccagcttcatggtgtggaaggatgaagcatttgaaatttggtcaagaacatgggcctcctggtactccgacaccgaccctgagggtgttcaatccaaaaaactgcttgaagaggtgcagagcaagtactatttggtcagcttggtagacaacgattacatcagcggtaacatttttgctgtttttgaagatatttaagatgggatgctgcctgcttctattatgcgctcaactgattaaatctctctctcataagccctatttaaggctgtctattccccatatattatttgcagttgttttcctttgccttgtggtgtattgaattataatcttatttgtcataatgactttattaaaaaaaaaaattgcaataataactcaattggaattttg

SEQ ID NO: 1561 - DNA, 2137 bp, Mimulus guttatus
tatcagtgctatatagcaacatttacagatccgatctaactttttaggttttgaggattaattcagtgaagatgaaggtgatagagaagatccaggaggcggcgcgtgcgaatgacgatcgggtggtgttctcgttcgagttcttcccgccgaagacggaggacggcgtggacaacctgttcgagaggatggagcggatggtggtgcacaaccctacattctgcgacatcacgtggggcgccggcggatccacggcggatctgactctggagatcgccaaccgcatgcagaacatggtgtgcgtcgagaccatgatgcacctcacctgcaccaacatgcccgtcgagaagatcgaccacgccttggcctccatcaagtctaacggcatccagaatgttctcgctctgcgtggcgacccgcctcacggccaggacaagttcgtccaagtcgagggagggctcgcttgcgcactcgacctggtcaagcatatccgttctgaatatggtgactactttgggattactgttgctggttatccagagggacaccctgatgttattcaggagggaggggcatcggcagaggcatatcaaagtgatcttgcttatctcaagaaaaaggttgatgctggagctgatgtgattgtaactcaactcttctatgatactgacattttcctcaaatttgtcgatgactgtcgtcaaattggaataacctgtcccattgtgcctggtattatgcccattaataattacaagggcttccttcgcatgactggtttctgcaaaactaagattccagcagagattatggctgccttggaacctatcaaggataatgaagaagctgtcagggcttatggaattcaccaaggaacagaaatgtgcaagaaaattattgccagtgggatcaaaactgtacatctctacacattaaacatggataaatctgcattggcaatattgatgaaccttgggctgattgaggaatccaaaatttcaagatctttgccatggagacgtccagcaaattatttccgtgtaaaagaagatgttcgtcccatattctgggctaatcgtcccaaaagctatatctcacgtactattggttgggaccaattcccacatggtagatggggagattctcgaaatgcatcatatggagctctcactgattaccagttcatgaagcctcgttcgcgtgataagaaactcaacgaagaatgggccgttcctttgaaaaatgttgaagatatttatgagaaattcgtgaagttctgcctcgggaaactcaaaagcagtccatggtctgacctagacgggcttcagccagagactaaagtgattaacgaacagctgggtagcattaacttgaaaggctttctcactatcaacagccaaccagctgttaatggagcccgctctgactccccgtctgttggatggggtgggccaggtggatatgtctaccagaaggcatacttagaatttttctgctccaaggatagtttgaatgctctagtcaataactgcaaactcttcccatctcttacctacatggctgtgaacaaagaaggaaattggatatctaacgcaaacaaaaccgatgtgaatgctgtcacttggggagttttccctgcaaaggaaatcgtccagcctactgttgtggaccccgcaagtttcatgatatggaaagacgaagcctttgctatatggtcaaggggatgggctaaacgctacccagaggctgacccttccaagaaattactcgaggaggtggagagcagctattacttggtcagcttggtcgataatgactacgttggtggagatctgtttgctgtttttaaaaacatttgaaatggtttaaaatcacgtctttttctttttcaccccttctttatttatgtattattgttctgctgtattcatcagagtcattcattatacgtacctccctttcgagttataatttactaccccgtgtagctctatgttatttacattacatgggatttttgatgtaaaactaaaccctacatttttcgtatttgtttttgaattttacacgcataggctaatgtgaagccttggttgtgtgattcaagtgatgaaatttcaataatagtttcaagtgt

SEQ ID NO: 1562 - DNA, 2254 bp, Amsonia hubrichtii
cgcgacatatatcaatcccttgctccgaaacagatctcacctcattgtagctcctctgcagtgcaaatctttgtggctgtagacggaggcgccaccaacgtcacacacttcaattaccaactccttgctaccacagccgccgctcaattttcatttaattgagaagaaatgaaggtgatagagaagatcaatgatgccattgccactgataaggtggtgttttcattcgagttctttccgccgaagacggaggacggagtggagaatttgttcgagagaatggaccgtatggtagctcacaatcctactttctgtgatatcacttggggagcaggaggatccactgcggatctgactctggagatcgccaaccgaatgcagaacatggtgtgcgtggagagcatgatgcatcttacctgcactaacatgcctgtcgagaagatcgaccacgctctcgatactattaaatccaatggactccagaacgtcctcgccctccgcggtgaccctcctcacggacaggacaagtttgttcaggtggaaggtggcttcgcctgtgctctcgacttggtgaggcatattaggaagaagtacggggattatttcgggatcaccgttgctggctatccagaggctcatcccgatgttatacctaacaatggagtggcttcgcttgatgcttaccaaagcgaccttgcttaccttaagcgaaaggttgatgctggtgccgatctcattattacccagctcttctatgatacagatatcttcctcaagtttgtcaatgactgtcgccagattggaataaattgtccaatagttcctggcatcatgcccatcaacaattacaagggcttcctgcgtatgactggattctgcaaaactaaggttccagctgagattatggctgccttggagcctatcaaggacaatgaagaagctgttaggaactatggaattcacctggggacagaaacgtgcaagaagatattggctagtggaatcaaaacactacatctctatactctaaacatggagaagtctgccttggcaatattgatgaatcttggactcatagaggagtctaaggtttcaaggccattgccttggaggcgtcccacgaatgttcaccgtaccaaagaagatgtccgccctattttctgggccaatcgtccaaagagctacatcacaaggaccataggctgggagcaatatccacatggccgatggggcgattcccgatttgctcaatacggagcactcagtgaccatcaattcatgaggccacgtgcacgcgataagaagcttcgtgaggaatgggctgtcccactgaaaactgttgaagacatttacgagaaatttaagcagtattgtcttggaaaattgagaagctgtccgtggtctgaattagacgggcttcaagcagagacaaagatcataaatgaacaacttggtaatgttaatttgaaaggtatcctcacaatcaacagccaaccagcagttaatggagcaaagtctgactccccatctgttggatggggtggtccaggtggatatgtttaccaaaaggcctaccttgagtttttctgctccaaagagaagttgaatgctatcgttgagaaagctaaagcttatccatctcttacctacatctctgtgaacaaagagggagattggatttcaaacataagctcaactgatgtgaatgcagtgacttggggagtcttcccagcaaaagagattatccaacccactgttgttgatcctaccagctttgcagtatggaaggatgaagcttttgaagtttggtcaagaggatgggctcaattatacccagaagttgatccatccagaaaattactcgaagaggtgcaaagcagttactatttggtcagcttggttgataatgactacatcaacggtgatctgtttgccatctttaaagatatttgaaaccagagatactagtcaaatgtccctttgccaagtcctcgcattccactttaatatatggcctttgttccttggctttgatataattgttgttatttatcatcattcctaatgtttagactaggcttatatttatgttataataacaattcaattcattgggattttggcattcttcctttggtaatgctaattgtattcatcttcgttattgtgtgtaacaagtacaacgtttagcgttgacaatagtataatccacatatactttattaggttacaaatatgaataaaagtgcaagtg

SEQ ID NO: 1563 - DNA, 2097 bp, Vinca minor
ctacttcctttttccttcttcctaaatttcacggttggcgctgccgccaccaccactgccgccgacaattttccatttctccttcaacaatgaaggtaattgagaagatcaatgacgccattgtcaccgacaaggtggtattctcgttcgaattctttccaccaaagacggaagacggagtcgagaatttgttcgagagaatggatcgtatggtagctcacaatccttctttttgcgatattacttggggagctggaggatctactgcggatctgactctcgagatcgctaatcgaatgcagaatatgatttgtgttgagactatgatgcatctcacttgtactaatatgcctgttgagaagatcgatcacgctctcgatactattaaatctaacggtatccagaatgtccttgctctccgtggcgatcctcctcatggtcaggataagtttgttcaggtcgaaggtggatttgcttgtgctcttgacttggtgaagcatattaggaagaagtatggggattattttgggatcactgttgctggatatccagaggctcatcctgatgttatacctaacaatggaatggctccgcttgatgcttaccaaagtgaccttgcttaccttaagagaaaggttgatgctggtgcagatctcattgttacacaactcttctatgatacagatgttttcctcaagtttgttcatgactgtcgccaaattggaataaattgtccaatagttcctggcatcatgcccatcaacaattacaaaggcttcttgagaatgactgggttctgcaaaactaagattccagctgagattatggctgccttggagcctataaaggataatgaagaagctgttaggaactatggcattcatctggggacagaaatgtgcaagaagataatgactagtgggatcaagacagttcatctctatactctaaacatggagaaatctgccttggcgatattgatgaatcttggattaattgaggagtccaaggtttcaaggccattgccttggaggcgtcccacaaatgtcaaccgtagcaaagaagatgtccgcccgattttctgggccaatcgtccaaagagctatatctccaggactataggctgggagcaatatccacgtggccgatggggtgattcccgatctgctcaatatggagcgcttagcgattatcaattcatgaggcctcgtgcacgcgacaagagacttcatgaggaatgggttgtcgcactgaaaaatgttgaagacatttatgagaaatttaagcagtattgtcttggaaaattgagaagctgtccttggtctgaattagacgggcttcaaccagagacaaagatcataaatgaacagctcggtaatgttaacttgaaaggtttcctcactatcaacagccaaccagcagttaatggagcgaagtccgactccccgtctgttggatggggtggttccggtggatatgtttaccagaaggcataccttgaatttttctgctcaaaagacaagttgaatgctatcgttgagaaagcaaaagcttatccgtctcttacctacttggctgtgaacaaagagggagattggatttcaaacgtgacatcaaccgatgtgaatgcagtgacttggggagtctttccagcgaaggagattatccaaccaactgttgttgaccctaccagcttcgcggtttggaaggatgaagcttttgaaatttggtcaagaggatgggctcaattatacccagcagccgatccatccagaaaattactcgaagaggtgcaaaacagttattatttggtcagcttggtcgataatgactacatcacgggtgatctatttgctgtctttaaggacatttgaaactagcaatgctagtcggttttcttttagccaattcccacattccacttcaataagtggcggtttgttttttatgtttggtaaaattaattgttagtcgtcatcattcctaaagtttagactagatttatggttatattattatagtcacaataacaatttagttgaatgggagtttggcattcttccctttgtattaatgatatttatttgtatttgattt

SEQ ID NO: 1564 - DNA, 2260 bp, Cicer arietinum
tatcattgcatctataaataacaagaagagacttcctcacatttcgcgctttgccctcttccacttcttcattctctctctcactaaccgtaaggttaattaaattaaataattaaattttaaaagagaaaatatgaaggtgatagacaaaattcgagcagcttcagctgatccaaacagagtggttttttcgtttgagtttttcccaccgaaaactgaagatggtgtcgataatttgtttgagagaatggatcgtatggttgcacacaatccttcattttgtgatattacttggggtgctggaggaacaactgctgatctgacattggaaattgcgaacaagatgcagaatattatttgtgttgaaactatgatgcatcttacttgcactaatatgcctgtggataagattgatcatgctcttgagactattaagtctaatggtattcagaatgtgcttgctcttcgtggtgatccgcctcacggtcaggagaaattcgttcaggcagaaggtggatttgcctgtgctcgcgatttggtagaacatatcagaagcaaatatggtgactactttggcattaccattgctggctatccagaggcacatcccgatgttataggaagtgatgggctggctccagtggaaggttatcaaaatgatcttgcttacttgaagagcaaggttgatgctggagcagatttgattgtcacccagttattttatgatactgatatattcctcaaatttgtgagcgattgtcgccaaattggaataacctgtcccattgtgcctggaattatgcccattaacaattacaagggatttatccgcatgactggtttttgtaaaacaaagatacctgctgagataatggctgctttagagcctatcaaggacaatgaagaagctgtcaaggcttatggaatacacctgggaactgaaatgtgcaaaaagattatggctcatggaattaagacagtgcacctttatacgctaaatatggagaaatctgcattggcgatactaacgagccttggcttaattgaagagtccaaaatttctagatctttaccttggagacgccctacaaatgttttccgtgttaaagaggatgtccgcccaatcttttgggcaaatcgtccaaaaagctacatatcaaggaccattggatgggatcaatacccacatgggcgttggagtgattccggtaacccatcatatggtgcattaactgattatcagttcatgcgaccacgtgcacgggacaagaagcttattgaagaatgggcagttcccttgagaagcgttgaagatatttatgagagattcagactgttttgcctgggaaagttgagaaccaatccttggtccgaacttgatggtcttcagccagagtcaaagatcattaatgagcagctggagaagataaacacgaagggtttcctcaccattaatagccagccagcagtcaatggggaaaagtcagattgtcctactgtaggctggggtggacctaatgggtatgtttatcagaaggcatacttagagttcttctgctccaaggaaaagctggatgcacttgttgagaaatccaaggcccgaccatccctaacttatatggctgtgaataaagaagggactgcgaaatctaatgtgggcccaaccgatgtgaatgctgtaacatggggtgtcttcccagctaaggagataatacaaccaaccattgtagatcctgtcagcttcaatgtatggaaggatgaggcatttgaaatttggtctagagcatgggcaagcttataccctgaggctgatgcatccaggaaattggttgaacaggtgggtggtagctacttcttggtcagcttggtggacaatgattacatcaatggtgatctttttggtgtgtttggtgatatctgatacgagcttcttaataatatattagttctataaagaagccatttctgttgctcggcaagttttttccttttctttttcccattaattattattcacattatacatactattattctatgttggagtggcaaattaattgtctggaatatatggcaaacatcttaattttgtcatgtttcagagtctcatgagtaatctgtaatttcatcaaatcacctgtatgttgatttttgaaaacaagttgctcattcctatgaatttgatggttgtatgagattgaattttatatttaaaaaaatgagtggaagtagaatttagaagtagaaactatatttgacg

SEQ ID NO: 1565 - DNA, 2243 bp, Plantago ovata
agaagtacctgttgcctgaggaagaaggcaagacctagcggccgggggatccacatctcctcgactccatagccataaaacccccccaaaattctgtcggtcggcagtacacactcacatgccacctctcttctactagttccattagcacgaagaagaaatgaaggtaatcgagaagattcacgaggcaaatggcggctccgacagagtcgtcttctccttggaattcttcccgccgaaaaccgatgacggcgtcgacaacctcttcgagcgaatggagcgtatggtcgctcacaaccctaccttctgcgacattacttggggagctggtggatccaccgctgatctcactcttgagatcgccaatcgcatgcagaacatgatctgtgtcgagaccatgatgcacttgacttgcactaacatgcctgttgataagattgatcacgccttggagacgatcaaatccaacggaatccagaatgtgctcgcccttcgtggcgatccgcctcatggtcaggataagttcgttcaggttgatggtggctttgcctgtgctcttgacctggttaatcatatccgctccaagtatggggactactttgggatcactgttgccggctatccagaggggcatcctgatgttattcaggacggagcagcatctgccgaggcatatcagaacgaacttgcttatctaaagaagaaggttgatgctggtggtgaagtcattgtaactcaactgttctatgatactgacatctttctcaaatttgtgaatgactgtcgccaaatcgggataacttgtccgattgtgccgggtattatgcctatcaacaattacaagggcttcatccgcatgacaggtttctgcaaaacaaagataccggatgatattatggctgccttggaacctatcaaggataatgaagaagccgtcagggcctatggtattcacctaggaacagaaatgtgcaagaaaattatggctagtggcataaaaactttacatctttacacattaaacatggagaaatctgcattggcaatactgatgagccttggtcttattgaggagtcaaaaatatcaaggtccctgccttggagacgtccggcaaatattttccgtgtaaaagaggatgttcgtcctatattctgggctaaccgtcctaaaagctacatctcacggaccataggctgggaccaatacccacacggtcgttggggagactccagaaatgcatcatatggaacactcagtgattatcagtttatgcgtccacgttcacgcagcaagaaaattcttgaagagtgggttgttcctttgacaaacgctgaagatatttatgagaaatttatgaatttttgccttggaaaactgaaaactagcccatggtctgagctagatgggctccagccagagaccaaaatcattaacgaacagcttggtagcattaacatgaaaggctttctcaccatcaacagccaaccagctgtcaatggagcaaagtctgattccccatctgttggatggggaggaccaggagggtatgtttaccagaaggcatacttggaatttttctgctcttcagagctgttgaaggatctggttgagaaatccaagctcttcccatccctcacctacatggctgtgaataaggaagggaatttgatatctaatgttcactctgctgatgtaaacgctgtaacatggggagttttccctgcaaaggagataattcaacccactgttgtcgatccttcaagctttgcaatatggaaggatgaagcatttgaaatttggtccaaaggatgggctacgctctatccagaatctgatccatccagaaaaatactcgaggaggtgcagagcagttattacttggtcagcttggttgataatgactacattggtggagatctgtttgctgttttcaaagatatctgatgtgatacggtcatcctctattttacatacacatacacaattgtattttgcacaatatgatctactattcttttctatttccggcgctcaaatagttgcgcatattataggttgatctagtgaatctgtgcgatttaataccatgtcattataggctctacttggggattctacaatacccaagttatggtgtagacaaaacttaaaatttcagtgtaattggtccattgcgatcatactatagttgctactgtatttctattcattgaagttgatggtcataaagtgattgttgccg

SEQ ID NO: 1566 - DNA, 2246 bp, Plantago ovata
agaagtacctgttgcctgaggaagaaggcaagacctagcggccgggggatccacatctcctcgactccatagccataaaacccccccaaaattctgtcggtcggcagtacacactcacatgccacctctcttctactagttccattagcacgaagaagaaatgaaggtaatcgagaagattcacgaggcaaatggcggctccgacagagtcgtcttctccttggaattcttcccgccgaaaaccgatgacggcgtcgacaacctcttcgagcgaatggagcgtatggtcgctcacaaccctaccttctgcgacattacttggggagctggtggatccaccgctgatctcactcttgagatcgccaatcgcatgcagaacatgatctgtgtcgagaccatgatgcacttgacttgcactaacatgcctgttgataagattgatcacgccttggagacgatcaaatccaacggaatccagaatgtgctcgcccttcgtggcgatccgcctcatggtcaggataagttcgttcaggttgatggtggctttgcctgtgctcttgacctggttaatcatatccgctccaagtatggggactactttgggatcactgttgccggctatccagaggggcatcctgatgttattcaggacggagcagcatctgccgaggcatatcagaacgaacttgcttatctaaagaagaaggttgatgctggtggtgaagtcattgtaactcaactgttctatgatactgacatctttctcaaatttgtgaatgactgtcgccaaatcgggataacttgtccgattgtgccgggtattatgcctatcaacaattacaagggcttcatccgcatgacaggtttctgcaaaacaaagataccggatgatattatggctgccttggaacctatcaaggataatgaagaagccgtcagggcctatggtattcacctaggaacagaaatgtgcaagaaaattatggctagtggcataaaaactttacatctttacacattaaacatggagaaatctgcattggcaatactgatgagccttggtcttattgaggagtcaaaaatatcaaggtccctgccttggagacgtccggcaaatattttccgtgtaaaagaggatgttcgtcctatattctgggctaaccgtcctaaaagctacatctcacggaccataggctgggaccaatacccacacggtcgttggggagactccagaaatgcatcatatggaacactcagtgattatcagtttatgcgtccacgttcacgcagcaagaaaattcttgaagagtgggttgttcctttgacaaacgctgaagatatttatgagaaatttatgaatttttgccttggaaaactgaaaactagcccatggtctgagctagatgggctccagccagagaccaaaatcattaacgaacagcttggtagcattaacatgaaaggctttctcaccatcaacagccaaccagctgtcaatggagcaaagtctgattccccatctgttggatggggaggaccaggagggtatgtttaccagaaggcatacttggaatttttctgctcttcagagctgttgaaggatctggttgagaaatccaagctcttcccatccctcacctacatggctgtgaataaggaagggaatttgatatctaatgttcactctgctgatgtaaacgctgtaacatggggagttttccctgcaaaggagataattcaacccactgttgtcgatccttcaagctttgcaatatggaaggatgaagcatttgaaatttggtccaaaggatgggctacgctctatccagaatctgatccatccagaaaaatactcgaggaggtgcagagcagttattacttggtcagcttggttgataatgactacattggtggagatctgtttgctgttttcaaagatatctgatgtgatacggtcatcctctattttacatacacatacacaattgtattttgcacaatatgatctactattcttttctatttccggcgctcaaatagttgcgcatattataggttgatctagtgaatctgtgcgatttaataccatgtcattataggctctacttggggattctacaatacccaagttatggtgtagacaaaacttaaaatttcagtgtaattggtccattgcgatcatactatagttgctactgtatttctattcattgaagttgatggtcataaagtgattgttgccgtcg

SEQ ID NO: 1567 - DNA, 2040 bp, Solanum lycopersicum
ccccaacttgatcctacattgttaaaaaaaaaatgaaggttattgagaaaattcaagaatctgtgaaagatgacagagtagttttctcttttgagttttttccaccaaaaactgaagatggggttgataatttgtttgaaagaatggaaagaatggtgtcacataacccatctttttgtgatattacatggggtgctggtggttcaacagcagatctgactcttgaaatttcaaataggatgcagaatatggtttgtgttgagactatgatgcatttgacttgtactaatatgcctgttgagaaaattgatcatgctcttgaaactattaagtctaatgggattcaaaatgttcttgctcttcgtggagatcctcctcatggacaagataagtttgttcaagttgaaggtggttttgcttgtgctttagatctggtaaagcacatgcgggccaagtatggggattactttgggatcactgttgcgggttacccagaggctcatcctgatgttatacctgcgaatgggctagctacactagagacatatgaaaacgaacttgcctatctcaaacagaaggttgatgctggagctgatctcgttgtaactcaactcttctatgatactgataatttcctcaagttcgtcagtgattgtcgtcaaattgggattacttgtcccattgttccaggaatcatgcccatcaacaattataagggcttcttgcgcatgactggattttgcaaaactaggatcccggcagagattacagctgccttggaacctattaaggataacgaagaggctgtcaaagcatatggaattcaccttggaactgaaatgtgcaagaagattatggccagtggcattaagacattgcatctttatacattaaacatggagaaatcagcattggccattttgatgaatcttggattgattgaagagtccaaaatttcaaggctgttaccttggagacgtcctacaaatgtttttcgtatcaaagaagatgtccgtccgatattctgggccaaccgtccaaagagctacatctcaagaaccattggttgggacgagtttccacatggccgatggggcaatgctaaaaatccgtcatatggagcacttagtgattatcagttcatgcgggcacgctcacgtgataagaaacttcaagaggaatgggctattgctctcaatagtgtggaagacatctatgagagatttatgtactactgtctcgggaagctgagaagttgtccttggtctgagttagacgggcttcaggcagagacaaagatcatcgatgatcacttgggtaatataaactcgaaaggtttcctgactattaacagccaaccatcagttaatggtgcaaagtccgatgctcctttagttggatggggtggtcctggtggatatgtttatcaaaaggcatacttagagttcttttgctcgcgtgagaagttaaatgctgttatcgaaaaatgcacggcttaccccttccttacctacatggctgtgaacaagaaaggaaactggatgtccaacttcaaccaaatcgatgtcaatgcagtgacatggggcgtcttcccatctaaggagattgtacagccaaccgtcgttgatcctgccagcttcatggtatggaaagacgaggcatttgaaatctggtcaagaggttgggctcaattataccccgagaacgatccatctagaacattgctcgaacaggttcaaaacagttacttcttggtcagccttgtcgataacgattacatcaatggagatttgtttgccatcttcaaggatatctggaattagttctttacacacaatgaagtttcttctttggatttgagtagaaaatttatgatttattgttgctttttattaattcagttttgtatttgttctcttcattctttttagactacaccttggctcttttaagctttggcaaattcatgagcatttgtatacaattttcatttatctctctatacataaaatatatatatattttgaatttttcactcga

SEQ ID NO: 1568 - DNA, 2322 bp, Triphysaria pusilla
actttagcccctttagacctcttacggtcttacctacctccggtgtcccatttttcttcgtcataattacacataacaaatctaatgaataccaactatattaatccataccaatgctatagcctatagcaccacactgcagatctgatccaaaactcacctattcagaatccattaagttctaagatgaaggtgatagagaagatccagcaagcaaccgctgccaatgacgatcgtgtggtgttctcctttgaattcttcccaccgaagactgaggacggcgtcgagaacctgttcgagagaatggagcggatggtggtccataatcccacgttttgtgacatcacgtggggagccggcgggtccacggcggatctgacgctggagatcgccaaccgcatgcaaaacatggtctgtgtcgagaccatgatgcacctcacctgtaccaatatgcccgtcgagaagatcgaccacgctctcactaccataaagtccaaaggcattcagaacgttctcgccctccggggggacccaccgcacggccaggacaagtttgtccaggtcgaagggggtttcgcctgcgcccttgacctcgttaagcatatccgttctcaatatggggactattttgggattactgttgctggttatccagagggacatcctgatgttattcaggatggaggtgcttccgcagaggcatatcagaatgaccttgcttatctcaagaaaaaggttgatgctggagctgatgtcattgtaactcaactcttctacgacactgacatcttcctgaaatttgtgaatgactgtcgtcaaattggaataaccattccaattgtgcctggtatcatgcccattaataattataagggcttcatccggatgactggtttctgcaaaactaagattccggatgagattatggctgccttggagccaatcaaggacaatgaagaagctgtcagggcctatggaattcacctaggagtagaaatgtgcaaaaagattatggctagtgggatcaaaactttacatctctatacattaaacatggagaaatctgcattggcaatattgacgaaccttgggctgattgaggagtccaaaatttcaaggtccttgccatggagacgaccagcaaatgtttttcgagtaaaagaaaatgttcgtccaatattctgggctaatcgtccaaagagctatatctcacgaacccttggttgggaccagtacccacagggtcgatggggagattctcacagtgcatcatatggggcactaagtgattatcagttcatgcggccacgcgctcgtgacaagaaacttcgtgaagaatgggctgtttctttgaacaacattgaagatatctatgagaaattttcaaagttctgccttgggaaacttaaaagcagtccctggtctgacgtcgatgggcttcaggcagagaccaaaatcatcaatgaacaacttggtagtattaatttgaaaggttttctcactatcaacagccaaccagctgttaacggtgtgcagtctgactccccatctgttggatggggtgggccaggcggatatgtataccagaaggcttacctagaatttttttgttcaacggagaagttgaaagctctggtcgataaatccaaacacttcccacatctcacttacatggccgtgaataaacaaggaagttggcaatctaatgcgaacaaaactgatgtgaatgctgtgacttggggagtttttcctgcaaaggagattattcaaccaactgtggtggaccctgaaagctttcttgtatggaaggatgaagctttcgagatatggtccaggggatgggctaagctctacccagatacagacccgtcaaagaaattactcgaggaggtggagagcagctattatttggttagcttggttgataatgattacatcaatggagatctgtttgctgcttttaaagacatttgaaagaatgattccaagaatttgattttcgatttatttattcctataagttattcattctatgaaaggtatactgccatgtagtaacattattgtccacttgggattttggagtggccaattttatgatgtaaaagtaaaactatcacaagtttctgattgtattttattgtttacacgacaatgcctcaggttggtgctgctgtatctgtgtttcttgaaaaataacactagcaaatattaattttattaccatagtacattttcatattaatttggtccatggacctgtaactttacaccatagcacaaaaatagttaatattattgacgaaaaaaaaaaaaaaaaaa

SEQ ID NO: 1569 - DNA, 2654 bp, Secale cereale
cgccgcactggcgcgcatcgtatcgcgggccctccgttcgcctcgcgctcgcacctccatctctccccgcccctccgcggcgcggcgctcctcagctccacgccactcctcccgcacctccctgcggcggcgtccacggcctctctgctctcctggcgggggttcacacccacccccgagccctcccgctttccgcagcctttcgcgggattcctcgctggcatacgcggcttccgaagggcgcggcgcgggcaggcggcggcgaagcgagagccgccgcaggaccctgcgcccccgccccgcccaaggagagcgagatagagctctgcgcccgcatcagcgtcgaggatgatttgcccgacgacatcgaagtgctgaatgttatagaaatcatgaaattaaatgttcctatggcgatgaaaattgcactagatggacttctggagtataactacaaaacacgagacacttcaataagtgacgttgggaagtatgaaaaggttgaggtttctgtgttgttatgcaacgacaacttcatccagaatcttaacaaagaatggagaggcgaggactgcgctactgatatgctctcagtgtcacagttcattcccgatctggatgttcctactcttatgttgggtgatatagtaatatcggtggaaacagctgcaaggcaagctgaggcgaaaggtcatacccttcttgatgaactgcggacactagtggttcgtggcctgttatgtcttctgggttttgaccgtcagattagtgatgaggccgcaatggaaatggagaaggaggagctgctcattttaaaaagtctaaggtggaaagggaaaggtcttgctaagaacgctcctgatttgagcaagcctcacacagaaacattggatggacaagtagcaaacagtctaaagaaagctggcagcctgagattttatagaccaaaattcaaatatatcttctgtgatatggatggtacattgctcaacagtaaaagtcaagtaacagcaaggaatgcagaagctctaaaggaagctaggtcaagaggagtaaacatagttattgccacaggaaagacgcgcccagctgccattgatgctcttaatatggttgatttatctggaagaaatggcattgtttcagaatcttcgcctggtgtatttcttcaggggctgttggtttatggtttggaagggagagaaatttatagaaatacattgaaccaagaagtatgccgagaggcatttatgtattccttggagcacaaggtaccattagtagcatttagccaggatcggtgtttttctatgtttgaggatccattggttgattctctccatgatgtataccatgaacctaaggctgaaatagtgtcatctattgatcagcttttaggaacagctgagatacagaaactagtgttcattggaacttctgagggaatttcttccacattgaggccatactggacaaaggcaatagaagaaagggctagtgttctccaggcacagcctgatatgcttgagcttgtaccacctgcaacttcgaagggcaccggggtgaagattttgttggaccatctttgcattagtccggacgaggtaatggcaattggagatggagaaaatgacatagaaatgctacagctagcatcactgggtgtcgctttggcaaacggtgctgagaagaccaaagcagttgcaaacgtgattggcgccaccaacgacgaagatggagttgcacaggccatctatgaatacgctttctaacagctgctgacactactaaggcgcactgggacaggattgtcttccacagtgttgttgccaaataacaagtttgttcaaacatctatcaccaagatgattcagggtcgtggtcacagcacccgccaagtgttttaacacttgaggcatcaggcagagctattttttggctggcaatcagtgaagacacgccattcttttttccactgggaaatagttgtactccctatgatccatattacttgtcgctcacctagtacaattttagtactggattggaggggtagtaaaacattcttccatctctgatacccaaaggaccgctctctgttttggccatgctactttgtactccttgttatgttgagaaataaccaggacgatcaaagaccatgtaccatggctcagaattcggaccttggataatctttgttaatcaaaagaaaatgtttagtatacaaccggtctctctatttacacagtgatgaatcaatcaatgtcctcctgaacaatatgtcttcccgaacagcagagaagcaaaagcctgctagagtacatttgacaggctaatacgcccgccaagaaaaatcctcaaggtcaaggaacaaagaagggaagagctgccgaggccagccatggacagacatttccaggcagccgcgagccctactgatggcacgcgctcttgttgacagggatcgcgggaggcctgtagagcatgttggcgccgttggtccgcgccatcatcaggttcgcgcaggagctcgccgagttctgcttggcgattcctttgctgttggtgttgggagcagatacggggcaagctgtctggttcccatccagatcgatgttgctcctgcatgacttaatcttcttgcaggggct

SEQ ID NO: 1570 - DNA, 3485 bp, Oryza sativa
gagatcccgcacttacacggtgggccggagcaaaacacagaccgttggatacgaaatggacggcccgaacgagacccaggatataatacgcagcgcagaagaaaatcaaacggaccaacacgaaaaccctcctcctccgcccaaccccattccttctcacccactctcttctcccgccgccgccgccggaggaggcggctcctcgtcgtcggcctcgacgaccatggcacggatcgtgtcgcgcgccctcccgttcgcctcgcgctcgccgcagctcggcgcggcgctgatacgctcggcgccgatgcgctgcccgcccctccccgccgcggcgcccaccgcctcgctgctctcctggcgcgggttcacgccctcctcagagccctcgcgctcggcgccgccgccaccgccgctgccgatgccgcccttcgcggggttcctcgccggcatccgaagcttccgcaggggtaggcgcggccagtcggcggcgaggcgtgcgcagccccaggaccccatcccttcaccccctcccgcgccgaaggagagcgagatcgagctctacgcgcgaatcggcatcgacgatgacacgcccgaagaccccgaagtgctgaacattgtagaaattctaaaattaaatgttccgatggcgatgaaaattgcactagatgggcttctggattccaactacaaaacacgagacacttcaataagtgatgtcgggaggtatgataaggttgaagtttctgtgttgctatgcaatgacaacttcatccagaaccttaacaaagaatggagaggtgaagacagctgtattgaaatgctctcaatgtcacaatacattcctgatcttgatgttcctattctaatgttaggtgatattgtaatctcagttgagacagctgcaaggcaggctgaggagcgaggtcatacacttcttgatgaagtgcggatactagcggttcgtggaattctacgtcttctgggttttgatcaccaaacaagtcatgagtctgcagttgaaatggagaaggaggagcagctcattttgaagagtctaaggtggaaagggaaaaatcttgctaagagtgttcttgattcgggcaagcgtcatacagaaacatcggatgggcaagtgacaagtggtctaaaaagagctggaagcctaagattttatagaccaaaattcaaatatatcttctgtgatatggatggtacactgctcaacagtaaaagtcaagttacagcaaggaatgcagaagctctgagggaagcaaggtcaaggggagtaaacatagttattgccacagggaaggcacggccggctgtcattgatgctctcaatatggttgacttgtctggaagaactggaattgtctcagaatcatctcctggcatatttcttcagggcctcttggtttatggtttgcaaggaagagaaatttataaaaggaatttagatcaagaagtatgcagagaggcattgttatattctttggagcagaaggtaccattagtagcatttagccaggaccgatgcttctctatgtatgatgatcctttggttgattctctccattatgtgtatcatgaacctaaggctgaaatagtctcgtctattgatcagcttttaggaacagctgagatacagaaagtgctcttccttgaaactcctgagggaatttcttctgcattgaggccattctgggaaaaggcaatagaaggaagggcccgtgtggttcaagcacagcctgatatgcttgaacttgtacctcctgcaacttcaaaaggcaatggggtgaagattcttttggaccacctttgcattagtccggatgaggtaatggctatcggggatggagaaaatgacatagaaatgctacagctagcatcattgggtgttgcgcttgcaaatgggtctgagaaaaccaaagcagtggcaaatataattggtgccactaatgatgaagatggagtcgcacaggctatttacgactatgctttctaacagctgctaactctaaggcgtattgggataggattatctactctttggttctccccagtgccctggattcaccatataacaagacttgatcaccatctatccacaagataatactgggatgtgatctgaagccctgttggagtcaaaacattttgaactattaggcttcggttcattttttggtttggcaaacattcatgaccagccatgctacaatttgtgtgtctggaatatttatagaattgaattccttttgttttcatctttgatgaccaaaggactcccttaacgttaagctgttcttcttcttcttttaaccaaggcaattggatgtactgcagacatatgctttaaatttcgacagaaggctgttcatcatccccaggcagtccaatgaaaaatttcattgtagtatttacaaacagaatcgatgtctccttgaacaagacgactctctgtatatggcagagaacgaaatcctcttacatccgtgacaggctaatatgcttgtcaacaaaatcctcaacgaaaaaagaacagagatgaaaccctgaccccccaaaaaaaaaacatttcgatactgttcctactgatgatatccgcttttgtttacaggaattgggggaggcctatagagcatgcttttggtgttattcctggccatcagatttgcgcaagaacttccagacttcttggctattgatgtgctgtttgcgccaggtatatgacaagcttcctggttcccatccagtgctacatagctcttggatgatttgatcttcttgtatggattctccttcttgcgtagatcctctaggcatctcacctcagacatacatgcaaaagattgagactttccgtcgtagtatttggataatcctttcctgcaaagaacaacaaagcacttgccctgtgagaaaattttccttttgctagtacatctattgatactaatatgcaactcttcttccccaggaacttacttgacagggagttgtgccttcatagatgacagatcgtagaggctatctgaattcatccttctcgctggctgctgcgcaaactggtcttcttgagcttcagcttcctcgctgtctgaaaattgagcctcatcatcggagtcgcctgagatggacgatgatgtctcgaacaagtcttcatcttcttcttcacggtatactggaaggaccgcagctccaccgaatttgcccatgctcgcagtttttctggcttctggaacaaagacaccgaaagaacaggtacgctttgtgtatagaactatggatatattcttcttcctctcttgcttcctctctttcacaatctttacaacgtccggtggggagggtgggtgtatatatagctccagctgaaatgggataacgctaagctgccttctttcaaacactgcacagtgccctttgactaatataatcttacgcaatttgcatccatgacatcacctatttgttgtgtttac

SEQ ID NO: 1571 - DNA, 3335 bp, Oryza sativa
gagatcccgcacggacacggtgggccggagcaaaacacagaccgttggatacgaaatggacggcccgaacgagacccaggatataatacgcagcgcagaagaaaatcaaacggaccaacacgaaaaccctcctcctccgcccaaccccattccttctcacccactctcttctcccgccgccgccgccggaggaggcggctcctcgtcgtcggcctcgacgaccatggcacggatcgtgtcgcgcgccctcccgttcgcctcgcgctcgccgcagctcggcgcggcgctgatacgctcggcgccgatgcgctgcccgcccctccccgccgcggcgcccaccgcctcgctgctctcctggcgcgggttcacgccctcctcagagccctcgcgctcggcgccgccgccaccgccgctgccgatgccgcccttcgcggggttcctcgccggcatccgaagcttccgcaggggtaggcgcggccagtcggcggcgaggcgtgcgcagccccaggaccccatcccttcaccccctcccgcgccgaaggagagcgagatcgagctctacgcgcgaatcggcatcgacgatgacacgcccgaagaccccgaagtgctgaacattgtagaaattctaaaattaaatgttccgatggcgatgaaaattgcactagatgggcttctggattccaactacaaaacacgagacacttcaataagtgatgtcgggaggtatgataaggttgaagtttctgtgttgctatgcaatgacaacttcatccagaaccttaacaaagaatggagaggtgaagacagctgtattgaaatgctctcaatgtcacaatacattcctgatcttgatgttcctattctaatgttaggtgatattgtaatctcagttgagacagctgcaaggcaggctgaggagcgaggtcatacacttcttgatgaagtgcggatactagcggttcgtggaattctacgtcttctgggttttgatcaccaaacaagtcatgagtctgcagttgaaatggagaaggaggagcagctcattttgaagagtctaaggtggaaagggaaaaatcttgctaagagtgttcttgattcgggcaagcgtcatacagaaacatcggatgggcaagtgacaagtggtctaaaaagagctggaagcctaagattttatagaccaaaattcaaatatatcttctgtgatatggatggtacactgctcaacagtaaaagtcaagttacagcaaggaatgcagaagctctgagggaagcaaggtcaaggggagtaaacatagttattgccacagggaaggcacggccggctgtcattgatgctctcaatatggttgacttgtctggaagaactggaattgtctcagaatcatctcctggcatatttcttcagggcctcttggtttatggtttgcaaggaagagaaatttataaaaggaatttagatcaagaagtatgcagagaggcattgttatattctttggagcagaaggtaccattagtagcatttagccaggaccgatgcttctctatgtatgatgatcctttggttgattctctccattatgtgtatcatgaacctaaggctgaaatagtctcgtctattgatcagcttttaggaacagctgagatacagaaagtgctcttccttgaaactcctgagggaatttcttctgcattgaggccattctgggaaaaggcaatagaaggaagggcccgtgtggttcaagcacagcctgatatgcttgaacttgtacctcctgcaacttcaaaaggcaatggggtgaagattcttttggaccacctttgcattagtccggatgaggtaatggctatcggggatggagaaaatgacatagaaatgctacagctagcatcattgggtgttgcgcttgcaaatgggtctgagaaaaccaaagcagtggcaaatataattggtgccactaatgatgaagatggagtcgcacaggctatttacgactatgctttctaacagctgctaactctaaggcgtattgggataggattatctactctttggttctccccagtgccctggattcaccatataacaagacttgatcaccatctatccacaagataatactgggatgtgatctgaagccctgttggagtcaaaacattttgaactattaggcttcggttcattttttggtttggcaaacattcatgaccagccatgctacaatttgtgtgtctggaatatttatagaattgaattccttttgttttcatctttgatgaccaaaggactcccttaacgttaagctgttcttcttcttcttttaaccaaggcaattggatgtactgcagacatatgctttaaatttcgacagaaggctgttcatcatccccaggcagtccaatgaaaaatttcattgtagtatttacaaacagaatcgatgtctccttgaacaagacgactctctgtatatggcagagaacgaaatcctcttacatccgtgacaggctaatatgcttgtcaacaaaatcctcaacgaaaaaagaacagagatgaaaccctgaccccccaaaaaaaaaacatttcgatactgttcctactgatgatatccgcttttgtttacaggaattgggggaggcctatagagcatgcttttggtgttattcctggccatcagatttgcgcaagaacttccagacttcttggctattgatgtgctgtttgcgccaggtatatgacaagcttcctggttcccatccagtgctacatagctcttggatgatttgatcttcttgtatggattctccttcttgcgtagatcctctaggcatctcacctcagacatacatgcaaaagattgagactttccgtcgtagtatttggataatcctttcctgcaaagaacaacaaagcacttgccctgtgagaaaattttccttttgctagtacatctattgatactaatatgcaactcttcttccccaggaacttacttgacagggagttgtgccttcatagatgacagatcgtagaggctatctgaattcatccttctcgctggctgctgcgcaaactggtcttcttgagcttcagcttcctcgctgtctgaaaattgagcctcatcatcggagtcgcctgagatggacgatgatgtctcgaacaagtcttcatcttcttcttcacggtatactggaaggaccgcagctccaccgaatttgcccatgctcgcagtttttctggcttctggaacaaagacaccgaaagaacaggtacgctttgtgtatagaactatggatatattcttcttcctctcttgcttcctctctttcacaatctttac

SEQ ID NO: 1572 - DNA, 1633 bp, Panicum virgatum
cccgcttcccccgatcatctctctccctctcgcacgccgtctctcttccctcgcgccgccgcttcaacagcaacgcgcgcgcgcctctcgccaaggaaaccaccgatggagacgccgctgtccaacaggaggatcacccgctcgctcgccgccgccgccgccgccgccgcatcagcccagaagggcgccgccgccgcggcggactccacggccctgtcctcccgggccaagaacgccgacgcgggggagccgcaggcgcgcgccgcgctgcacgacatctccaacgactcccccatcgtcggcctcgccccgggcggcctgcacggctccgacaagactcccgcctccaccgccgccaagacccgccgcagggccccgcgccgcacgcccggctccggggaggcgctcctgcgcggccaggtccaggcgctcctgcacaaggtcgaggaggagcagggatgcgcccccgcggctctcgtcaggccagcgcgcatccaggcgcttcttgcggtctccaggtcgccggcccagctcctcgcgcccacgccggccaacacgccgcagatcgggcccgtctccgctgccatggaaggcctcctgatgcctgatgtccccgtggtgccctgcgtcctcgaggaggaggaactactgcttcctaagctgcaggtcatggctgcttccctgccgctccctcagccaaaggagaacctcggcgagtgccaactgaaccgtgcgctggtgttcgacgattcgcctgagaagtccgacgtgtccaatgggtcggctgtctcgttccaggagagcagcaccggcagctgcatagacaagtcgtcatcatcatcacctgaggatgacagctcctcggcctggtcagttcaggtccatgccagctctgagaagggcgacgaagaagagctcggcgtggaggaggaggacctgggagagtacactgaagaaggggaggacctgggagagtacactgaagaagggaaggagtgggaagaaaatagcgacgacgactgcttcgatgacctgtgcgaggagatgagcaggatgaccgtggtcgacgaagaagaggagaggaaggcagggctgccgcagttcgaggggaagcacacccggttcatctacaacagcgacgacgagatcgagcgggaggaggtggcggacgcagctgaggcgagggcggagctcggcgcgctgatgctcaggggactgccggtgccggagggcaggcacctgcgcttccacgaggacgatgaggacgaggagtgaagccgtgtcagtcgtgttcggattcgggcatctgcagtggttgtcattccctgacatgacaccagcaacatattcttttggggtctctgattctacattctgactctgtgttttggggtctctcagttgcgaattcatcagaaatgcaacatatccccagttactgaataaatctgctctgtggcattcggtgcatgagaagtctctatgctgttcagtagtttcagattttgtgctgttttggatatatcgttctggggaagttgaggccttgtactagcaaaaactaatttctgctatggcctctgggcttctgcgccctctgtttcttcattgtgatcagttcttcagaaagcat

SEQ ID NO: 1573 - DNA, 1588 bp, Zea mays
cttgcacaccagcagcaacaaaccacgcaacggctagtacggaagaagaggggcgagcggcgagcagcgccgttccgtcttcgccgtctcctcgtccgttcgccaagacaacggtcatattaccgttgtcctgccaaaattccaacactttaaaactgccacccaacgcgctcctccgccgccgtctccagcacacgcttccccttccctcccgctcccattcacgtcgtctctttcctcgagcctccgcttcgccagcgacgcgcccttctcacccacctcgccgaggaagtattcaccgatggagacgccgctgtcttccaggaggatcacccgctcgctcgccgccgcatctgcccagaagagcgccgccgccgggccggactccgccgccctcttctcccgcgccaagaacgccgccgctggggagacccagcctcgcgccgccctgcacgacatcaccaacgactcccccatcgtcgggctcgcggcgggcgccctccacgccaccgataccacccccgcctccaccgccgccaagacccgccgcagggccccgcgtcgcacgcccggctccggggaggcgctcctgcgcggccaggtcaaggcgctcctccacaaggtcgaagaggagcagggctgcgccgccgcggccatcgtcaggcccgcgcgcatccaggcgctgctcggtgtatccaggtcgccggcccagcttcttgcgccgacgccagccaacacgccgcagatcgagcccgtccccactcccagggaaggtctcctcctgcttgatggcgctacggtcgtgccctgcgtcctagacgaagaggaactgctgattcctaagcttcaggtcattgcagcttccctacctccacctcatcaggcagaggagaagctcggggactgccagctgaaccgtgcgctggtgttcgatgactcccctgagaaatgtgaagagtccagtggatcagccgtctcgtcaaccttctccctccaggagagcagcaccggcagctacgtggacaagtcatcatcacctgaggacgacagctcctctgcctggtccattcaggtccatgccagctctgagaagggcgacgaagaagagctgggcgtggaggagctggcagcagagtacactgacgaagaggaggaggaggaggaggaggactgggacgaagacagcgatgacgactgctacgatgatctgtgcgaggagatgagcaggatgaccgtgttggaggaggaggagaagaagaagaccgtgctgccgcagttcgaggggaagcacaccaggttcatctacaacagtgacgacgagatcgagcgggtggaggaggcggatgcagctgaggcgacggcggagcttcgcgcattgatgctcaggggcctgctggtgccggaggggaggcacctgcgcttccacgacgaggatgccgacgaataagaatctcagttgtgttgtcaagtggttggttgtctttcgctgacaccagccaaaattcttttgcggggctctgagtccagttctgtacgttgattcatgtctccgttcttaagagaaataatccaacttttctgaaaatca

SEQ ID NO: 1574 - DNA, 1799 bp, Sorghum bicolor
acccagcagcaacaaaccacgcaacggctagtacggagggagtgggggcaagcagaagcagcgccgttccgccttcgccgtctcctcgtcaacggtcatattaccgttgtcctgccacaatccccacactttaaaactgccaccccaagcgctccccctcccgccgccgtctccacccccgattccccgtctctccggctccctcgccctcacacgccgtctctttcctcgagcctccgctccgctagcgacgccgacgcgcgcctctctcacccgcgtcgacgagaaagcacccaccgatggagacgccgctgtccaccaggaggatcacccgctcgctcgccgccgccgccgccgcatccgcccagaagagcgccgccgccgccgggtcggactccgccgccctcttctcccgggccaagaagaccgccgcggtggagacccaggcccagacgcgcgccgccctgcacgacatcagcaacgactcccccatcgtcggcctcgcggcgggcggcctccacgccaccgacaccacccccgcctccaccgccgccaagacccgccgcagggccccgcgcagcacgcccggatccggggaggcgctcctgcgcggccaggtcaaggcgctcctgcacaaggtcgatgaggaccagggctgcgccgccgccgccgccctcgtcaggcccgcgcgcatccaggcgctgctcggcgtctccaggtccccggctcagcttcttgcgcccaccccggccaacacgccgcagatcggccccgtctccgcgcccagggaaggcctcctccagcttgatggcgccgccgccgtgacctgcgtcctcgacgaagaggaaccgctgattcctaagctgaaggtcattgcagcttccctgcctccacctcaggcagaggagaagctgggcgagtgccagctgaaccgtgcgctggtgttcgacgactcccctgagaagtccgacgagtccaatggatcagccgtctcgtcgtccgtctccctccaggagagcagcgccggcagctacatggacaagtcatcgtcacctgacgacgacagctcctctgcttggtccattcaggtccatgccagctccgagaagggcgacgaagaagagcttagcgtggaggagctggcggcagcagagtacactgaagaagaagaagaagaagaagaggagtacactgaggaggaggactgggaagaagacagcgacgacgactgctacgacgacctgtgcgaggagatgagcaggatgaccgtgttggacgaagaagagaagaaggccgccgggctgccgcagttcgaggggaagcacaccaggttcatctacaacagtgacgacgagatcgagcgcgaggaggtggccgacgcagctgaggcgacggcggagcttggcgcgttgatgctcagggggctgccggtgccgaaggggaggcacctgctcttccacgacgaggaggatgacgaggaataagaatgtcagttgtgttcaggttattgggttgcatgcagtggttgtctttccctgacaccagccaaattgatgctcagggggctgccggtgccgaaggggaggcacctgctcttccacgacgaggaggatgacgaggaataagaatgtcagttgtgttcaggttattgggttgcatgcagtggttgtctttccctgacaccagccaaaattcttttgggggcttccggttctgtattttgaattcatgtctccgttcttcagagaacaatattttatcgattcaactcttctgaaattcaatatactatttctcgg

SEQ ID NO: 1575 - DNA, 1983 bp, Sorghum bicolor
cccaacccagcagcaacaaaccacgcaacggctagtacggagggagtgggggcaagcagaagcagcgccgttccgccttcgccgtctcctcgtcaacggtcatattaccgttgtcctgccacaatccccacactttaaaactgccaccccaagcgctccccctcccgccgccgtctccacccccgattccccgtctctccggctccctcgccctcacacgccgtctctttcctcgagcctccgctccgctagcgacgccgacgcgcgcctctctcacccgcgtcgacgagaaagcacccaccgatggagacgccgctgtccaccaggaggatcacccgctcgctcgccgccgccgccgccgcatccgcccagaagagcgccgccgccgccgggtcggactccgccgccctcttctcccgggccaagaagaccgccgcggtggagacccaggcccagacgcgcgccgccctgcacgacatcagcaacgactcccccatcgtcggcctcgcggcgggcggcctccacgccaccgacaccacccccgcctccaccgccgccaagacccgccgcagggccccgcgcagcacgcccggatccggggaggcgctcctgcgcggccaggtcaaggcgctcctgcacaaggtcgatgaggaccagggctgcgccgccgccgccgccctcgtcaggcccgcgcgcatccaggcgctgctcggcgtctccaggtccccggctcagcttcttgcgcccaccccggccaacacgccgcagatcggccccgtctccgcgcccagggaaggcctcctccagcttgatggcgccgccgccgtgacctgcgtcctcgacgaagaggaaccgctgattcctaagctgaaggtcattgcagcttccctgcctccacctcaggcagaggagaagctgggcgagtgccagctgaaccgtgcgctggtgttcgacgactcccctgagaagtccgacgagtccaatggatcagccgtctcgtcgtccgtctccctccaggagagcagcgccggcagctacatggacaagtcatcgtcacctgacgacgacagctcctctgcttggtccattcaggtccatgccagctccgagaagggcgacgaagaagagcttagcgtggaggagctggcggcagcagagtacactgaagaagaagaagaagaagaagaggagtacactgaggaggaggactgggaagaagacagcgacgacgactgctacgacgacctgtgcgaggagatgagcaggatgaccgtgttggacgaagaagagaagaaggccgccgggctgccgcagttcgaggggaagcacaccaggttcatctacaacagtgacgacgagatcgagcgcgaggaggtggccgacgcagctgaggcgacggcggagcttggcgcgttgatgctcagggggctgccggtgccgaaggggaggcacctgctcttccacgacgaggaggatgacgaggaataagaatgtcagttgtgttcaggttattgggttgcatgcagtggttgtctttccctgacaccagccaaattgatgctcagggggctgccggtgccgaaggggaggcacctgctcttccacgacgaggaggatgacgaggaataagaatgtcagttgtgttcaggttattgggttgcatgcagtggttgtctttccctgacaccagccaaaattcttttgggggcttccggttctgtattttgaattcatgtctccgttcttcagagaacaatattttatcgattcaactcttctgaaattcaatatactatttctcggttattgtggagtaaatatgttttgtggtgactttccttcggtaagtcacaacgtgactttcgcccctgtatctgccgtccaaagaggatccaagggctacgaacattttcacccatgatgagtcgtgctctgctcgcctcgccgcgcataagaggagcaggccggccggaggtccgtggg

SEQ ID NO: 1576 - DNA, 1630 bp, Sorghum bicolor
gttgtatacaaggcgccgtgctagattccacacctaaggcaggcctcacacgccagccaactctcgtgtgcgtgattgcgtctcgcgcggtcagacgcagacgcagacgtgcgcaggcagagccaagagccagagcccagccgcagcgccatggacgtagaagcgcgcaaggacgcgccgccgcccgcgcgcggcaacaaggcgatgcaccgctttctggtggcgctcaactgtgggatgctcgcgctgggtgccatcggcggtcccctcctgagccgcctctacttcagcaagggcggccaccggcagtggctctccgcgtggctggagaccggcgggtggccgctgctgctggtccccgtggcgctgtcgttcgtcgcccgccgcgcgcgcgaccgggctgccccggtcctgctgacgccgccgcggatcctgctggccgccgtggcgctcggcgtggccacgggcgtggacgacttcatctacgcctacgggctcgcgtacctccccgtgtccacctccgcgatcctcatctcgacgcagctggcgttcacggtgttcttcgcgttcctcgtggtgcggcagcgcctgacggcggcgtccgtgaacgccgtggcgctgctgacggtgggcgccgtggtgctgggcctgcacgtctcgtcggaccggccccccggggtcaccaggggccagtactggctggggttcaccctcacgctcggcgccgccgcgctctacggcctcgtcctgccgctggtggagctcgcgtacaagcgcgccgccgctggcgggggccgcgccgtgtcgtacgcgctggtggtggagatgcagctggtgatggggttcttcgccaccgcgttctgcactgtgggcatgatcgtcaacaaggatttccaggcgatccctcgggaggcgaggcagtacgagctgggtgaggcccggtactacacggtgctggtgtggtcggcggtgctgtggcagtgcttcttcctgggcgcggtgggggtcatcttctgcgtgcacacgctgctggcggggatcctcatcgccgtgttcatcccggtcacggaggtggccgccgtcatcttcctgcacgagaagttcagcagcgagaaaggcgtggcgctggtgctctcgctctggggcctcgcctcctactcctacggcgagtggagccaagccaggaaggccaagaagaagcgggagcacgccgccgcggtggaggcccagcagccggcggcaccgtgatcatgcatgcatgcatctgtgctcgctgctgtggacgtgacgtacgtcgtcgatcttccttctccctcgttgtactgtctgtatgtgtaggttgtgattttatggcggcggccgtgtggatatatggcgtccgtacgtcctgatgagtcgtcagtcgtgctcttctgttcagtaggcatttgggcagtagcgtactgcatggtgcatggaggtaccgtggcagtacaaccacgtttgaatagttattaattagctacgtttggagttcgtggcaaatcgatcccagggaatgatctgatctgattctgatctgaacgaatataaaaaaaaacaaatgcttgtttctgtgtatatttcaatactatttgtgttgctacactta

SEQ ID NO: 1577 - DNA, 1734 bp, Sorghum bicolor
gggtgctttgcacgtaaataggatccggtgcacacggctcgcgtctacaaggagtgaaattaatccgcagccgcctgccggcgtcgacatcgttgtatacaaggcgccgtgctagattccacacctaaggcaggcctcacacgccagccaactctcgtgtgcgtgattgcgtctcgcgcggtcagacgcagacgcagacgtgcgcaggcagagccaagagccagagcccagccgcagcgccatggacgtagaagcgcgcaaggacgcgccgccgcccgcgcgcggcaacaaggcgatgcaccgctttctggtggcgctcaactgtgggatgctcgcgctgggtgccatcggcggtcccctcctgagccgcctctacttcagcaagggcggccaccggcagtggctctccgcgtggctggagaccggcgggtggccgctgctgctggtccccgtggcgctgtcgttcgtcgcccgccgcgcgcgcgaccgggctgccccggtcctgctgacgccgccgcggatcctgctggccgccgtggcgctcggcgtggccacgggcgtggacgacttcatctacgcctacgggctcgcgtacctccccgtgtccacctccgcgatcctcatctcgacgcagctggcgttcacggtgttcttcgcgttcctcgtggtgcggcagcgcctgacggcggcgtccgtgaacgccgtggcgctgctgacggtgggcgccgtggtgctgggcctgcacgtctcgtcggaccggccccccggggtcaccaggggccagtactggctggggttcaccctcacgctcggcgccgccgcgctctacggcctcgtcctgccgctggtggagctcgcgtacaagcgcgccgccgctggcgggggccgcgccgtgtcgtacgcgctggtggtggagatgcagctggtgatggggttcttcgccaccgcgttctgcactgtgggcatgatcgtcaacaaggatttccaggcgatccctcgggaggcgaggcagtacgagctgggtgaggcccggtactacacggtgctggtgtggtcggcggtgctgtggcagtgcttcttcctgggcgcggtgggggtcatcttctgcgtgcacacgctgctggcggggatcctcatcgccgtgttcatcccggtcacggaggtggccgccgtcatcttcctgcacgagaagttcagcagcgagaaaggcgtggcgctggtgctctcgctctggggcctcgcctcctactcctacggcgagtggagccaagccaggaaggccaagaagaagcgggagcacgccgccgcggtggaggcccagcagccggcggcaccgtgatcatgcatgcatgcatctgtgctcgctgctgtggacgtgacgtacgtcgtcgatcttccttctccctcgttgtactgtctgtatgtgtaggttgtgattttatggcggcggccgtgtggatatatggcgtccgtacgtcctgatgagtcgtcagtcgtgctcttctgttcagtaggcatttgggcagtagcgtactgcatggtgcatggaggtaccgtggcagtacaaccacgtttgaatagttattaattagctacgtttggagttcgtggcaaatcgatcccagggaatgatctgatctgattctgatctgaacgaatataaaaaaaaacaaatgcttgtttctgtgtatatttcaatactatttgtgttgctacacttacacactgtgcgtc

SEQ ID NO: 1578 - DNA, 1409 bp, Zea mays
gtgtaactaatccgctgccggcgtcatcgttgtatccaaagcgccgtgctagattccactccacacctaggcaaggccgcacacgccaaccaccctcgtgtcgtgtgcgtgtgcgtgtgcgcgggcagacgccagcggccagccgcagcgccatggacgtagaagcgcgcaaggacgcagcgcccgcgcgcggcaaggcggtgcgccgctttctggtagcactaaactgcgggatgctggcgctgggggccatcggcgggccgctcctgagccgcctctacttcagcaagggcgggcaccggcagtggctctccgcgtggctcgagaccggcggctggccgctgctgctggttcccgtggcggcgtcgttcggcgcccggcgcgcgcgcgaccggggcgccccggtgctgctcaccccgccgcggatcctgctggccgccgcgggcctcggcgtcgccacgggcgtggacgacttcgtctacgcctacgggctggcgtacctccccgtgtccacctccgcgatcctgatctcgacgcagctggcgttcacggtgttcttcgcgttcctggtggtgcggcagcgcctgacggccgcgtccgtgaacgccgtggcgctgctgacggtgggcgccgtggtgctgggcctgcacgtctcgtcggaccggcccccgggcgtcaccaggggccggtactggctgggcttctcgctgacgctctgcgccgcagcgctttacggcctcgtcctgccgctggtggagctcgcgtacaggcgcgccgcgggcggtggccgcgccgtgacgtacgcgctggtggtggagatgcagctggtgatggggttcttcgccaccgccttctgcacggtaggcatggtcgtgaacaaagacttccaggcgatcccgagggaggcgaggcagtacgagctgggggaggcccggtactacatggtgctggcgtgggcggcggtgctgtggcagtgcttcttcctgggcgcggtgggcgtcatcttctgcgtgcacacgctgctggcgggcatcctcatcgccgtgttcatcccggtgacggaggtggcggccgtcatcttcctgcacgagaagttcagcagcgagaagggcgtggcgctggcgctctcgctctggggcctcgcgtcctactcctacggcgagtggagccaggccaaggccaagaaggagaagaagagcgaggaggacgacggcgaagtggcccaggcagtcccatgatccgtgccccacacacacaaacacaatggtctgccccgttgtactctctgtctgtgtgtatgtaaatgttgtgttgattgcggccgtgttggtcctgtgaatggcgtcctgagtcgtcggttgtcagtgatgtttgatttccagggattaatcttttgtctctttattttt

SEQ ID NO: 1579 - DNA, 2106 bp, Zea mays
aatccgctccgggcgtcatcgttgtatccaaagcgccgtgctagattccacacctagacaggacgccgcacacggcagccaccctcgtgtgcgtgactgcgtctcgcgcgggcaagagtgcgcaggcagagccatggacgtagaagcgcgtaagtccgacgcgccgcccgcgcgcggcaaggcgatgcaccgctttctcgtagcgctcaactgcgggatgctggcggtgggagccatcggcgggccgctcctgagccggctctacttcagcaagggcgggcaccggcagtggctgtccgcgtggctggagaccggcgggtggccgctgctggtgattcccgtggcggcgtcgttcgtggcccgccgcgcgcgcgacaggggcgccccggtcctgctcgcgccgccgcggatcctgctggccgccgcgggcctcggcgtggccacgggcgcggacgacttcatctacgccttcgggctcgcgtacctcccggtgtccacgtccgcgatcctgatctcgacgcagctggcgttcacggtgttcttcgcgttcctcgtggtgcggcagcgcctgacggccgcgtccgtgaacgccgtggcgctgctgacggtgggcgccgtggtgctgggcctgcacgtctcgtcggaccggcccccgggcgtcaccaggggccagtactggctgggcttcgtgctgacgctcggcgccgcggcgctctacggcctcgtcctgccgctcgtggagctcgcctacaggcgcgccgcgggcgccggcggccgcgccgtgacgtacgcgctggtggtggagatgcagctggtgatgggcttcttcgccaccgcgttctgcaccgtcggcatggtcgtcaacaaggatttccaggcgatcccgcgggaggcgaggcggtacaagcttggggaggcgcggtactacgcggtgctggcgtggtcggcggtgctgtggcagtgcttcttcctgggcgcggtgggcgtcatcttctgcgtgcacacgctgctggcgggcatcctcatcgcggtgttcatcccggtgacggaggtggcggccgtcatcttcctgcgcgagaggttcagtagcgagaaaggcgtggcgctggtgctctcgctctggggcctcgcgtcctactcctacggcgagtggagcgaggccagggccaagaagaggaagaccaggacggaggagggcgccgcagccgcggaggccctgcagcaggcgaacccgtgatgctgctgcggactttggcctggcctcttcgatcttccccgttgtgtgtatatcagtatatgttgtgattgtgatcgctgctgtgtgctacgtggatagcgtcctgaatcgtcgtcacctgcagctgtcgcttctggtgtgggtgctcttctgttcggcggtggacgttggccaatactgtgctgcatggtgtgtagatgtaccttggcagtaccacgttcggttcggacagtaagtctggaccggcgcactttgtgggccgatcccagtacaggactgatctaatctgaacgaatataaaaaaaagaagaaatgtctgtttctatgtgttactttctgttgctaccttgcacgcctgaagaaaatcagctactgggattgggcaacaggccaacagtttgacgcaccgtgcggtgccacgaaggttatgcatgatgtatatgcattattatgggactaccattctgaaatggaacagaggggcagaggtcatccaaacctcggctgcactgcacaacgtgcaaaagtgcaaccagtccttattcagcaatatatgagcgtcggcggtgaaactagctgctccagaattactagccatatctacgcggagaggagctgctcacggcgggccttgttggcggcgaggagcctgtccctgtcgggcagggccgccttcaccacgtcaagggcgaggaaccgaccgaaccaggccttcatcagcggcagctcctcgtgggtgacgacgctggcgccggtcacctcctcgatgacggggagccagtgcgcgaaccacccgacgacgatgtcgaggtagcccacggcgtcgccgccgaagaacttcttcccctccaaggccgtctccagggtct

SEQ ID NO: 1580 - DNA, 1495 bp, Secale cereale
ccatcgttgtatccaaagcgccgtgcgcacttgcttccaagaatggagtcctagacaaacgccatccagctaccgcacccagcggtcagacacgcgcgcacccccgaagcgtaggcatggacgtggaggcggccaaggacgacgaccagcgccccgcggcaccggcggcgcgcggcaaggcgatgcagcggctcctggtggcgctcaactgcgggatgctgacgctgggcaccacgggcgggccgctcctgagccgcctctacttcagcaagggcgggcaccggaagtggctctcggcgtggctcgagaccggcggctggccgctgctgctgctccccgtggcggcgtcgtacctcagccggcgcgcgcacgaccccagcgcgccagtggtgctgaccccgccgaggatcctcctggccgccgcggggctcgggctggcgaccggcgccgacgacttcctgtacgcgtacgggctgtcgttcgtgccggtgtccacctcggcgatcctcatctccacgcagctggccttcaccgtgttgttcgcgttcctcatcgtgcggcagcggctgacggcgctgtcggtgaacgccgtggctttgctcaccgtgggcgcggtggtgctgggcctgcacgtctcctcggaccgcccggccggggtgaccaaggggcagtactggcttgggttcctgctcaccctgggcgcggcggcgctgtacgggctggtgctgccgctgatcgagctgacgtacaagcgcgcggcgggcggcgggcgcgtggtgacgtacgcgctggtgatggagatgcagctggtgatgggcttcttcgccaccgctttctgcaccgtcggcatggtcgtcaacaacgatttccaggcgatcgcgagggaagcgcgggcgttccagctgggggaggcccggtactacacggtgctggtgtggagcgccatcctgtggcagttcttcttcctgggcgccgtgggcgtcatcttctgcgtgcacaccctcttcgccgggatcctcatcgccgtcttcatcccggtcaccgaggtgctggccgtcatcttcctgcatgagaagttcagcagcgagaagggcgtggcgctcgtgctctcgctgtggggcctcgcctcctactcctacggggagtacagcgacgccaaggcggccaagaagaaagcggccttggatgcacaggcctcatgactaatagcactttgatttgtataagctcatctttttttttgttactaataactatgatttgtactgttgtgctcgtctacttgcatacataacctgcaggtgccgacgtatttatagttaccagatatagaaaaaaaaaaaaaaaaaaaaaaaaaaaaaaaacaaaaaaaaataaaacaacacacacaacacacaccacacaccacagcacagtacaccactcaccacataccgacacaccagagagccgacgtcagcgaccgctaccagactagacgatgaccgtactagca

SEQ ID NO: 1581 - DNA, 1564 bp, Hordeum vulgare
aaaagcttattcgattcatatcctcagctaggcagccggccggccggcatcatcgttgtctccaaagtgccgtgcgcactagcttccaaaaatggagtcctagacaaacgccatccatcctaccagctacccagcaggccagcactcacacgacgcgcgcaccctcgtaacgcaggcatggacgtggaggcgcccaaggacgacgagcagcggcccgcgccgccggcgcgcggcaaggcgatgcagcggctcctggtggcgctcaactgcggcatgctgacgctgggcaccacgggcgggccgctcctgagccgcctctacttcagcaagggcgggcaccggaagtggctgtcggcgtggctcgagacgggcggctggccgctgctgttgctccccgtggcggcgtcgtacctgcgccggcgcgcgcaggaccccagcgcgcccgtggtgctggccccgccgaggatactcgtggcggccgcggggctcgggctggcgaccggcgccgacgacttcctgtacgcgtacgggctgtcgttcgtgcccgtgtccacctcggcgatcctcatctccacgcagctcgccttcaccgtcctgttcgcgttcctcatcgtgcggcagcggctgacggcgctgtcggtgaacgcggtggcgctgctcaccgtgggcgccgtggtgctgggcctgcacgtctcctccgaccgccccgccggggtgaccagggggcagtactggctggggttcctgctcaccctcggctccgccgcgctgtacgggctggtgctgccgctcatcgagctgacctacaagcgggccgcgggcggcggccgcgtggtgacctacgcgctggtcatggagatgcagctggtgatgggcttcttcgccaccgctttctgcaccgtcggcatgatcgtcaacaacgatttccaggcgatggcgagggaggcgcgggcgttcgagctgggggaggcccggtactacacggtgctggtgtggagcgccatcctgtggcagttcttcttcctgggcgccgtgggcgtcatcttctgcgtccacaccctcttcgccgggatcctcatcgccgtcttcatcccggtgacggaggtgctggccgtcatcttcctgcacgagaagttcagcagcgagaagggcgtcgcgctcgtgctctcgctctggggcctcgcctcctactcctacggcgagtacagcgacgccaaggccgccaagaagaaagcggccttggacgcccaggcctcgtgactaatattagtgcactttgatttgtaagctcgttttctgttttccgtccaggaattctgatttgtattgctgtgcttgtctgctcgtaacgcgtatatatgcataacctgcagttgcaggcgtgttggtttccaggaagtatgggaaacaaatcaaggccacggagaagagaagcggccatggatgcacaggactcgtggctatattctgctttgtcaaattatgtttttgttttggagaagtgttggggttaaataaaaaggtgcaaggatgcatcacaattggtgctagattcccattagag

SEQ ID NO: 1582 - DNA, 1636 bp, Triticum aestivum
cttcgtagatctttgcactagtaggtgtagcattattgtttggcaatgaatgtacaaatgagtggcaaactcatgtcagtagctaaaactttgtcaattcatatcctcagcccgccggccggcgccatcgttgtctccaaagcgccgtgcgcactagcttccaaaaatggagtcctagacaagcgccatccagctaccgtacccagcactcagacacgcgcaggcgcaccctcgcaacgtaggcatggacgtggaggcgcccaaggacgacgaccagcgccccgcgccgccggcgcgcggcaaggcgatgcagcggttcctggtggcgctcaactgcgggatgctcacgctgggcaccacgggcgggccgctcctcagccgcctctacttcagcaagggcgggcaccggaagtggctgtccgcgtggctcgagaccggcggctggccgctgctgctgctccccgtggcggcgtcgtacctcagccggcgcgcgcacgaccccagcgcgccggtggtgctgaccccgccgaggatactgctcgccgccgcggggctcgggctggcgaccggcgccgacgacttcctgtacgcgtacgggctgtcgttcgtgcccgtgtccacctccgcgatcctcatctccacgcagctggccttcaccgtcttcttcgcgttcctgatcgtgcggcagcggctgacggcgctgtcggtgaacgcggtggcgctgctgaccgtgggcgccgtggtgctggggctgcacgtgtcctcggaccgccccgccggggtgaccaaggggcagtactggctggggttcctgctgaccctggccgcggcggcgctgtacgggctggtgctgccgctgatcgagctgacctacaagcgggccgcgggcggcgggcgcgtggtgacctacgcgctggtgatggagatgcagctggtgatgggcttcttcgccaccgctttctgcaccgtcggcatgatcgtcaacaacgacttccaggcgatctcaagggaagcgcaggcattcgagctgggggaggcccggtactacacggtgctggtgtggagcgccatcctgtggcagttcttcttcctgggcgccgtgggcgtcatcttctgcgtccacaccctgttcgccgggatcctcatcgccgtcttcatcccggtcacggaggtgctggccgtcatcttcctgcacgagaagttcaccagcgagaagggcgtggcgctcgcgctctcgctctggggcctcgcctcctactcctacggcgagtacagcgacgccaaggcggccaagaagaaagcggccttggatgcccaagcctcgtgactaatagtacacttcgatttggaaactcattttatgtttttcttcaagaattgtgatttggattgttgtgcttgtctactcgtaaggcatacataacctgccaccagtggtaaatggcacggttattgtcatgacccaaaatttcagaacctggtaaaaaatactgatttttgtcctattagcttatgtaatgttatttacaaagttattccaaagtgcctagtcaataggcttaggccagttctggatgatattatttctccctccgaaagtgcttttattccaagatatatgatcaccgataatgct

SEQ ID NO: 1583 - DNA, 1456 bp, Triticum aestivum
gagacaagcgccctccagctaccgttcccagcactcagacacgcgcaggcgcaccctcgcaacgtaggcatggacgtggaggcgcccaaggacgacgaccagcgccccgcgccgccggcgcacggcaaggcgatgcagcggttcctggtggcgctcaactgcgggatgctcacgctgggcaccacgggcgggccgctcctcagccgcctctacttcagcaagggcgggcaccgaaagtggctgtcggcgtggctcgagaccggcggctggccgctgctgctgctccccgtggcggcctcctacctcagccggcgcgcgcacgaccccagcgcgccggtggtgctgaccccgccgaggatactgctcgccgccgcggggctcggtctggccaccggcgccgacgacttcctgtacgcgtacgggctgtcgttcgtgcccgtgtccacctccgcgatcctcatctccacgcagctggccttcaccgtcttcttcgcgttcctgatcgtgcggcagcggctgacggcgctgtcggtgaacgcggtggcgctgctcaccgtgggcgccgtggtgctggggctgcacgtctcctccgaccgccccgccggggtgaccaaggggcagtactggctggggttcctgctgaccctggccgcggcggcgctgtacgggctggtgctgccgctgatcgagctgacctacaagcgggccgcgggcggcgggcgcgtggtgacctacgcgctggtgatggagatgcagctggtgatgggcttcttcgccaccgccttctgcaccgtcggcatgatcgtcaacaacgacttccaggcgatctcaagggaagcgcaggcattcgagctaggggaggcccggtactacacggtgctggtgtggagcgccatcctgtggcagttcttcttcctgggcgccgtgggcgtcatcttctgcgtccacaccctgttcgccgggatcctcatcgccgtcttcatcccggtcacggaggtgctggccgtcatcttcctgcacgagaagttcaccagcgagaagggcgtggcgctcgcgctctcgctctggggcctcgcctcctactcctacggcgagtacagcgacgccaaggcggccaagaagaaagcggccttggatgcccaagcctcgtgactaatagtacacttcgatttggaaactcattttatgttttccttccagaattgtgatttggattgttgtgcttgtctactcgtaaggcatacataacctgccaccagtggtaaatggcacggttattgtcatgacccaaaatttcagaacctggtaaaaaaatactgatttttgtcctattagcttatgtaatgttatttacaaagttattccaaagtgcctagtcaataggcttaggccagttctggatgatattatttctccctctgaaagtgctttcattccaaaaaaaaaaaaaaaacga

SEQ ID NO: 1584 - DNA, 3640 bp, Oryza sativa
aactccacaagatctgttttaatccaacttaacaaattgagcttcaaaaaggtcagttttaaattattcttttactaagttaaacatgtctaatttaatcattaattatataaactcgtgtagtttaacaacatgtgtttaatattaaattcgtgaaaattatacttaaaaaacaaaaagtcacatggaaggaataccaaatatgctcatcatttctgaataacttaaaaaaatattattattatttgtaaatggaaggagtacttcttaatagctcctctgtatgttgatcactaatgcatgatcgttaatctgatggatcgtattatcatgaacgtagatcgtgttgagagtccgtgttaaataaattatgcaattgaaaatagtgtacccgtctcgaatcttaattttactatgttttattaatttaactcaaaaaccaaacttagtaattaataaattataattgatgtggactcttcttttaatacaagaagctagtgaccacatgtttcacgtaatactcctaggattttaatggagacatagggtagcaatcgacaaacccgaaactccccaaaatgacaactcagttgatttattgctaaaaattcatatagattctaaccaattaatataagattcttgcatttatctatttgtcatgtaggaataacaatgtttctcttgtccccaccgctagctcatagctcaaataattaaataggtatagatgactatggtctcctgaaagcgtatgctttctttcgttcctctccttccttattacttatgggacacagatggatcggtagaatgtccacttttctggatggaggaagtagccatgacgctaagatgactcccgaataaaatgtctagacatgccaataaaaataaatttcaacttctaaacacaacctatgaaataaagattaacaaagttgatagtgctagcacgataaaattatatgcttggactgtctggagagtgcacggattgtacctctccttgatcatgctcgacaacgccagaggtgaatatgcgcctgtaatatggtcaatgatatgatggcaacaatacgaaccccagattatctgacaaaaaacagagtagctacccatcgatcaatcctgaaatggcctttgatgatgctgcctcattcaacatgacagcgattgccaaacacactgacaattgaaagggataaggcaaatcataaagctcgtgccagtattatactacgtgcccgtggcgatatatatatcaagtagtcaaaacttgcttaacttgtgccaaagatttcttagccacataaatcatggcaaataccacagcttagatatcaaattttgacaaagtgaaacaaacaatctagtcatgccatgcgtttatgttcctcagctaatactgtgttgcaagcctgagaaggacccgcgcgtgcccgtccattgtgatccgatggaatcaattattggagtagatattgcctcaaccagtgacacaacgacgatggccattgtttaaaagatcatctattgctttcaatccggccattaatcgtttaactttgatggtcatgtccaagtgttcaggggtggggttccctgttgtttttgtcgtggctagctgggtgtgttagagatgtctggactttgtttttgttctcgtctaatatgcaatttgttttgaatgttatatttaacaaaactaatttagtggtgtagatattgaagaatattttaataatccgatcaagcttacaagaattcatttggaaaaaagttagagcatcttatataatataaaacgaataaaacgaagtgagtacatcactagcttaccatgctctaaacaacgaaccttttatcaccatccatcgcaatagcgacgtgcgcgcgcgcccgcaccatatgtagatcgactgtatatatccgtagccagcgtcgtcaccgtcgttgtatccaaagctacccacttctgctgttgtgctaccctccaaagctggagtcctagctaggcagacggcagcaagcctgtcccgcgcgccctcgagctgtgatcctcacgcaacacgcgcacggcgtaggtagcgcggctagccctgcacgcgtgggcatggacgtggaggcgaccaaggacgtggtccacgagcaggcggcggcgccggggcgcggcagggcggcgcgatggctcctcgtggcgctcaactgcgggatgctggtggtgggcaccacgggcgggccgatccttagccggctctacttcagcaagggcggccacaggaagtggctctcggcgtggctcgagaccgccgggtggccgctgctgctggtgcccgtgtcggcgtcctaccacagccgccgcgcgcgcgaccgcggcgcgccgctgttcctcacgccgcggcgcgtgctgctggcgggcgcggtgctcggcgtcctcaccggcgccgacgacttcgtctacgcctacggcctcgcctacctgccggtgtccacctccgccatcctcatctccacgcagctcgcgttcaccgtcttcttcgcgtgcctcatcgtgcggcagcggctcaccgcggcgacgctgaacgccgtggcgctgctcactatcggcgccgtcgtgctgggcctccacgcgtccaaggaccgacccgccggggtgaccaccgggaagtactggatgggcttcttcctcaccctcggcgccgccgcgctgtacgggctcatcctgccgctcgtcgagctcgcgtacaagcacgccgcgggcggcggccgcgccgtcacgtacgcgctggtgatggagatgcagctggtcatgggcttcttcgccaccgcgttctgtaccgtcggtgtgatcgtcaacaaggacttccaggcgatcccgagggaggcgaagcagtacgagctgggtgaagcgcggtactacgtggtgctggtgttcaacgccgtcctgtgggagttcttcttcgtgggcgccgtcggcgtcatcttctgcgtgcacacgctgctcgccgggatcatcatcgccgtgttcatcccgatcacggaggtgctgggcgtcatcttcctccacgagaagttcagcagcgagaagggcgtggcgctcgtgctctcgctctggggcctcgcctcctactcctacggcgagtacgccgacgccaaggccaagaagaaagcggctttggaagctgaagaagcctcatgaatccgtgtgtatatattgcttactttgcttttgttgtgccagtggccacggatttattagtttttataggccataaagtgagctgcatctgcagcagttcaactgctcgtggagcaaaatagcagactgtgtgcacattgcactatttgtgtactgtatgtgatcgaggctgtttttgtgggtcggcgaaaacaagctacttcactgtatctgtaatgactgagtacggtgcaatgtttgttcttgtactcactttttgttcttattaatctggtcatgcatgtccatgaccaatctaccattttgtgtactgtgtactctagtgaatgtggacatctggactacatgcaagcctatattgtgacctgttggaattatttattctcgggatctaattgcttagcttaacacatgattaccaattctaaatacgaa

SEQ ID NO: 1585 - DNA, 1506 bp, Oryza sativa
tgtagtgtatccaaagctcgcgccgtggaagctagctacccacttcagctaccctccaaatctggtctcctaggctgtgaatctgtgatccgcaccgcacgcaacacgcgtgcgtgggcatggacgtggaggcgaccaaggacgtgggccacgagcaggcggcggtgccggggcgtggcagggcggcgcgatggctccttgtggcgctcaactgtgggatgctggtggtgggcaccacgggcgggccgctcatcagccgcctctacttcagcaagggcggccataggcagtggctctcggcgtggctccagaccgccgggtggccgctgctgctggtgcccgtggcggcgtcctacctcagccgccgcgcgcgagaccgccgcgcgccgctgtttctcacgccgacgcgcgtgctgctggcgggcgtcgggctcgggttcctcaatggcgccgacgactttatatacgcctacggcctcgcctacctgccggtgtccacctccgccatcctcatctccacgcagctcgcgttcaccgtcttcttcgcgtgcctcatcgtgcggcagcggttcaccgcggcgacgctgaacgccgtggcgctgctcactatcggcgccgtcgtgctgggcctgcacgcgtccaaggaccgccccgccggggttaccagtgggaagtactggatgggcttcttcctcaccctcggcgccgccgcgctgtacgggctcatcctgccgctcgtcgagctcgcgtacaagcacgccgcgggaggcggccgcgccgtcacgtacgcgctggtgatggagatgcagctggtcatgggcttcttcgccaccgcgttctgcaccgtcggcatggtcgtcaacaaggacttccaggcgatcccgagggaggcgaagcagtacgagctgggtgaagcgcggtactacgtggtgctggtgttcaacgccgtcctgtgggagttcttcttcgtgggcgccgtcggcgtcatcttctgcgtgcacacgctgctcgccgggatcatcatcgccgtgttcatcccgatcacggaggtgctgggcgtcatcttcctccacgagaagttcagcagcgagaagggcgtggcgctcgtgctctcgctctggggcctcgcctcctactcctacggcgagtacgccgacgccaaggccaagaagaaagcggctttggaagctgaagaagcctcatgaatccgtgtgtatatattgcttactttgcttttgttgtgccagtggccacggatttattagtttttataggccataaagtgagctgcatctgcagcagttcaactgctcgtggagcaaaatagcagactgtgtgcacattgcactatttgtgtactgtatgtgatcgaggctgtttttgtgggtcggcgaaaacaagctacttcactgtatctgtaatgactgagtacggtgcaatgtttgttcttgtactcactttttgttcttattaatctggtcatgcatgtccatgaccaatctacca

SEQ ID NO: 1586 - DNA, 3149 bp, Setaria italica
cttcacccaaacggcggaggacggaaacggaagcccgaatagaaaagcgtgctcttttttcatcctctcgtgtgtgtgcgtgcgtgcgtgcgccccccttcctgcctccccccacctcgcgatcccaattcgatccgctcgcctgccctcccgatccgccgcgccctccccggccgcccaattcggccgccgccgcccggattcgcgtgggcccgcccgcggattcgcgctccccggcgcgccaaaccctagatccgccgccgctcatcccgccgccgccatgttctggcgcatgaccggcctctccgcggcctcgcccgtggatacaattctggacaaagaaaattttacgttggaagaacttcttgatgaggatgaaattattcaggagtgcaaagcactgaattcacgactcataaacttcttacgtgacaaggcccaggtggaacagttgcttcgttatgttgtggaagaagttccagaggacaatgaaaaaaagcgctctttcaagttcccttttattgcttgtgaaatatttacttgtgaaattgatgtcgttttgaggaccctagtcgaggatgaagagctaatggacttgcttttctcatttgtgaaacctgatcatccacatagcacactattatctggttatttcagtaaggttgtaatatgcttgatgctgcggaagactgccccacttatgaattatgttcaggggcatccagagatagttgtccagcttgttgacctgattggcatcacatcaataatggaggtgctgatacgactgattggtgctgatgagaacatatactcaaactacggtgatacattgcagtggttagaaaatacagatgtccttgaaatgattgctgataagtttagctcatcggattctcctgaagtgcatgccaatgctgcagaaattctatgtgcagtgacacgatgtgcacctccatctcttgctgcaaagatatgcagtccaagttttgttggaaggttgttccatcatgcttttgaagaatcaagaccgaaatctgttctggttcattcgttgtctgtgtgcatatcattgctggatccaaaaagacttgcatcagcttcctatcaagcattcagaagcaacttaagtcatggggcattggtcactgccagtccagagacagttgatggcatgcttgagagcctaggcaacttgctgatgttattggacacttctgctgctgaaaatgtattgccaacaacttatggatgtttacgcccacctcttggcaaacatcgtctgaagattgtagagttcatctctgtgctgcttacaattggtagtgaaactgctgaaaaggagctaataaggcaatcagcaataaagcgctcaattgatttgttctttgagtacccatataataactttttgcaccaccatgttgaaaatataattgtttcttgcctggagggtaaaagaactgaacttgttgagcatgttcttaacgagtgtgacattgttggtaaaattcttgttgcggaaagactttcttctttgtcgacagagtctaacgggcctaccataccctcggaagagaaagcccctccaagaattgggaatgttggtcacatgacaaggatagccaataagcttattcagttgggaaatagtaacagcacaatccaggcacatttacaggaaaataccgagtgggttgaatggcaaacaaatgtgctggtcaaacgcaatgaagtggagaatgtttatcactgggcttgtgggcgcccaacatcattacatgatcgtggtagggatagtgatgatgacgacttccgagacagggattatgatgtggcagctcttgctaataacttgagtcaagcattccgttatgggatatacagcaacgatgacattgaagaggcacaaggatcacttgaacgcgatgatgaggatgtgtattttgacgatgaatcagctgaggtggtaatatcttctctgcgtctgggagatgaccaggacggctccctctttacaaattcaaactggttcacatttgatggagagagaggcatcaatgaccgtatatccgattctgttccctcatcgtcacccaattctgaggagatatccctagagaccgaggaagctgatgatggtaaagtcattggcactgaggatgaaatggaaaccgtttgccttggaaatgggagtacagaggaggcaaaggatgtagcagaatgtgtcgaacagctaaattgtagtacagcgaatgagccgttgcaaaatacagacagtctggaacggcattcagatgtttcaaatggcagtaccgaagtaggtacagccgcagcggcagaatcttcagccccatcagttgagattgcggcagaatcttcagccccatcagttgagatagcggcagagaaaacggcagatgaaccattaatggtagagagaacagtaggtgaaccagcagtctcatctgatctggacaattctatctctgaagctacaccgggtgctaatggaagtgagcctgctgaccctgaagtatcttctgaacaagttggcaatgacactgatgtacagcaaccagtaaaggaagttgctggtgaggatgttgatgaaacaaaaactgatgcagtcaaagcaagcgactgaagtagcaacatgtcgaattagagcaattacttgtgaactcggcggtctgcatgattttgcttcatgtctgctcagaagccacggaatagtccgaagcaaactgctgtacaataagcaagtgtattgttctgccatccaccgtggcatatcactgtacaaatgagcaccattgactaaggcacgctcaccgtgttgtctgaaactggtcattttctttgaaatttacctccagttcatgtgctctggtctggtggcagtcttcgtgaagttgtatgtgatacctgaaagaacattctttgagtggcaactggttttggctacgtagtcttctgtttctttaggttaactgtggaactgtaatatgatgtcatattatttctagtctagctattgttgtaagtttattcagactctacatgtttcagttcaccttgaacatgttattttttataaagattcccggccccatgtattcaattcttaaagacttgtttgatcaacg

SEQ ID NO: 1587 - DNA, 3143 bp, Sorghum bicolor
cttccccaaacggaggaaggaaacggaagccaaatagaaaagcgtgctcttttttcatcctctcgtgtgtgtgcgagcgtgcgcctgcttcccccatctcgcgatcccaattcgatccgctcgcctgctctcccgatccgacccgccctccgcggccgggcaattcggccgccgctgctcggattcgcgcggagccgcatcagattcgcgcttcccggcgccaccaaaccctagatccgccgccgctcgtcgcaccgccgccgccatgttctggcgcatgaccggcctctccgcggcctcgcccgtggatacaattctggacaaagaaaattttacattggaagaacttcttgacgaggatgaaattattcaggagtgcaaagcactgaactcgcgactcataaacttcttacgtgacaaggcccaggtggaacagttgcttcgttatgttgtggaagaagttccagaggatgctgaaaggaagcgctctttcaagttcccttttattgcttgcgaaatatttacttgcgaaatcgatgtcattttgaggaccctagtagaggatgaagagctaatggacttgcttttctcatttgtgaaacctgatcatccgcatagtacattattgtctggttacttcagtaaggtggtaatatgtttgatgctgcggaagactgctccacttatgagttatgttcaggggcatccagagatagttgtccagcttgttgacctgattggcatcacatcgatcatggaggtgctgatacgactgattggtgctgatgaggccatatattcaaactatggtgatacgttacagtggttagaaaatacagatgtccttgaaatgattgcagataagtttagctcatcggattctcctgaagttcatgccaatgctgcggaaattctatgtgcagttactcggtgtgcacctccatctcttgctgcgaaaatatgcagtccaagttttgttgggaggttgttccatcatgctcttgaagaatcaagacccaaatctgttctggttcattcactgtcagtgtgcatatctttgctggatccgaaaagactagcatcagcttcgtatcaagcattcagaagcaacttaactcatggggcattggtcacggccagtccagagacagttgacggtatgcttgagagtctaggcaacttgctgaagttattggacacttcggctgctgaaagcgtgttgccaacaacttatggatgtttacgcccacctcttgggaaacatcgtctgaagattgtagaattcatctctgtgctgcttacaattggaagtgagactgctgaaaaagagctaattaggcagtcagcaataaagcgctcgattgatttattctttgagtatccatataacaactttttgcaccatcatgttgagaatataatcgtttcttgccttgagggtaaaagacctgaagttgttgatcatgttcttcatgaatgtgatattgttggtaaaattcttgtttcagaaaggctttcatctttgtcgattgagtctaatgggcctactgttccctctgaagggaaaacacctccaagaattggaaatgttggtcacatgacgagaatagccaataagcttattcagttgggcaacagtaacaacacaatccaggctcacttatgggaaaataatgagtgggttgaatggcaaacaaatgtgctggtcaaacgcaatgaagtggagaatgtttatcattgggcttgtgggcgcccgacatcattacatgaccgtggtagggacagtgatgatgatgacttccgggacagggattacgatgtggcagctcttgctaataatttaagtcaggcatttcgttatgggatatacagcaatgatgacattgaagaggcacaaggatcacttgaacgagatgatgaggatgtgtattttgatgatgaatcagctgaggtggtgatatcttctttgcgactgggagatgaccaggacggctccctctttacaaattcaaactggttcacatttgatggagagagaggcattgatgaccgtacatctgcctctgttccttcatcatcacccaattctgaggagatttcaccagagaccgaggaagctgatgatggtaaagtaattggcactgaggatgaaatggaaacagtatatcttggaaatggtagtgctgaggaggtaaaagatgtagcagaatgtactgaacaggcaaactgttgtactgaggatgagcgattgaaaaatacagaagggatggagcggcatccagatgcttcaaataatgataccgacatatgcacaaatgaggctgcctctgctgcagcagaatcttcagccccatcggttgagaaagcggcagaaaaaacagtagatgaaccattggaggcagaaagaacagtggatgaaccggcagaatcatctttggacagttctgtctctgtagctttgccagctcctgttaatggtagtgagcctgccaactcggaagcttcttccgaacaagttgcccatgacactgatgtgcagcaaccagtcaaggaagcccctgccgaggatgttgatgcaaagaaaactgatggagccaaagcaagcgagtgaattagcaacatgttggacttagctgatcagagcaattacttgtgaactgaaactctgtagagtgtagcctgggcattgatcttgcttcatgtgtgctcagctgccacaggatagtctgaagcaaactgctgtacaataagcaagtgattgttctgccatcaaccgtggcatatcactgtacaaatgaccaccattgactaacgcacgtaagtcgccttgtctgaaactggtcattttctttgaaattcaccctccagttcatgtgctttggtggcggtcttaatggcatggtatatgatacctgaaagaacattctttggttggcactggttttggctacttagtcttctgttgctttaggttaactttggaactgtaatatgagatgtgatgttatttctagtctagctattgttgtaattttttcggactctacatgtgtcagttcgacttgaacatgttatttttttataaagattcgttactgtatttgaagacttctcttgatcgacggctcctcgtttccatcccc

SEQ ID NO: 1588 - DNA, 3329 bp, Sorghum bicolor
cggctacctgccacgatgaaagtaacagcgcccggtcgcagaacaaacacatgacggctaaagaccaaaaccaatcccaattaaccccaatccagcccaaatcaaacttccccaaacggaggaaggaaacggaagccaaatagaaaagcgtgctcttttttcatcctctcgtgtgtgtgcgagcgtgcgcctgcttcccccatctcgcgatcccaattcgatccgctcgcctgctctcccgatccgacccgccctccgcggccgggcaattcggccgccgctgctcggattcgcgcggagccgcatcagattcgcgcttcccggcgccaccaaaccctagatccgccgccgctcgtcgcaccgccgccgccatgttctggcgcatgaccggcctctccgcggcctcgcccgtggatacaattctggacaaagaaaattttacattggaagaacttcttgacgaggatgaaattattcaggagtgcaaagcactgaactcgcgactcataaacttcttacgtgacaaggcccaggtggaacagttgcttcgttatgttgtggaagaagttccagaggatgctgaaaggaagcgctctttcaagttcccttttattgcttgcgaaatatttacttgcgaaatcgatgtcattttgaggaccctagtagaggatgaagagctaatggacttgcttttctcatttgtgaaacctgatcatccgcatagtacattattgtctggttacttcagtaaggtggtaatatgtttgatgctgcggaagactgctccacttatgagttatgttcaggggcatccagagatagttgtccagcttgttgacctgattggcatcacatcgatcatggaggtgctgatacgactgattggtgctgatgaggccatatattcaaactatggtgatacgttacagtggttagaaaatacagatgtccttgaaatgattgcagataagtttagctcatcggattctcctgaagttcatgccaatgctgcggaaattctatgtgcagttactcggtgtgcacctccatctcttgctgcgaaaatatgcagtccaagttttgttgggaggttgttccatcatgctcttgaagaatcaagacccaaatctgttctggttcattcactgtcagtgtgcatatctttgctggatccgaaaagactagcatcagcttcgtatcaagcattcagaagcaacttaactcatggggcattggtcacggccagtccagagacagttgacggtatgcttgagagtctaggcaacttgctgaagttattggacacttcggctgctgaaagcgtgttgccaacaacttatggatgtttacgcccacctcttgggaaacatcgtctgaagattgtagaattcatctctgtgctgcttacaattggaagtgagactgctgaaaaagagctaattaggcagtcagcaataaagcgctcgattgatttattctttgagtatccatataacaactttttgcaccatcatgttgagaatataatcgtttcttgccttgagggtaaaagacctgaagttgttgatcatgttcttcatgaatgtgatattgttggtaaaattcttgtttcagaaaggctttcatctttgtcgattgagtctaatgggcctactgttccctctgaagggaaaacacctccaagaattggaaatgttggtcacatgacgagaatagccaataagcttattcagttgggcaacagtaacaacacaatccaggctcacttatgggaaaataatgagtgggttgaatggcaaacaaatgtgctggtcaaacgcaatgaagtggagaatgtttatcattgggcttgtgggcgcccgacatcattacatgaccgtggtagggacagtgatgatgatgacttccgggacagggattacgatgtggcagctcttgctaataatttaagtcaggcatttcgttatgggatatacagcaatgatgacattgaagaggcacaaggatcacttgaacgagatgatgaggatgtgtattttgatgatgaatcagctgaggtggtgatatcttctttgcgactgggagatgaccaggacggctccctctttacaaattcaaactggttcacatttgatggagagagaggcattgatgaccgtacatctgcctctgttccttcatcatcacccaattctgaggagatttcaccagagaccgaggaagctgatgatggtaaagtaattggcactgaggatgaaatggaaacagtatatcttggaaatggtagtgctgaggaggtaaaagatgtagcagaatgtactgaacaggcaaactgttgtactgaggatgagcgattgaaaaatacagaagggatggagcggcatccagatgcttcaaataatgataccgacatatgcacaaatgaggctgcctctgctgcagcagaatcttcagccccatcggttgagaaagcggcagaaaaaacagtagatgaaccattggaggcagaaagaacagtggatgaaccggcagaatcatctttggacagttctgtctctgtagctttgccagctcctgttaatggtagtgagcctgccaactcggaagcttcttccgaacaagttgcccatgacactgatgtgcagcaaccagtcaaggaagcccctgccgaggatgttgatgcaaagaaaactgatggagccaaagcaagcgagtgaattagcaacatgttggacttagctgatcagagcaattacttgtgaactgaaactctgtagagtgtagcctgggcattgatcttgcttcatgtgtgctcagctgccacaggatagtctgaagcaaactgctgtacaataagcaagtgattgttctgccatcaaccgtggcatatcactgtacaaatgaccaccattgactaacgcacgtaagtcgccttgtctgaaactggtcattttctttgaaattcaccctccagttcatgtgctttggtggcggtcttaatggcatggtatatgatacctgaaagaacattctttggttggcactggttttggctacttagtcttctgttgctttaggttaactttggaactgtaatatgagatgtgatgttatttctagtctagctattgttgtaattttttcggactctacatgtgtcagttcgacttgaacatgttatttttttataaagattcgttactgtatttgaagacttctcttgatcgacggctcctcgtttccatccccacgtccgcttatctctctcagttataatcgagagcgtggccgaatttctaagtattttaaatttgaaaacactttttgtc

SEQ ID NO: 1589 - DNA, 3254 bp, Brachypodium distachyon
aaaccaaatcaaacccaaggaaagcccaaatagaaaagcgtgctgttttttcctcctctcgtgcgcctccccaccccgcgatcccaattcgatccgctcgccctcctcccgatccacccgtcctccccggccgccctctcaggccgtcgccgcccggattcgcgcggaatcgcccgcggattcgctctccccggggccggaaaccctagatccgccgccgccgccaccatgttctggcgcatgaccggcctctccgcggcctcgcccgtggatacaattctagacaaggaaaattttacattggaagaacttcttgacgaggatgaaattattcaagagtgcaaagcactgaatacccgactcattaatttcttgcgtgacaaggctcaggtggaacaattgcttcgttatatcgtggaagaagttccagaggatgttgaaaaaaagcgctctttcaagtttcctttcattgcttgtgagatatttacttgtgaaattgatgtcattttgaggaccctagtagaggatgaagagttaatggagttgcttttctcatttgtgaaacctgatcatccacacagcacattattatctggttacttcagtaaggtggtaatttgtttgatgctgcggaagactgcgcctcttatgaattatgtccaggagcatccagagatagttatccaacttgtcgacctgattggcatcacatcgataatggaggtgttgatccgactgattggtgctgatgagaccatatattcaaactatgctgatacaatgcagtggttagaaaatacagatgtccttgggatgattgcagataagtttagctcatcggactctcctgaagtgcatgccaatgctgccgaaattctttgtgcggtgactcgatgtgcacccccatctcttgctgcaaagatatgcagcccaagttttgttgggaggttgttctgtcatgctcttgaaggatcaagacccaaatctgtgctggttcattcattgtcagtgtgcatatctttactggacccaaaaagactagcatcagcttcttatcaagcattcagaagcaacttaagtcatggggcgttggtaactgccagtcctgagacagttgagggcatgctcgagagtctaggcaatttgctgaagttattggacacttctgctgcggaaaatgttttgcctacgacatatggatgtttacgcccacctctgggaaaacatcgactgaagatcgtggagttcatctctgttttgctgacagttggtagcgaaactgctgaaaaggagttaatcaaccaatcagcaataaagcgctccattgatttattctttgagtatccatataacaacttcttgcaccatcatgtcgagaacatcattgtttcttgcctggagggcaaaagaactgaactgattgagcatgttcttaatgaatgtgacattgttggtaaaattcttgctgcagacaaactttcttccttatcaacagagtctaacgggcctactctaccatctgaagggaaaaccccttcaaaaattgggaatgttggccacatgacaagaatagccaataaactcattcagttaggaaacagtaacagcacgatccagactcacttgcaggacaatagtgagtgggttgaatggcagacagatattctggtcaggcgcaacgaggtggagaatgtttatcattgggcttgtgggcgcccaacatcactgcatgaccgtggtagggatagtgacgatgatgacttccgagacagggattatgatgttgcagctcttgctaataacttgagccaggcattccgctatggaatatacagcaatgatgacatcgaagaggcacaaggttcgcttgaacgggatgatgaggatgtctattttgatgacgaatcagctgaggtggtaatatcttctctgcgtctgggagaggaacaggatggctccctgtttacaaattcaaattggttcacgtttgatggagagagaggtatcaatgaccgtttagcagcctctgttccttcgtcctcacccaattctgaggaggtttccccggacgccgaggaaactgatgatggtgaagccattggtactgaggatcaaatggaaactctgtgtcttggaaatggccctaccgaggcagaagatgtggcagaatgtaccaaacagacaaactttagtactgaggatgagcaactaggaagtccagaagggatcgagcggcatccggatgcatcaaatggcgatactgaagttagcacagatgaagctgcctctgctgccgtagaatcttcagccccagcagctgaggagcagacagagagaacagttgataaagccacgggctcatctggtttggacaatcttgtctctgaagctttaccagatcctgatgttaatgttagtgatttggccgattcggcggtatcttccgagcaagctgtatgcaacgaagatgtggagccaccgatcgaaactgatgcagtcgtggatgttgaagcgaaaactgatgcggtcgtggatgttgaagcgaaaactgatgtggttatggatgttgaagcgaaaactgatgcagtcgtggatgttgaagcgaaaactgatgcagtcgtggatgttgaagcgaaaactgatgcagtcatggatctaccagtcaaggaagtttctgccttggatgttgaagcgaaaactggtgtagtagaggcaaatgagtgaagtggaagtatatttgtggactaaaatggcatagctgacgagcaactattaagtcagacctctcagaagacaagaaaccatctttgcttcaggtgctcatcagccagaaagaactctgaagcaaactgctgtacaataagcaagtgtactattttgccttccattgtgaccaatcagtgtacaaatgagcaccttatctaactgcacgcacgacattttgtcagaaactggtcaatttgcttcgaaatttaccctcccggttcctgtggaaagattggttggtgctaaatgtcatttggcaatagtctcgtgtagacgatatgtgaaggacatcattttttggatggcaactggtttgtctacctagtgttttgtttcattaggttaactttggaactgtaatatgggatatggtattatttctagtttagctattgtaattctttctgactcgatgttcgtcagttcaaatagagcatgctatttttgataaatgtttctgccggttctgttcaaccggtctttcaaaa

SEQ ID NO: 1590 - DNA, 3541 bp, Brachypodium distachyon
tgccgtcgtcgccaaaagtaacagcgcccctcaaccccaatccccatctccaaaccaaacaaaaccaaatcaaacccaaggaaagcccaaatagaaaagcgtgctgttttttcctcctctcgtgcgcctccccaccccgcgatcccaattcgatccgctcgccctcctcccgatccacccgtcctccccggccgccctctcaggccgtcgccgcccggattcgcgcggaatcgcccgcggattcgctctccccggggccggaaaccctagatccgccgccgccgccaccatgttctggcgcatgaccggcctctccgcggcctcgcccgtggatacaattctagacaaggaaaattttacattggaagaacttcttgacgaggatgaaattattcaagagtgcaaagcactgaatacccgactcattaatttcttgcgtgacaaggctcaggtggaacaattgcttcgttatatcgtggaagaagttccagaggatgttgaaaaaaagcgctctttcaagtttcctttcattgcttgtgagatatttacttgtgaaattgatgtcattttgaggaccctagtagaggatgaagagttaatggagttgcttttctcatttgtgaaacctgatcatccacacagcacattattatctggttacttcagtaaggtggtaatttgtttgatgctgcggaagactgcgcctcttatgaattatgtccaggagcatccagagatagttatccaacttgtcgacctgattggcatcacatcgataatggaggtgttgatccgactgattggtgctgatgagaccatatattcaaactatgctgatacaatgcagtggttagaaaatacagatgtccttgggatgattgcagataagtttagctcatcggactctcctgaagtgcatgccaatgctgccgaaattctttgtgcggtgactcgatgtgcacccccatctcttgctgcaaagatatgcagcccaagttttgttgggaggttgttctgtcatgctcttgaaggatcaagacccaaatctgtgctggttcattcattgtcagtgtgcatatctttactggacccaaaaagactagcatcagcttcttatcaagcattcagaagcaacttaagtcatggggcgttggtaactgccagtcctgagacagttgagggcatgctcgagagtctaggcaatttgctgaagttattggacacttctgctgcggaaaatgttttgcctacgacatatggatgtttacgcccacctctgggaaaacatcgactgaagatcgtggagttcatctctgttttgctgacagttggtagcgaaactgctgaaaaggagttaatcaaccaatcagcaataaagcgctccattgatttattctttgagtatccatataacaacttcttgcaccatcatgtcgagaacatcattgtttcttgcctggagggcaaaagaactgaactgattgagcatgttcttaatgaatgtgacattgttggtaaaattcttgctgcagacaaactttcttccttatcaacagagtctaacgggcctactctaccatctgaagggaaaaccccttcaaaaattgggaatgttggccacatgacaagaatagccaataaactcattcagttaggaaacagtaacagcacgatccagactcacttgcaggacaatagtgagtgggttgaatggcagacagatattctggtcaggcgcaacgaggtggagaatgtttatcattgggcttgtgggcgcccaacatcactgcatgaccgtggtagggatagtgacgatgatgacttccgagacagggattatgatgttgcagctcttgctaataacttgagccaggcattccgctatggaatatacagcaatgatgacatcgaagaggcacaaggttcgcttgaacgggatgatgaggatgtctattttgatgacgaatcagctgaggtggtaatatcttctctgcgtctgggagaggaacaggatggctccctgtttacaaattcaaattggttcacgtttgatggagagagaggtatcaatgaccgtttagcagcctctgttccttcgtcctcacccaattctgaggaggtttccccggacgccgaggaaactgatgatggtgaagccattggtactgaggatcaaatggaaactctgtgtcttggaaatggccctaccgaggcagaagatgtggcagaatgtaccaaacagacaaactttagtactgaggatgagcaactaggaagtccagaagggatcgagcggcatccggatgcatcaaatggcgatactgaagttagcacagatgaagctgcctctgctgccgtagaatcttcagccccagcagctgaggagcagacagagagaacagttgataaagccacgggctcatctggtttggacaatcttgtctctgaagctttaccagatcctgatgttaatgttagtgatttggccgattcggcggtatcttccgagcaagctgtatgcaacgaagatgtggagccaccgatcgaaactgatgcagtcgtggatgttgaagcgaaaactgatgcggtcgtggatgttgaagcgaaaactgatgtggttatggatgttgaagcgaaaactgatgcagtcgtggatgttgaagcgaaaactgatgcagtcgtggatgttgaagcgaaaactgatgcagtcatggatctaccagtcaaggaagtttctgccttggatgttgaagcgaaaactggtgtagtagaggcaaatgagtgaagtggaagtatatttgtggactaaaatggcatagctgacgagcaactattaagtcagacctctcagaagacaagaaaccatctttgcttcaggtgctcatcagccagaaagaactctgaagcaaactgctgtacaataagcaagtgtactattttgccttccattgtgaccaatcagtgtacaaatgagcaccttatctaactgcacgcacgacattttgtcagaaactggtcaatttgcttcgaaatttaccctcccggttcctgtggaaagattggttggtgctaaatgtcatttggcaatagtctcgtgtagacgatatgtgaaggacatcattttttggatggcaactggtttgtctacctagtgttttgtttcattaggttaactttggaactgtaatatgggatatggtattatttctagtttagctattgtaattctttctgactcgatgttcgtcagttcaaatagagcatgctatttttgataaatgtttctgccggttctgttcaaccggtctttcaaaatagtcgtacttgcttctaaccgtggtgctatcttaacagttataatctcagagaagtgccagaataatctgaaccgatggtaaagaagtacttcttcagtccaacaaaggatgtctcaattttgactaaatttgaaagcatctatacacttgagacatcttttgttgagggattcaaattttgacaaacttgagacatcttgttttgttgagggagtacaatcttt

SEQ ID NO: 1591 - DNA, 3139 bp, Triticum aestivum
ccacgcgtccgaacccaaggaaagcccaaatagaaaagcgtgctgttttttcctcctctcgtgcgcctcccaccccccgcgatcccaattcgatccgctcgcccctctcccgatccaccctcctcccccggccgcccaatccggccgccgccgcccggattcgcgcggattcggccgcggactcgcgctccccggggtcggaaaccctagatccaccgccgccgccaccatgttctggcgcatgaccggtctctccgcggcctcgcccgtggatacaatcctagacaaggaaaattttacacttgaagaacttcttgatgaggatgaaattattcaagagtgcaaagcactgaacacccgactcataaatttcctgcgtgacaaggcccaggtggaacaattgcttcgttatgttgttgaagaagttccggatgacgctgaaaaaaagcgctctttcaagttccctttcattgcttgtgagatatttacttgtgaaatcgatgtcattttgaggaccctagtagaagatgaagagttaatggatttgcttttctcatttgtgaaacctgatcatccacacagcacattattatctggttacttcagtaaggtggtaatttgtttgatgctgcggaagactgccccactaatgaattatgttcaggagcatccagagattgttgtccaacttgtcgacctgattggcatcacatctgtaatggaggtgctgatacgcctgattggtgctgatgagaccatatattcaaactatgctgatacaatgcagtggttagaaaatacagatgttcttggaatgatcgcagataagtttagctcatcggactctcctgaagtgcatgccaatgctgccgaaattctttgtgctgtgactcgatgtgcacctccatctctcgctgcaaagatatgcagtccaagttttgttgggaggttgttctgccatgctcttgaaggatcaagacccaagtctgtgctggttcattcattgtcagtgtgcatatctttactggacccaaaaagattggcatcagcttcctatcaagcattcagaagcaacgtaagccatggggcattggtcactgccagtcctgagacagttgatggtatgctcgagagtctaggtaatttgctgaacttattggacacctctgctgctgaaaatgttttgcctacaacttatggatgtttacgcccacctctggggaagcatcgactgaagattgtggagttcatctctgttttgctgacagttggcagtgaaactgctgaacaggagctaatcagccaatcggcaataaagcgctccattgacttattctttgagtacccttataacaactttttgcaccatcatgtcgagaatataattgtttcttgcctggagggtaaaagaacagaacttgtcgaacatgttcttaatgaatgtgacattgttggtaaaattcttgctgccgacaagctttcttctttggcaacagaatctaatgggcctactgtgccgtctgaagggaaaaccccttcaaaaattgggaatgttggtcacatgacaagaatagccaataaactcattcagttgggaaatagtaacagcacaatccagactcacctgcagggtaacagtgagtgggttgaatggcagacagatgttctggtcaggcgaaatgaggtggagaatgtttatcattgggcttgtggacgcccaacctcgcttcatgaccgtggtagggatagtgatgatgatgacttccgagacagggattatgatgttgcagctctggccaataacttgagccaggcattccgctatgggatatacagcaatgatgacattgaagaggcacaagggtcacttgaacgtgatgatgaggatgtctattttgatgacgaatcagctgaggttgtaatatcttccctgcgtctgggagatgatccagacggttccctctttacaaattcgaattggttcacgtttgatggagagagaggtatcaatgaccgtttagctgcctctgttccttcgtcctcacccaactctgaggaggcttccccagacaccaaggaagctgatgatggtgaagcaattggcactgaggatcaaatggaaactttgggtcttggaaatggtcctgctaaggaggccgaagatgctgcagaatgtaccaaacagacaaatttgagcactgagaatgagcaactagaaagtgcagaaggtactgagcggcatctggatgtttcatttcatggtactgaagctagcacagacgaagctgcctctgaagcagctgaatcttcagtctcagctactgagacacaggcagagagaacagttgataaaccagctggctcatctgatttggacaatcctatctctgaagcttcacccgatcctgatgtcaatgggagtgatttggctggctcggcattatcttctgagcaagctgtccgtaacgaagatgtggaggtaccgaccaagactgatgcagtcgtggatactgaaatgaaaactgatacagtcgtggaaactgatgcagtcggggatgttggagtgaaagctgatgcagtcgtggaggtaccaagcaaggaagtatctgccgtggatgttgaagctaaaactggcgcagcagaagcaaaagagtgaagtggcagcttatctcatggactgaaatggcatagctgacgagcaattattagtcagacccctcagaagacaggcaatcatctttgcttcaagtgctcatcagccacaagcaacttcgaagcaaactgctgtacaataagcaagtgtactattttgccttccattgtggccaatcactgtacaaatgggcaccattgtctaactgcacgcgtacacttcatcagaaattggtcaatttgcttcaaaatttaccctccgtttcatggggaacaattggttgatgcgaaatgtcatttggcggtagtctcgtgtcttgcgatatgtgaaagcacaattctttttggatggcaactgttttgtctactttagtcttttgtttcattattaggttaactttggaactataatatttcatatggtatatttctagtttagctattgtaattctttctgactcgatgtgcttcagttcaaatagagcat

SEQ ID NO: 1592 - DNA, 3161 bp, Oryza sativa
caccccccctctcaaaattaaaaaaaaagcgtgctgttcttttctcctcctctcgtgcgcctcctccccctcccccaccctcgccctcgcgatcccaattcgatccgctccggcctccccctcgatccgccgccccccgccaccgcccctcgccggccgcggaatccgcacgcccacgcccggattcgcgcggcgccggccgcggattcgtggccccacccccgcccgccgtcgccgtcgccggaaaccctagatccgcctccgcctccgccgccatgttctggcgcatgaccggcctgtccgcggcctcgcccgtggatacaatcctagacaaggaaaattttacactggaagaacttcttgacgaggatgaaattattcaagagtgcaaagctctgaatacacgactcataaatttcttgcgtgacagagcccaggtggagcaattgcttcgttatgttgtggaagaagtaccagatgatgctgaaaaaaagcgctctttcaagtttccattcattgcttgtgagatatttacatgtgaaattgatgtcattttgaggaccctagtcgaggatgaacagttaatggaattgcttttctcatttgtgaaatccgatcatccacatagcacattgttatctggttacttcagcaaggtggtaatatgtttgatgctgcggaagactgctcctcttatggcttatgttcagggacatccagaaatagttgtccaactcgttgacctgattggcatcacatcaataatggaggtgttaatacgattgattggtgctgatgagaccatatactcaaactatggcgatacattgcagtggttagaaaatacagatgtccttgaaatgattgctgataagtttagctcatcggactcccctgaagtgcatgccaatgctgccgaaattctttgtgccgtgactcgatgtgctcctccatctcttgctgcaaagatatgcagcccaagttttgttgggaggctatttcgtcatgcacttgaagaatcaaggcccaaatccgttctagttcattcattgtcagtgtgcatatctctgttggatccaaaaagattggcatcagcttcctatcaagcatttagaagcaacttaagtcacggggcgttggtcactgccagtccagagactgttgatggcatgcttgagagcctaggcaatttgctgaagttattggatacttctgatgctgaaaatgttttgcctacgacatatggatgtttacgcccaccccttggaaaacatcgtttgaagattgtggagttcatctcagttctgctgacaattggcagtgaaactgctgagaaagagcttatcaggcaatcggcaataaagcgatctgttgatttattcttcgagtacccatataacaattttttgcaccatcatgttgagaatattattgtctcttgcctggagggtaaaagaactgaacttgttgagcatgttcttaatgactgtgacattgttggtaaaattcttgccgcggaaaaactttcttctttgtcaacagagtctactgggcctactataccttcagatggtaaatcgattcccaaaattgggaatattggtcacatgacaagaataaccaacaagcttattcagttgggaagcagtaacggcacaatccagattcacttgcaggaaaatagtgagtgggttgactggcaaacagatgttctagtcaagcgtaatgaggtggagaatgtttatcattgggcttgtgggcgcccaacatcacttcatgaccgtggtagggatagtgatgatgatgacttccgagacagggattatgatgtggcagctcttgctaataacttgagccaggcattccgatatgggatatatagcaatgatgatatggaagagaatcaagggacacttgaacgggatgatgaggatgtctattttgatgatgaatcagcagaggtcgtaatatcttcactgcgactgggagatgatcaggatggttccctctttacaaattcgaattggtttacatttgatggagagagaggtattactgaccgtttggctgcggttccttcgtcttcacctaattcagaggagatttccccagacactgaggaaactgatgatggtgaagtcgtcattggtactgaggatcatatggatactgtcaatcttgggaatggtcctatcgaggaggcagaagatgcagcggaatttactaaacacccggctactagcacggaggatgagcaactacaaaacgctgaagggattgagcgacacctggatgtttcaaatggtgatgctgaagctagtacagaagctgcagaggcagcaccagtatcttcagccccatcttctgatgaggtgcagacagagagaactgcagatgaacccactggctcatctgattcgggtaattctgtctcagaagttttgccagatcctgaagatagtagcattgatccagccaacacagcagtatcgtctgaacaaactgtggataacgaagacgtggagttaccaactaaggaagttccgtctgtggatgttgaaactaaaaccgatgaaatcaaagcaaatgagtgaaggggcaggaaatctcatgggctaaaatggcatagttgaccagaacagttgttagtcagatcggtcagaaagacaagcaagcctcacctgctcatcaggcatggacatgtccgaagcaaactgctgtacaataaaaagagtgtactatttttgccatccattgtggtctatccctgtacaaaaatgatcaccatcatctaaccgcacgctcgtcatcgcaacatctgaaactggtcaaaatttgtttcaagttcgcctccagttcatgggaaaaataggttggtgccaaacgtcatttgtcagttagtctctgtgtcgtgtcttgatatatggaaaagaacattctttggatggcagctagttttgtcaacgtggtcttttgtttccttttaggtttaacactttgaactgtaatatgggatgtgctatttatttatagcctagctattatttgtaattttttccaacatgacgtgggtcagttcaaatggaacacgtcctttttgataaaaacaaaatttctctgcactcttacccatttggttttcgaaacgatttccacatcag

SEQ ID NO: 1593 - DNA, 3100 bp, Hordeum vulgare
attttttcctcctctcgtgcgcctctcaccccccgcgatcccaattcgatccgctcgcccctctcccgatccaccccccttccccggtcgcccaatccggccgccgccgcccggattcgcgcggattcggccgcggactcgcgcctcccggggccggaaaccctagatccaccgccgccgccaccatgttttggcgcatgaccggtctctccgcggcctcgcccgtggatacaatcctagacaaggaaaattttacacttgaagaacttcttgacgaggatgaaattattcaagagtgcaaagcactgaacacccgactcataaatttcctgcgtgacaaggcccaggtcgaacaattgcttcgttatgttgttgaagaagttccggatgatgctgaaaaaaagcgctctttcaagttccctttcattgcttgtgagatatttacttgtgaaatcgatgtcattttgaggaccctagtagaggatgaagagttaatggatttgcttttctcatttgtgaaacctgatcatccacacagcacattattatctggttacttcagtaaggtggtaatttgtttgatgctgcggaagactgccccattaatgaattatgttcaggagcatccagagatcgttgtccaacttgtcgacctgattgggatcacatctgtaatggaggtgctgatacgtctgattggtgctgatgagaccatatattcaaactatgctgatacaatgcagtggttagaaaatacagatgttcttggaatgatcgcagataagtttagctcatcggactctcctgaagtgcatgccaatgctgccgaaattctttgtgctgtgactcgatgtgcacctccatctctcgctgcaaaaatatgcagtccaagttttgttgggaggttgttctgccatgcccttgaaggatcaagacccaagtctgtgctggttcattcattgtcagtgtgcatatctttactggacccaaaaagattggcatcagcttcctatcaagcattcagaagcaatgtaagtcatggggcattggtcactgccagtcctgagacagttgatggtatgctcgagagtctaggtaatttgctgaacttattggacacctctgctgctgaaaatgttttgcctacaacttatggatgtttacgcccacctctggggaaacatcgactgaagattgtggagttcatctctgttttgctgacagttggtagtgaaactgctgaacaagagctgatcagccaatcggcaataaagcgctccattgacctattctttgagtacccgtacaacaactttttgcaccatcatgtcgagaatataattgtttcttgcctggagggtaaaagaacagaacttgtcgagcatgttcttaatgaatgtgacattgttggtaaaattcttgctgccgacaagctttcttctttgtcaacagagtctaatgggcctactgtgccgtctgaagggaaaaccccttcaaaaattgggaatgttggtcacatgacaagaatagccaataaactcattcagttgggaaatagtaatagcacaatccagactcacctgcagggtaacagtgagtgggttgaatggcagacagatgttctggtcaggcgaaatgaggtggagaatgtttatcattgggcttgtggacggccaacctcgcttcatgaccgtggtagggatagtgatgatgacgacttccgagacagggattatgatgttgcagctctggccaataacttgagccaggcattccgctatgggatatacagcaatgatgacattgaagaggcgcaagggtcacttgaacgggatgatgaggatgtctattttgatgacgaatcagctgaggtggtaatatcttccctgcgtctgggagatgatccggacggttccctctttacaaattcaaattggttcacgtttgatggagagagaggtatcaatgaccgtttagctgcctctgttccttcgtcctcacccaactctgaggaggcttccacagacatcgaggaagttgatgatggtgaagcaattggcactgaggatcagatggaaaccttgggtcttggaaatggccctgctaaggaggcagacgatgatgcagaatgtaccaaacaggcaaatttgaacagtgagaatgaacaactagaaagtgcagaaggtaccaagcggcaaccggatgtttcaattgatggtaccgaagttagcaccgatgaagctgcctctgaagcagctgcatcttcagccccagctactgagacacaggcagagagaacagtagataaaccagctggctcatctgatttggacaatcctatctctgaagcttcaccagatcctgatgtcaatgtgagtaatttggcaggctctgcattatcttcccagcaagctgtccttaacgaagatgttgaggtaccaatcaagactgatgcagttgtggatactgaaacgaaaactgatacagttgtggaaactgacgcagtcggggatgttggagtgaaagctgatgcagtcgatgaggtaccaagcaaggaagtatctgccgtggatgttgaagctaaaactggcgcagcagaagcaaatgagtgaagtggcagcctatctcatggactgaaatggcatagctgacgagcaattattagtcagacccccgagaagacaggcaatcatctttgcttcaagtgctcatcagccacaagcaacttcggagcaaactgctgtacaataagcaagtgtactattttgccttccattgtggccaatcactgtacaaatgagcaccattgtctaactgcacgcgcacacatcatcagaaattggtcaatttgcttcaaaatttaccctccgtttcatgggctgtgaaatgtcatttggcggtagtctcgtgtcttgcgatatgtgaaaacacaattctttttggatggcaactgttttgtctacctagtcttttgtttcatcattaggttaactttggaactattatatttcatatcctattatttctagtttagctattgtaattctttctgactcgatgtgcgtcagttcaaatagagcatgctatttctttatgaaaa

SEQ ID NO: 1594 - DNA, 3341 bp, Secale cereale
aaaagtaacagcgcccctcagctccaatcccccatctccaagccaaatcaaacccgaggaaagcccaaatagaaaaagcgtgctgttttttcctcctctcgtgcgcctcccaccccccgcgatcccaattcgatccgcttgcccctctcccgatccaccctccttccccggtcgcccaatccggccgccgccgcccgtattcgcgcggattcggccgcggactcgcgctccccggggccggaaaccctagatccaccgtcgccgccaccatgttctggcgcatgaccggtctctccgcggcctcgcccgtggatacaattctagacaaggaaaattttacacttgaagaacttcttgatgaggatgaaattattcaagagtgcaaagcactgaacacccgactcataaatttcctgcgtgacaaggcccaggtggaacaattgcttcgttatgttgttgaagaagttccagatgacgctgaaaaaaagcgctctttcaagttccctttcattgcttgtgagatatttacttgtgaaatcgatgtcattttgaggaccctagtagaggatgaagagttaatggatttgcttttctcatttgtgaaacctgatcatccacacagcacattattatctggttacttcagtaaggtggtaatttgtttgatgctgcggaagactgccccactgatgaattatgttcaggagcatccagagatcgttgtccaacttgtcgacctgattgggatcacatctgtaatggaggtgctgatacgcctgattggtgctgatgagaccatatattcaaactatgctgatacaatgcagtggttagaaaatacagatgttcttggaatgattgcagataagtttagctcatcggactctcctgaagtgcatgccaatgctgccgaaattctttgtgctgttactcgatgtgcacctccatctctcgctgcaaagatatgcagtccaagttttgttgggaggttgttctgccatgctcttgaaggatcaagacccaagtctgtgctggttcattcattgtcagtgtgcatatctttactggacccaaaaagattggcatcagcttcctatcaagcattcagaagcaacgtaagtcatggggcattggtcactgccagtcctgagacagttgatggtatgctcgagagtctaggcaatttgctgaacttattggacatctctgctgctgaaaatgttttgcctacaacttatggatgtttacgcccacctctggggaaacatcgactgaagattgtggagttcatctctgttttgctgacagttggtagtgaaaccgctgaacaagagctaatcagtcaatcggcaataaagcgctccattaacttattctttgagtacccgtataacaattttttgcaccatcacgtcgagaatataattgtttcttgcctggagggtaaaagaacagaacttgtcgaacatgttcttaatgaatgtgacattgttggtaaaattcttgctgccgacaagctgtcttctttgtcaacagagtctaacgggcctactgtgccgtctgaagggaaaaccccttcaaaaattgggaatgttggtcacatgacaagaatagccaataaactcattcagttgggaaataataacagcacaatccagactcacctgcagggtaacagtgagtgggttgaatggcagacagatgttctggtcaggcgaaatgaggtggagaatgtttatcattgggcttgtgggcgcccaacctcgcttcatgaccgtggtagggatagcgatgatgatgacttccgagacagggattatgatgttgcagctctggccaataacttgagccaggcattccgctatgggatatacagcaatgatgacattgaagaggcacaagggtcacttgaacgggatgatgaggatgtctattttgatgatgaatcagctgaggtggtaatatcttccctgcgcctgggagatgatccagacggttccctctttacaaattcgaattggttcacgtttgatggagagagaggtatcaatgaccgtttagctgcctctgttccttcgtcctcacccaactctgaggaggcttccccagacattgaggaagctgatgatggtgaagcaattggcactgaggatcaaatggaaactttgggtcttggaaatggccctgctaaggaggcagaagatgatgcagaatgtaccaaacatacaaatcttagcactgagaatgagcaactagaaagtgcagaaggtatggagcggcatccggatgtttcagttgatggtactgaggttagcacagacgaagctgcctctggagcagctgaatcttcagccccagctgctgagacagaggcagagagaacagttgataaaccagctgcctcatctgatttggacaatcctatctctgaagcttcaccagatcctgatgtcaatgggagtgatttggctggctcggcattatcttctgagcaagctgtccgtaacgaagatgcagaggtagcgatcaagactgatgcagtcgtgggtactgaaacgaaaactgaaacagtcgtggaaactgatgcagccggggatgttggagtgaaagctgatgcagtcggggaggtaccaagcaaggaagtatctgccgtggatgttgaagctaaaactggcgaagcagaagcaaatgagtgaagtggcagcgtatctcatggactgaaatggcatagctgacgatcaattattagtcagacccctcagaagacaggcaatcatctttgcttcaagtgctcatcagccacaagcaacttcggagcaaactgctgtacaataagcaagtgtactattttgccttccattctggccaatcactgtacaaatgagcaccattgtctaactgcacgcgcacactccatcagaaattggtcaatttgcttaaaatttaccctccgtttcatgggctgtgaaatgtcatttggcggtagtctcatgtcttgcgatatgtgaaagctcaattctttttggatggcaactgttttgtctacttagtcttttgtttcattattaggttgactttggaactataatattttatatggtattatttctagtttagctattgtaattctttctgactcgatgtgcgtcagtccaaatagagcatgctatttttgtatgaaaatacttctgctcgtttcctttaaattgtttcagacccagcttgttacacatagaaacaaaaaaaaaaaaaaaaaaaaaagaaaaaaaaaaaaaaacaaaaaaaaaaaaacaaaacgtagactacgacgaacgaccgacaaccgagggaggtagggaggc

SEQ ID NO: 1595 - DNA, 3094 bp, Hordeum vulgare
ccccctccgctctctcagattggtttgttcgtccgtccgcccctttgtgctgcggtggctgcgagcttggtcgtgaacccatttgtttagattgacactgtggattgggtgccgcacttgggttgtataatgctcgcttgctcttattttgttctcgggtgcgctgcgactgcgaggtggatacaatcctagacaaggaaaattttacacttgaagaacttcttgacgaggatgaaattattcaagagtgcaaagcactgaacacccgactcataaatttcctgcgtgacaaggcccaggtcgaacaattgcttcgttatgttgttgaagaagttccggatgatgctgaaaaaaagcgctctttcaagttccctttcattgcttgtgagatatttacttgtgaaatcgatgtcattttgaggaccctagtagaggatgaagagttaatggatttgcttttctcatttgtgaaacctgatcatccacacagcacattattatctggttacttcagtaaggtggtaatttgtttgatgctgcggaagactgccccattaatgaattatgttcaggagcatccagagatcgttgtccaacttgtcgacctgattgggatcacatctgtaatggaggtgctgatacgtctgattggtgctgatgagaccatatattcaaactatgctgatacaatgcagtggttagaaaatacagatgttcttggaatgatcgcagataagtttagctcatcggactctcctgaagtgcatgccaatgctgccgaaattctttgtgctgtgactcgatgtgcacctccatctctcgctgcaaaaatatgcagtccaagttttgttgggaggttgttctgccatgcccttgaaggatcaagacccaagtctgtgctggttcattcattgtcagtgtgcatatctttactggacccaaaaagattggcatcagcttcctatcaagcattcagaagcaatgtaagtcatggggcattggtcactgccagtcctgagacagttgatggtatgctcgagagtctaggtaatttgctgaacttattggacacctctgctgctgaaaatgttttgcctacaacttatggatgtttacgcccacctctggggaaacatcgactgaagattgtggagttcatctctgttttgctgacagttggtagtgaaactgctgaacaagagctgatcagccaatcggcaataaagcgctccattgacctattctttgagtacccgtacaacaactttttgcaccatcatgtcgagaatataattgtttcttgcctggagggtaaaagaacagaacttgtcgagcatgttcttaatgaatgtgacattgttggtaaaattcttgctgccgacaagctttcttctttgtcaacagagtctaatgggcctactgtgccgtctgaagggaaaaccccttcaaaaattgggaatgttggtcacatgacaagaatagccaataaactcattcagttgggaaatagtaatagcacaatccagactcacctgcagggtaacagtgagtgggttgaatggcagacagatgttctggtcaggcgaaatgaggtggagaatgtttatcattgggcttgtggacggccaacctcgcttcatgaccgtggtagggatagtgatgatgacgacttccgagacagggattatgatgttgcagctctggccaataacttgagccaggcattccgctatgggatatacagcaatgatgacattgaagaggcgcaagggtcacttgaacgggatgatgaggatgtctattttgatgacgaatcagctgaggtggtaatatcttccctgcgtctgggagatgatccggacggttccctctttacaaattcaaattggttcacgtttgatggagagagaggtatcaatgaccgtttagctgcctctgttccttcgtcctcacccaactctgaggaggcttccacagacatcgaggaagttgatgatggtgaagcaattggcactgaggatcagatggaaaccttgggtcttggaaatggccctgctaaggaggcagacgatgatgcagaatgtaccaaacaggcaaatttgaacagtgagaatgaacaactagaaagtgcagaaggtaccaagcggcaaccggatgtttcaattgatggtaccgaagttagcaccgatgaagctgcctctgaagcagctgcatcttcagccccagctactgagacacaggcagagagaacagtagataaaccagctggctcatctgatttggacaatcctatctctgaagcttcaccagatcctgatgtcaatgtgagtaatttggcaggctctgcattatcttcccagcaagctgtccttaacgaagatgttgaggtaccaatcaagactgatgcagttgtggatactgaaacgaaaactgatacagttgtggaaactgacgcagtcggggatgttggagtgaaagctgatgcagtcgatgaggtaccaagcaaggaagtatctgccgtggatgttgaagctaaaactggcgcagcagaagcaaatgagtgaagtggcagcctatctcatggactgaaatggcatagctgacgagcaattattagtcagacccccgagaagacaggcaatcatctttgcttcaagtgctcatcagccacaagcaacttcggagcaaactgctgtacaataagcaagtgtactattttgccttccattgtggccaatcactgtacaaatgagcaccattgtctaactgcacgcgcacacatcatcagaaattggtcaatttgcttcaaaatttaccctccgtttcatgggctgtgaaatgtcatttggcggtagtctcgtgtcttgcgatatgtgaaaacacaattctttttggatggcaactgttttgtctacctagtcttttgtttcatcattaggttaactttggaactattatatttcatatcctattatttctagtttagctattgtaattctttctgactcgatgtgcgtcagttcaaatagagcatgctatttctttatgaaaatatctctgttcgttgctttaaattgtttcagttcatgcttgt

SEQ ID NO: 1596 - DNA, 2885 bp, Triticum aestivum
gtggatacaatcctagacaaggaaaattttacacttgaagaacttcttgatgaggatgaaattattcaagagtgcaaagcactgaacacccgactcataaatttcctgcgtgacaaggcccaggtggaacaattgcttcgttatgttgttgaagaagttccggatgacgctgaaaaaaagcgctctttcaagttccctttcattgcttgtgagatatttacttgtgaaatcgatgtcattttgaggaccctagtagaagatgaagagttaatggatttgcttttctcatttgtgaaacctgatcatccacacagcacattattatctggttacttcagtaaggtggtaatttgtttgatgctgcggaagactgccccactaatgaattatgttcaggagcatccagagattgttgtccaacttgttgacctgattggcatcacatctgtaatggaggtgctgatacgcctgattggtgctgatgagaccatatattcaaactatgctgatacaatgcagtggttagaaaatacagatgttcttggaatgatcgcagataaatttagctcatcggactctcctgaagtgcatgccaatgctgccgaaattctttgtgctgtgactcgatgtgcacctccatctctcgcttcaaagatatgcagtccaagttttgttgggaggttgttctgccatgctcttgaaggatcaagacccaagtctgtgctggttcattcattgtcagtgtgcatatctttactggacccaaaaagattggcatcagcttcctatcaagcattcagaagcaacgtaagccatggggcattggtcactgccagtcctgagacagttgatggtatgctcgagagtctaggtaatttgctgaacttattggacacctctgctgctgaaaatgttttgcctacaacttatggatgtttacgcccacctctggggaagcatcgactgaagattgtggagttcatctctgttttgctgacagttggcagtgaaactgctgaacaggagctaatcagccaatcggcaataaagcgctccattgacttattctttgagtacccttataacaactttttgcaccatcatgtcgagaatataattgtttcttgcctggagggtaaaagaacagaacttgtcgaacatgttcttaatgaatgtgacattgttggtaaaattcttgctgccgacaagctttcttctttggcaacagaatctaatgggcctactgtgccgtctgaagggaaaaccccttcaaaaattgggaatgttggtcacatgacaagaatagccaataaactcattcagttgggaaatagtaacagcacaatccagactcacctgcagggtaacagtgagtgggttgaatggcagacagatgttctggtcaggcgaaatgaggtggagaatgtttatcattgggcttgtggacgcccaacctcgcttcatgaccgtggtagggatagtgatgatgatgacttccgagacagggattatgatgttgcagctctggccaataacttgagccaggcattccgctatgggatatacagcaatgatgacattgaagaggcacaagggtcacttgaacgtgatgatgaggatgtctattttgatgacgaatcagctgaggttgtaatatcttccctgcgtctgggagatgatccagacggttccctctttacaaattcgaattggttcacgtttgatggagagagaggtatcaatgaccgtttagctgcctctgttccttcgtcctcacccaactctgaggaggcttccccagacaccaaggaagctgatgatggtgaagcaattggcactgaggatcaaatggaaactttgggtcttggaaatggtcctgctaaggaggccgaagatgctgcagaatgtaccaaacagacaaatttgagcactgagaatgagcaactagaaagtgcagaaggtactgagcggcatctggatgtttcatttcatggtactgaagctagcacagacgaagctgcctctgaagcagctgaatcttcagtctcagctactgagacacaggcagagagaacagttgataaaccagctggctcatctgatttggacaatcctatctctgaagcttcacccgatcctgatgtcaatgggagtgatttggctggctcggcattatcttctgagcaagctgtccgtaacgaagatgtggaggtaccgaccaagactgatgcagtcgtggatactgaaatgaaaactgatacagtcgtggaaactgatgcagtcggggatgttggagtgaaagctgatgcagtcgtggaggtaccaagcaaggaagtatctgccgtggatgttgaagctaaaactggcgcagcagaagcaaaagagtgaagtggcagcttatctcatggactgaaatggcatagctgacgagcaattattagtcagacccctcagaagacaggcaatcatctttgcttcaagtgctcatcagccacaagcaacttcgaagcaaactgctgtacaataagcaagtgtactattttgccttccattgtggccaatcactgtacaaatgggcaccattgtctaactgcacgcgtacacttcatcagaaattggtcaatttgcttcaaaatttaccctccgtttcatggggaacaattggttgatgcgaaatgtcatttggcggtagtctcgtgtcttgcgatatgtgaaagcacaattctttttggatggcaactgttttgtctactttagtcttttgtttcattattaggttaactttggaactataatatttcatatggtatatttctagtttagctattgtaattctttctgactcgatgtgcttcagttcaaatagagcatgctatttttttaat

SEQ ID NO: 1597 - DNA, 2254 bp, Sorghum bicolor
ccaccggccctcccaccctctctctcctggccccgatccttgcgatctggccgcttctcagggccgacacgtccgcccgcagacgcgctgggtctctgacttccagaaccttcctgccgcttcctggccacgaatgcccgtcccgatccagcggcccagcacgtgccacgtgtcagggaccagccacgtcggcgtccgatgtggcgcccccgccccgaagaaactgatacggccccaaacctcgcggctctcagcctcacgctcggaaaagcaagtggccgccgctgcctgcccatcccgccgcaaccaacaccaacgccttgcttgcttgctccgctgtccgcgccccggttcccagcgatcgaaatcagcagtggattcggagaggccagggccgccggaggagatgaacggccgcggcggcggcggaggaggaggaggggaggaggagatggaggaggacggcggcggccccggctgcgcgcagggcgcggggaataaggagcgggtggtgctgatgtgggggtacctgcccggcgtgtcgccgcagcgctcgccgctgctcgggccggtcccagtgaggctgcccccggcggcggcggcggccgccggtgatgggtggagggacgtgtgcggcggcgggtgcggcttcgccatggccatctctgagtctggaaaactccttacttggggttctgctgatgacatgggccaaagttatgtgactgctgggaagcacgaggagactccagaggcttttcctcttcctagcggcgtcgcaatagtgcgagcagatgctggatgggctcactgtgttgcaataacagatgaaggtgatgtttatacatggggttggaaagaatgtgttccaactggaagggttattggagaccaatcttcagttggaaccatggaaaaggatgaaagacaaatggcaatggccacggaccaagtgagccccaggtcacaggtgtctaggacaagcagcggagcagcatctggtccccctgaaagcagaggcactgatgatagtacaaagcgccgaaggttgtcatcagcaaaacatggacctgagagctcgacatccagtgatgaaagtctttcagcacccccttgtgttgtgacatttaatacaggagtgaaaatagtgtctgtagctgctggtggtcgtcatacattagcactatcagatttaggtcaggtgtggggttggggatatggaggagaagggcaactaggtctgggttctagaatccgaacagtttcttctccccatcctgtaccgtgcattgaatcagcactatacagcaaggatcggccatcagctatgaaaggtaacaaggctgctgaaggacatgtcagtaaagtcttgggaaattgcgtgagggccattgcttgtggaggtcgtcacagtgctgtagtaacagattcaggagctcttcttacatttggatgggggctgtatggacagtgtggacaagggaatacagatgatgttctaagtccgacgtgtgtatcatctatcctgggaatcaagatgcaagatgttgccgcaggtttgtggcacactgtatgtacatctgtagatggtgatgtgtattcgtttggaggaaaccagtttgggcagcttggcactggttctgatcaagctgagactgttccaaaattggtagatgctacaagcctggagaataagaatgccagatctgtttcttgtggagctcgccatagtgctatcataacagatgaaggcgaagtattctgctggggatggaacaagtatggacagcttggtcttggcgactcaatggacaggaacgtgccttgcagtgttcctgtggacgcttaccacccactaaacgtgtcctgtggttggtggcacaccttggtgctcgcggagtcgcctacttgaaacctgacaaagaaattaccttagattgacaattttgttaggaacttgtaggctcgtgcaggtgcggtgatgctgcatttcatcgtgtacatacatggcagtgcatacagatatgtgtattcattctttgcggtgcgctcttcaacctgtgcaacgtagacaaagcttgtatcgcattgcgtatacacagtttgagtaggattgccacgacgaattgtgcttgaaactgggctctataactcctgtcaagaagttaccctgcccagtggaatcttatttccacaggcaagacagccggtttatgagaccgctgactccgaacgcatgcgtttctcgttatag

SEQ ID NO: 1598 - DNA, 2394 bp, Sorghum bicolor
ccaccggccctcccaccctctctctcctggccccgatccttgcgatctggccgcttctcagggccgacacgtccgcccgcagacgcgctgggtctctgacttccagaaccttcctgccgcttcctggccacgaatgcccgtcccgatccagcggcccagcacgtgccacgtgtcagggaccagccacgtcggcgtccgatgtggcgcccccgccccgaagaaactgatacggccccaaacctcgcggctctcagcctcacgctcggaaaagcaagtggccgccgctgcctgcccatcccgccgcaaccaacaccaacgccttgcttgcttgctccgctgtccgcgccccggttcccagcgatcgaaatcagcagtggattcggagaggccagggccgccggaggagatgaacggccgcggcggcggcggaggaggaggaggggaggaggagatggaggaggacggcggcggccccggctgcgcgcagggcgcggggaataaggagcgggtggtgctgatgtgggggtacctgcccggcgtgtcgccgcagcgctcgccgctgctcgggccggtcccagtgaggctgcccccggcggcggcggcggccgccggtgatgggtggagggacgtgtgcggcggcgggtgcggcttcgccatggccatctctgagtctggaaaactccttacttggggttctgctgatgacatgggccaaagttatgtgactgctgggaagcacgaggagactccagaggcttttcctcttcctagcggcgtcgcaatagtgcgagcagatgctggatgggctcactgtgttgcaataacagatgaaggtgatgtttatacatggggttggaaagaatgtgttccaactggaagggttattggagaccaatcttcagttggaaccatggaaaaggatgaaagacaaatggcaatggccacggaccaagtgagccccaggtcacaggtgtctaggacaagcagcggagcagcatctggtccccctgaaagcagaggcactgatgatagtacaaagcgccgaaggttgtcatcagcaaaacatggacctgagagctcgacatccagtgatgaaagtctttcagcacccccttgtgttgtgacatttaatacaggagtgaaaatagtgtctgtagctgctggtggtcgtcatacattagcactatcagcttcagatttaggtcaggtgtggggttggggatatggaggagaagggcaactaggtctgggttctagaatccgaacagtttcttctccccatcctgtaccgtgcattgaatcagcactatacagcaaggatcggccatcagctatgaaaggtaacaaggctgctgaaggacatgtcagtaaagtcttgggaaattgcgtgagggccattgcttgtggaggtcgtcacagtgctgtagtaacagattcaggagctcttcttacatttggatgggggctgtatggacagtgtggacaagggaatacagatgatgttctaagtccgacgtgtgtatcatctatcctgggaatcaagatgcaagatgttgccgcaggtttgtggcacactgtatgtacatctgtagatggtgatgtgtattcgtttggaggaaaccagtttgggcagcttggcactggttctgatcaagctgagactgttccaaaattggtagatgctacaagcctggagaataagaatgccagatctgtttcttgtggagctcgccatagtgctatcataacagatgaaggcgaagtattctgctggggatggaacaagtatggacagcttggtcttggcgactcaatggacaggaacgtgccttgcagtgttcctgtggacgcttaccacccactaaacgtgtcctgtggttggtggcacaccttggtgctcgcggagtcgcctacttgaaacctgacaaagaaattaccttagattgacaattttgttaggaacttgtaggctcgtgcaggtgcggtgatgctgcatttcatcgtgtacatacatggcagtgcatacagatatgtgtattcattctttgcggtgcgctcttcaacctgtgcaacgtagacaaagcttgtatcgcattgcgtatacacagtttgagtaggattgccacgacgaattgtgcttgaaactgggctctataactcctgtcaagaagttaccctgcccagtggaatcttatttccacaggcaagacagccggtttatgagaccgctgactccgaacgcatgcgtttctcgttatagaacactgatctgcgatatcgtgctggtcgcgagtgcgattcaactatgggtctcgtccagggcatttgttgtgacttcatcgatttaattaaaagtccgtaccaaacgatgccgtcttagaggctgttcatttg

SEQ ID NO: 1599 - DNA, 2231 bp, Zea mays
ccactcccactcccacccccaccccctcctggccgcgatccttgcgatgtggacgcttctcgggtcgacacgtctgcaggcgaaccccccggcctcggaggctcggacttccagaaccttcctgccgcttcctggccacgaatggccgtcccgatccagcgtcccagcgcgcgccacgtgtcagagatcggccacgtcggcgtccgatgtggcgctcccgcccccgaagaaactgatacggccccaaccctcgcgtctcagcctcacgctcggaagagtaagtggccgccgcaagcccgcaaccaacaccaacgctttgctcgcttgctccgctgtccgctcccgtcggccagcgatcgaaatcagcggtggattcggaggcccaggctcccggaggagatgaacggccgcggcaccggcggaggagggggaggggaggatgagatggaggaggacagcggccccagctgcgcgcagggggagggcgcggggaataaggagcgggtggtgctgatgtgggggtacttgcccggcgtgtccccgcagcgctcgccgctgctcgggccggtccccgtaaggttgcccccgacggcggcgactgccgccggtgatgggtggagagacgtgtgcggcggcggttgcggcttcgcgatggccatctctgagtctggaaaactcctcacttggggttcagctgatgacatgggccaaagttatgtgactgctgggaagcacgaggagactccagaagcttttccacttcctagcagtgtcgtgatagtgcgcgctgatgctggatgggctcactgtgttgcaataactgatgaatatgatgtttatacatggggttggaaagaatgtgttccaactggaagggttattggagaccagtcttcagttggaaccatggaaaaggatgaaaggcaaatggcaatggccactgaccaagtgagccctaggtcacaggtgtctaggacaagcagcggagcggcagctggttcctctgaaagcagaggcactgatgacagcacaaagcgacgaaagttgtctttagcaaaacatggacctgagagttcgacatccagtgatgaaagtctttcagcacccccttgtgttgtgacatttagtacaggagtgaaaatagtggctgtagccgctggtggtcgtcatacattagcactatcagatttaggtcaggtgtggggttggggatatggaggagaagggcaactaggtttgggttctagaatccgaactgtttcttctccccatcctgtaccgtgcattgaatcagcactatacaccaaggataggccatcagctatgaaaggtaacaaggctgctgaaggacatgtcagtaaagtcttgggaaattgcgtgagggcaattgcttgtggaggtcgtcacagtgctgtagtaacagattcaggagcacttcttacatttggatgggggctgtatggacagtgtggacaagggaatacagatgatgttttaagtccaacgtgtgtatcgtctatcctgggaatcaagatgcaagatgttgccgcaggtttgtggcacactgtatgtacatctgtagatggtgatgtgtattcgtttggaggaaaccagtttggacagcttggcactggttctgatcaggctgagactcttccaaaattggtagatgctacaagcctggagaataagaacgccagatccgtttcttgtggagctcgccatagtgctattataacagatgaaggtgaggtattctgctggggatggaacaagtatggccagcttggccttggcgactcaatggacaggaacgtgccttgcagtgtacgtgtggacgcttaccacccgctaaacgtatcatgtggctggtggcacaccttggtgctcgcggagtcgcctgcttgaaacctgacaaagaaattaccttagattgacaattttgttaggaacttgtaggctcgtgcaggtacggtgatgctgcatttcatcgtgtacatacatggcagtgcatacagatatgtgtattcattctttgcggtgcgctcttcgacctgtgcgacgtagacgaaagcttgtatcgcactgcgtatacagttgaataggcttgcctcgacaaattgctgctgctccattgctagtagtggaaaattttccacaagcaacaatgcaagacagggtaaccggtttacgtgattgctaactccggacggacgtgatcctcgttacag

SEQ ID NO: 1600 - DNA, 1833 bp, Panicum virgatum
ggaacaaggagcgtgtggtgctgatgtggggctacctacccggcgtgtcgccgcagcgctcgccgctgctcgggccggtccccgtgaggcttcccccggcggcggcagcggccggcggcgatgggtggagggacgtgtgcggcggcgggtgcggcttcgccatggccatctccgagtctggaaaactcctcacttggggatctgctgatgacatgggccaaagttatgtgactgctgggaagcacgaggagactccagaggcttttcctcttcctagtggtgttgcaatagtgagggcagatgctggatgggctcattgtgttgcaataacagatgatggggatgtctacacgtggggttggaaagaatgtgttccaactggaagggtcgttggagaccaatcttcagttggaactatggagaaggatgaaagacagatcgcaatggccactgaccaagtgagccccaggtcacaggtgtctaggacaagcagtggagcagcatctggtccctctgaaagcagaggtactgatgatagctcaaagagacgaaggttgtcttcagcaaaacatggacctgagagctcaacatctagtgatgaaagtctttcagcacccccttgtgtggtgacatttaatacaggagtgaaaatagtggctgtagctgctggtggtcgtcatacattagcactatcagatttgggtcagtgtggggttggggatatggaggagaagggcaattaggtctgggttctagaatccgaacggtttcatctcctcatcctataccgtggcattgaattagcactatacagcaaggatcgctcatcagctatgaaaggtaacaagaccgctgaagggcatatcagtaaagttatgggaaattgcgtgcgggctattgcttgtggaggccgtcatagtgctgtagtaacagattcaggagctcttcttacatttggatgggggctgtatggacagtgtggacaagggaacacagaagatgttttaagtccaacatgtgtatcgtctatcctgggaattaagatgcaagatgttgctgcaggtttgtggcacactgtatgtacatctgtagatggcgatgtctattcctttggaggaaaccagtttgggcagcttggcactggttctgatcaagctgagactgttccaaaattggtagatgctacaagcctggaaaataagaatgccagatctgtttcttgtggagctcgccacagtgctattataacagatgaaggcgaggtgttctgctggggatggaataaatacggccagctcggcctcggcgactcgatggacaggaacgtgccttgcaatgttcccgtggacacgtaccacccgctgaacgtgtcatgcggctggtggcacaccttagtgcttgcggagtcccctacctgaaacctgacagaagaattaccgtagattgacaattttgttaggaacatgtaggctcctgcaggtgcggtgatgctgcatttcatcgtgtacatacatggcagtgcatacagatgtgtgtattcattctttccagtgcgctcacaaatgtgtgcaacgtagacaaagcttgtgtcgccctgcgtatacagttgagtaggattgcctgtacaattacgcttaaaactgggttcgctgacgcttctcaagcggttatgcggctccctcatcgctagaggaaaatttctgccggatgacgggacaggtaatcggattagcagattgcttactggaatggagacgcacatgcccttctctaccaaaataaggcatgatgtacctctctacgattgttaatagtcctgtttgtgatcctagc

SEQ ID NO: 1601 - DNA, 6109 bp, Oryza sativa
cagccggccacgttttccctggccgcgtctcctggctccgacccgcacgacgtggcctctcccacgggccgacacgtagcccctccaagccctgggcctcaaacctttccagaagcttccggccgtttcctggccaggaattcgccgtcccgatccagcggcccgccgagcgccacgtgtctggggcccagccacgtcggcatccgacgtggcgcccccggccccggagaaactgatacgcccaaatctcgcagctcacagcctcacgctcggaaagcaagtggccgccgcttccccaccccaaccaaaccaacgccttctcctcctcctcccccccgtggccgccgcgaggcgagagcgatcgagacggaggcggcgacgacggcgacggagaaggtagcggaggaatcggcggcggatacggggaggacgggtgctcccgaggagatgaacggccgcggcggcggcggaggcggaggcgtgggggtggtgggagcgggaggcgaggagcagatggagatggaggaggacggcgccgggcttcgcgcgcgggtttctgcggggaggaaggagcgggtggtgcttatgtgggggtacctccccggcgtctcgccgcagcgctccccgctgctcgggcccgtacccgtgaggctaccggccgcggcgggcggcgatgggtggagggacgtatgcggaggcggctgcggcttcgccatggccatctcagagtctggtaaactcctcacttggggttctgctgatgatatgggccaaagctatgtgactgccgggaagcatgaggaaactccagaagcttttccacttcctagtgacgtggcaatagtgagagctgatgctggatgggctcattgtgttgcaataactgatgaaggggatgtctatacatggggttggaaagaatgtgttccaacaggaagggtcatttctgaccaatcttctggtggaactttggaaaaagatgaaagacagagtgcgattgccgctgaccaagtgagccccaggtcgcaggtgtctaggacaagtagcggagcagcatctggtccttctgaaagtagaggtactgatgatagcacgaagagacgaaggttgtcttcaaccaaacatgcacccgaaagttcaacgtccagtgatgaaaacctttcagcacccccttgtgtagtgacatttaatacaggagttaaaataatggcagtagctgctggtggtcgtcatacattagcactatcagatttaggccaagtatggggttggggctatggaggagaagggcaactaggcctgggttctagaatccggactgtttcctctccacatcctatcccgtgcattgaatcagcattgtacagcaaagatcggccagcagctatgaaaggaaacaaaagtgctgaagtgcagattagcaaagtcatgggaaattgcgtgaaggccattgcatgtgggggtcgccacagtgctgtagtaacagattcaggagcactacttacatttggatggggactgtacggacagtgtggacaaggaaacacagatgatgttttaagtccaacgtgtgtatcgtctatcctgggagtcaagatgcaagacattggtgcagggctgtggcacactgtatgcacatctgtagatggcgatgtctattccttcggaggaaaccagtttgggcagctgggcactggttctgatcaagctgagactgtaccaaaactggtagatgcctcaagcttggagaataagaatgcacgagctgtttcttgtggagctcgtcatagtgcaataataactgatgaaggcgaggtcttctgctggggatggaacaagtacggacagctcggtctcggcgattccatggacagaaacgtgccttgcagtgttcctgtcgacgcataccacccactgaatgtgtcgtgcggttggtggcacaccttggtgctcgcggagtcccctacttaaaacctgacggcgaacaaacttccctagttgacaattttgttaggagtttggtaggctttcatcaaggtgcggccgtgttgcatttcgtgtatatacatggcagtgcatgcagatatggtgtattcattctttccggtgcgctcttcaacgggcaacgtacacaagcttgtatcgcaccgcgtatacagttgggtaggaatggctgtaaggcctgtgcttgaaagtgcatgcggtgatgactgtgtccatgcttcgtcttgcattttccagttgctatatgcagacgaaattaaccggttgctatatgcagacgaaattaaccggaacgctgattacgctagaacagggacgatcatgtatggggctgatgagctatacatttctgctcccgcctctgaaatccttcagaatttgacggtcacttcgtgttaattttccctcaatccagactttatataaggcagctactactgacgcaaagacttttcatttgaatcacctcaataaatacaatatacaatgtacacatttaagattagagaccctcatttagatcatccttataaacaatgtacacaccagaattagagatcttcaggatgacggatttaaaaaaacgagcgcaatggtacagtttaagaccgcaaaggctgaattgtattgtgatcggagacatgcaagacgcccaatgacacgatataatgacatttttttctgatcttttagatcaacttatgagttgtagcaaatacacgataccataatatgggttctacatctatataggaacaacaagaacgaaaagggctgccccgttcgcaaaaaaacatttatgtacaacgagaggggtcagctacagcgatcaacgaatacttctaataaggttacacaagagctcctggatgaggctgtcgcgaacaatctgtcagtcagcaacttctttcctttaaagaacacaagcatcccacttttgcccgtagatgctcatacatttattgtgcttccatttgctagcaatcctcaagttagatactaattaataccaagctgtatgtgaaatgtcctagaacctgtactgaaaacttcagatgattagaacgaggatgtattgtggtatgaaagagtgaaagatgagagcaaccatattttgtttcaaagttccatttatatgggaggcgagtatgtaatagctgataatgattataatggaaaaatggcttcaccatggacgggcaaagcctgatagctcgagtgcccgtaaataatgcccagtttacataatcactgtcagctgactgaagggtataccagaaagttgactaaggtctatgcattgttaataaacatcccaaggcaattgtgcaaaactattattatgtttattactaaaagacatgcaaattccaactgtagtatcatcacaattctgatgaagcaatgttaaagtaagaaaaggaatgattctatctgctgaacagacttacatgtaatttcccttttcccttgcactgatgaggaggcatgatgcttagaaacggggcacttttgacagaggccccattgtgggcattggtgaaggctcagtaaccggaggtcttgtttgatggttggcaactgaattgttaattaccaatttatttcctgtgcttctaataccagcagcatcacattctggttgttgagggtccactgatacctttacctgttgcagtttattgttttaaataatccaatcaaacttttgtttgagcttattgctgaatagcacagcagcagtacatgcaatgcaagatgcccagatgatgagaataaaggcaatggcaaaaatataagtgctagttctatttcaaaataacaaacagacaacattgcattctaaacttttataaccaaacaaacaaaggaaacagggaaaattgctgaattaatgttccctttactaagtaaattctactagaaagcactagactatggtactttgatagcgattacccccatacattcaaagtcataaaacctaaaacccaaaaacaacaaaatggctacaatagccaggtcaattccctcagaagttgggtccagatgtccagttggcatattgcataacatgagtgcacatgaacgaagattaagaaaaacagtttcacaaaatataataagtaatagaatggcatttcttagtcttacaggatgtctttgcggattcttgtcctcccttaagaaaccaggaacagataagtgccaatttttttctgcatgaaaatatattcagatttaataagcaaataaagttgattctatcacatcagagaggagggttatcaacctaggtgcagcaatacatccttggcttccaggactgatgatttcctatgcttcgcaagggtacacgcaaatgcagtcacctagtaacaaataaaaaaggtcagttgatacaagttttgtccatcagataaaagaagcaaaatcagaagctcaaggtactcagattctgaatcacacggaatcacatttttcaaccaaatagaaattcactaagagcaagtgtgctgtaaaagcatgatttacaaacaacaaacacattaccgaatcaatgaagtcatcagcaatctccaaaagcaaatcttccacttctggatcaaccttgcccaggggatctacctgtaaataggagttcacaattcaaagacaaagcaaagtattattcaaccaaaagagtaaagtattattcgaccaaaagagcaaaatattattattcaaccaacaaagagaatatgcttctgaaaaatgggaatgcgattctaatatttcaagaaaaatctcaaagatcatgatacgatcacatcataccagtgatacagaagctcataagaatgaacccagaaggttatttgttacctgtgaaaccaaatcttgtatttttctcttcccaagaagttgattagttacttctgctccttgacttgcacttccaccagtcatagttccacctgataaaggagtgcccggttgtgatcctgtcaggttcatggacttctgggaaccagatgctgatatccttggagattgttgttgttgctgaagttgctgtagaatgtgttgctgctgtaaaagctgggtattgagatgaggatgctgttgttgggtttgtgcgatttggtgttgattcaatcctgactgctgttgaagttgatgtattaatagcatcctttgttgatgctgaaattgttgtggagaaacaggtgatcccagcgatgattgcatttgttttaaccatgctgcctgctgctgtttctgaggaagggacatttgtgccatcggcccatttgtcgacgatccaggtagctgtggatttaatgcagcaatcgatgctgttcttgtcaagccttgacccacaaccttctgataaataaaccaagatagaagttatccgcataaacatgagaggtgctagaaaaattgatgcacgcaactgtcacaagttaaaaatagaatatccatggtgcaaagttaataagcatagttctgattaatcctaaaagaaaaagggaaaaggacacacaaatgcttaactctcatgcagttttagtgggtaaaagcataattttagtaactgtgtgtaaagatacatcagaaagctgccaagagattaatattagcttctttgatcagtacctgttaatatatgttctttaaaaaggaccttggctatttgctgcggcatgcattcacatataataacaataaggccatgaaagatacatatggtaaggtaaggactaaggaggtgggtgcttgataaccaaagataattcttttgcttacggaagtcaagtacctgtggagacagtgtgccttgctgtgatgtctgctgcggcctcaattgtgcttgtgcatgggcaaaacgttgctgattatatggaatagttccatttcctctcataccacccatgactcccatggactgcataccttgtaatgcttgagctgcattggcagtattaaattgtgcaccttgcaccatacccttctgccttggctgcagcaacaagaaaaaccaattatgctagtaatacaatcagatggtgatagttactagttaccttcaactgaattattttccccaataataataatt

SEQ ID NO: 1602 - DNA, 2144 bp, Oryza sativa
gcaagtggccgccgcttccccaccccaaccaaaccaacgccttctcctcctcctcccccccgtggccgccgcgaggcgagagcgatcgagacggaggcggcgacgacggcgacggagaaggtagcggaggaatcggcggcggatacggggaggacgggtgctcccgaggagatgaacggccgcggcggcggcggaggcggaggcgtgggggtggtgggagcgggaggcgaggagcagatggagatggaggaggacggcgccgggcttcgcgcgcgggtttctgcggggaggaaggagcgggtggtgcttatgtgggggtacctccccggcgtctcgccgcagcgctccccgctgctcgggcccgtacccgtgaggctaccggccgcggcgggcggcgatgggtggagggacgtatgcggaggcggctgcggcttcgccatggccatctcagagtctggtaaactcctcacttggggttctgctgatgatatgggccaaagctatgtgactgccgggaagcatgaggaaactccagaagcttttccacttcctagtgacgtggcaatagtgagagctgatgctggatgggctcattgtgttgcaataactgatgaaggggatgtctatacatggggttggaaagaatgtgttccaacaggaagggtcatttctgaccaatcttctggtggaactttggaaaaagatgaaagacagagtgcgattgccgctgaccaagtgagccccaggtcgcaggtgtctaggacaagtagcggagcagcatctggtccttctgaaagtagaggtactgatgatagcacgaagagacgaaggttgtcttcaaccaaacatgcacccgaaagttcaacgtccagtgatgaaaacctttcagcacccccttgtgtagtgacatttaatacaggagttaaaataatggcagtagctgctggtggtcgtcatacattagcactatcagcttcagatttaggccaagtatggggttggggctatggaggagaagggcaactaggcctgggttctagaatccggactgtttcctctccacatcctatcccgtgcattgaatcagcattgtacagcaaagatcggccagcagctatgaaaggaaacaaaagtgctgaagtgcagattagcaaagtcatgggaaattgcgtgaaggccattgcatgtgggggtcgccacagtgctgtagtaacagattcaggagcactacttacatttggatggggactgtacggacagtgtggacaaggaaacacagatgatgttttaagtccaacgtgtgtatcgtctatcctgggagtcaagatgcaagacattggtgcagggctgtggcacactgtatgcacatctgtagatggcgatgtctattccttcggaggaaaccagtttgggcagctgggcactggttctgatcaagctgagactgtaccaaaactggtagatgcctcaagcttggagaataagaatgcacgagctgtttcttgtggagctcgtcatagtgcaataataactgatgaaggcgaggtcttctgctggggatggaacaagtacggacagctcggtctcggcgattccatggacagaaacgtgccttgcagtgttcctgtcgacgcataccacccactgaatgtgtcgtgcggttggtggcacaccttggtgctcgcggagtcccctacttaaaacctgacggcgaacaaacttccctagttgacaattttgttaggagtttggtaggctttcatcaaggtgcggccgtgttgcatttcgtgtatatacatggcagtgcatgcagatatggtgtattcattctttccggtgcgctcttcaacgggcaacgtacacaagcttgtatcgcaccgcgtatacagttgggtaggaatggctgtaaggcctgtgcttgaaagtgcatgcggtgatgactgtgtccatgcttcgtcttgcattttccagttgctatatgcagacgaaattaaccggttgctatatgcagacgaaattaaccggaacgctgattacgctagaacagggacgatcatgtatggggctgatgagctatacatttctgctcccgcctctgaaatccttcagaatttgacggtcacttcgtgttaattttccctcaa

SEQ ID NO: 1603 - DNA, 1927 bp, Triticum aestivum
tgtggccgccagcgagcgcgagcgagggcgatcgagacggaggtggtggcggagaatacggccgtgggtacggagtttttcgaggagatgaacggcggcgacggcgggggaggggaggtgggcttcgtggggggaggcggggaggaggaggagatggacgaggacggcgcgcgggaggcggggaaggagcaggtggtgctgatgtggggctacctccccggcgtctcgccgcagcgctcgccgctgctgggccccgtgcccgtcaggctgcccccggcggcggccggcgacgcctggagggatgtctgcggcggcgggtgcggcttcgccatggccatctccgagtctggaaaactcctcacctggggctctactgacgatatgggtcaaagttatgtgacggctgggaagcacgaggagactccagaggcttttcctcttcctagtgatgttgcgatagcgagggctgatgctgggtgggctcattgtgttgcaataaccgatgaaggggttgtctatacatggggttggaaagaatgtgttccaactggaagggtcattgcagatcaagcttcagttggaactttggagaaggatgaaagacagagcgcaattgccaacaaccaagtgagccccaggtcacaggcgtctaggacaagcagtggagcagcatctggtccttctgaaagtagaggtaccgaggatagcaccaagaggcgacggttgtcttcagctaaacaaggaaatgacagttcgacatctggtgatgaaaacctttctgcaccaccttgtgttgtgacatttaatactggggtgaaaataacggcagtagctgctggtggtcgccatacattagcattatcagattttggtcaggtatggggttggggatatggaggagaagggcaactgggtctggggtccagaattcgtacagtttcctcccctcaccctataccttgcattgaatcaacatcgtacggcaaggatcggctatcagctatgaaaggcaacaaaaacgctgaagggcaaattaataaagtaacaggaaatcgtgtgacggccattgcgtgtggaggccgccatagtgttgtggtaacggattcaggagcacttcttgcatttgggtggggactgtacgggcagtgtggacaagggaatacagatgatgtgttgagcccaacatgtgtatcagctattctgggagtcaagatgcaagatgttgccgcagggttatggcatacagtatccatatctgcagatggtgatgtctattcgtttggaggcaaccagttcgggcagctggggattggttctgatcaagctgagactataccaaaactggtggatgcccccagcttggaaaataagaatgcaagatcagtgtcttgtggagctcgtcatagtgcaataataacagatgagggcgaagtcttctgctggggatggaacaagtacggccagctgggcctcggcgactccatggacagaaacgtgccctgcatcgtccccgtggacgagtaccacccgctgaacgtgtcgtgcggctggtggcacaccttagtgctcgcggagtccccgacgtgatgccgaacccctagcgaaggaggagctgaactgcccccgtaggtcaggtgacaattttgttaggagtttggtagacccatcatccacccaggtcccttgtacatacatgaatgagggtgcatacagtgacattgtgtatccatccattcttccctgtcaccggtacagagtgcagcattggacggacagatttgtatcgcgctgtgtgtatacggtcgagttaggaggatttgctcgcactgtttgattgtgtatacttacaatctactattaggttcaaagagcgcgataatttgtgcttgtatggtgctcccgcatttccagctatcttaacagagat

SEQ ID NO: 1604 - DNA, 1797 bp, Avena sativa
agcgagcgtgagcgatcgagagacggaggtaatagcggcggtggcgagtacggacttttccgaggagatgaacggaggcggcggcggcggtggaggagaagtgggttcagtagggggcggggaggaagatatggaggaggacggcgcgcagggggtgtccgctaaggagcagctggtgctgatgtggggtacctccccggcgtctcgccgcagcgctcgccgctgctgggacccgtgcccgtcaggctgcccccggcggcggccggcgacgtgtggagggacgtctgcggcggagggtgcggcttcgccatggccatctccgagtctggaaaactcctcacctggggatctactgatgatatgggacaaagttatgtgactgctggaaagcacgaggagactccagaggcttttcctcttcctagtgatgttgccatagtgagggctgatgctgggtgggctcattgtgttgcaataacagatgaaggggttgtctatacatggggttggaaagaatgtgttccaactggaagggtcgttgcaaaccaatcttcggttggaactttggagaaggatgaacgacaaagtgcagttgccagtgaccaagtgagtcccaggtcccaggtatctaggacaagtagcggagcggcatctggtccttctgaaagtagaggtaccgaggacagcacgaagagacgccgattgtcttcagcaaaacagggccaagacagttcgacatctaatgatgaaaacctttccgcaccaccttgtattgtgacatttaatactggagtgaaaatagcggcagtagctgctggtggccgccatacattagcactatcagattttggtcaagtatggggatggggatatggaggagaagggcaactgggtctggggtccagaatcaggacagtttcctctcctcatcctataccgtgcattgaatcggcttcgtatggcaaggatcggtcagcagctacgaaaggcaacagaaacactgaagggcatatcaataaggtcatgggaaatcgtgtgaaatccattgcttgtggaggtcgccatagtgttgtggtaacagattctggagcacttcttgcttttgggtggggactgtacggacagtgtggacaagggaatacggatgatgttttgagtccaacatgtgtatcatctattctaggagtgaatatgcaagatgttgctgcagggttgtggcacactgtatgcatatctgaagatggtggtgtctattcctttggaggcaatcagtttgggcagctgggggttggttctgatcaagctgagactataccaaaattggtggacgccccaagcttggatgataagaatgcaagatcggtctcttgtggagctcgtcatagtgccataataacagacgaaggagaggtcttctgctggggatggaacaagtacggccagctgggtcttggcgactcgatggacagaaatgtgccttgcattgttcctgtggacgcataccgcccactgaatgtgtcatgtggttggtggcacacgttagtgctcgctgagtctcctacgtgaaccccatcgaagaaggaactgcccttaggtgacatttttgtaggaatttggtagtctcatccaggtctcttgtacatacatgacggtgcatacagatatatgtgtatccattctttcgggtgcaccattacaggagtgcggcgtggacaggtttacattgcgctggttgagaagtactgcctgtacgcttgcactgtttaattgtgtatacagtcgagtaggatttgccac

SEQ ID NO: 1605 - DNA, 2045 bp, Brachypodium distachyon
aagcaagtgaccgctgctccccagttcgccctcgccaaaccaacgccatctccctccctcccgttcccgtgtggccgcaagcgagcgatcgagacgaagtcggagacggagatagtagcgggcgattcggcggtgagtacggagatttcgaggagatgaacggcggcggcggcgtagaagcgggtttaggagggggaggggaggaggagatggatgaggacggcgtatgccctgcgctggggatggggaaagagcaggtggtgctgatgtgggggtacctccccggcgtctctccgcagcgctcgccgctgctggcgcccgtgcccgtgaggctgcccctggcggcgaccggcgatgcgtggagggatgtatgcggcggagggtgcggctttgccatggccatctccgagtctggaaaactcctcacctggggctctactgatgatatgggccaaagttacgtgactgctgggaagcacgaggagactccagaggcttttcctcttcctagtgatgttgtgatagctagggccgatactgggtgggctcattgtgttgcaataacagaggaaggggttgtctatacatggggttggaaagaatgtgttccaactggaacggtcattgcagaccaatcttcagttggaactttggaaagggatgaaagtcagagtgcaagtgccagtaaccaagttagcccaaggtcgcatgtgtctagtagaacaagcagcggagcggcatctggtccttctgaaagtagaggtgccgaggagagcacaaagagacgccggctgtcttcagcaaaacaaggacctgacagctcgacatctagtgatgaaaacctttctgcacccccttgcattgtcacatttaatactggagtgaaaattacagcagtggctgcaggtggtcgccatacattagcactatcagattttggtcaggtatggggttggggatatggaggagaagggcaactgggtctggggtctagaattcgaacagtttcctctcctcatcctataccgtgcattgaatcggcattatacggcaaggaccggccggccgctatgaaaggcaacaaaaatgctgaaacgcagattagtaaagtcatgggaaattgcgtgaaggccattgcctgtggaggccgccatagtgttgtggtaacagattcagggacacttcttacatttgggtggggactatacggacagtgtggacaagggaacacagacgacgttttgagtccaacatgtgtatcatctattctgggagtcaagatggaaggtgctgccgcagggttatggcatactgtatgcatatctgtagatggtgatgtctattcctttggaggcaaccagtttgggcagctgggtactggttctgatgaagctgagactgtaccgaaattggtggacgcctcatgcttggaaaacaagaatgcaagaactgtatcttgtggagcccgtcatagtgcaataataacagatgaaagcgaggtcttctgctggggatggaacaagtacggccagctgggtctcggtgactcgatggacagaaacgtgccctgcattgtccccatggacgcgtaccgcgcactgaatgtgtcgtgtggttggtggcacaccttagtgctggcggagtctcctacgtgaaccctcctaggaagaaggaacgacccgtaggtgacaattttgttaggaattcagtagactcatcatacaggtgtggctacgctgcatctcgtgtacatacatgacggtgcatataccagatatgtgtatccattcttttcggtgcatccttacagcgtgcaacgtggacaggtctgtattgctctgtgtatacagtcgagtaggagtgcccgtacccttgcatagtgtatacggtcgagtaagattgtgaagcaagtcgggtaagattgtgacgcttgttgcttgagaagcgcgtgtgatttcgatttcgctttcgcttgtacgggcatagtgcggtgacctatcatttccagctatctaacagagaaagcagtactgagcttattttat

SEQ ID NO: 1606 - DNA, 1901 bp, Brachypodium distachyon
atttcgaggagatgaacggcggcggcggcgtagaagcgggtttaggagggggaggggaggaggagatggatgaggacggcgtatgccctgcgctggggatggggaaagagcaggtggtgctgatgtgggggtacctccccggcgtctctccgcagcgctcgccgctgctggcgcccgtgcccgtgaggctgcccctggcggcgaccggcgatgcgtggagggatgtatgcggcggagggtgcggctttgccatggccatctccgagtctggaaaactcctcacctggggctctactgatgatatgggccaaagttacgtgactgctgggaagcacgaggagactccagaggcttttcctcttcctagtgatgttgtgatagctagggccgatactgggtgggctcattgtgttgcaataacagaggaaggggttgtctatacatggggttggaaagaatgtgttccaactggaacggtcattgcagaccaatcttcagttggaactttggaaagggatgaaagtcagagtgcaagtgccagtaaccaagttagcccaaggtcgcatgtgtctagtagaacaagcagcggagcggcatctggtccttctgaaagtagaggtgccgaggagagcacaaagagacgccggctgtcttcagcaaaacaaggacctgacagctcgacatctagtgatgaaaacctttctgcacccccttgcattgtcacatttaatactggagtgaaaattacagcagtggctgcaggtggtcgccatacattagcactatcagattttggtcaggtatggggttggggatatggaggagaagggcaactgggtctggggtctagaattcgaacagtttcctctcctcatcctataccgtgcattgaatcggcattatacggcaaggaccggccggccgctatgaaaggcaacaaaaatgctgaaacgcagattagtaaagtcatgggaaattgcgtgaaggccattgcctgtggaggccgccatagtgttgtggtaacagattcagggacacttcttacatttgggtggggactatacggacagtgtggacaagggaacacagacgacgttttgagtccaacatgtgtatcatctattctgggagtcaagatggaaggtgctgccgcagggttatggcatactgtatgcatatctgtagatggtgatgtctattcctttggaggcaaccagtttgggcagctgggtactggttctgatgaagctgagactgtaccgaaattggtggacgcctcatgcttggaaaacaagaatgcaagaactgtatcttgtggagcccgtcatagtgcaataataacagatgaaagcgaggtcttctgctggggatggaacaagtacggccagctgggtctcggtgactcgatggacagaaacgtgccctgcattgtccccatggacgcgtaccgcgcactgaatgtgtcgtgtggttggtggcacaccttagtgctggcggagtctcctacgtgaaccctcctaggaagaaggaacgacccgtaggtgacaattttgttaggaattcagtagactcatcatacaggtgtggctacgctgcatctcgtgtacatacatgacggtgcatataccagatatgtgtatccattcttttcggtgcatccttacagcgtgcaacgtggacaggtctgtattgctctgtgtatacagtcgagtaggagtgcccgtacccttgcatagtgtatacggtcgagtaagattgtgaagcaagtcgggtaagattgtgacgcttgttgcttgagaagcgcgtgtgatttcgatttcgctttcgcttgtacgggcatagtgcggtgacctatcatttccagctatctaacagagaaagcagtactgagcttattttat

SEQ ID NO: 1607 - DNA, 2076 bp, Secale cereale
gtgtggccgccagcgagcgcgcgagcgagagttcgagacggaggcgatagaggcggcgagtacggggattttcgacgagatgaacggcggcggcggcggaggaggggaggtgggcttcgtggggggcggcggggaggaggagatggacgaggacggcgcgcgggagcggggaaggagcaggtggtgctgatgtggggctacctccccggcgtctcgccgcagcgctcgccgctgctgggccccgtgcccgtcaggctgcccccggcggcggccggcgacgcctggagggatgtctgcggcggagggtgcggcttcgcgatggccatctccgagtctggaaaactcctcacctggggctctactgacgatatgggtcaaagttatgtgacggctgggaagcacgaggagactccagaggcttttcctcttcctagtgatgttgcgatagcgagggctgatgctgggtgggctcattgtgttgcgataacagatgaaggggttgtatatacatggggttggaaagaatgtgttccgactggcagggtcattgcagaccaagcttcagttggaactttggaaaaggatgaaagacagagcgcaattgccaacaaccaagtgagccccaggtcacaggcgtctaggacaagcagtggagcagcatctggtccttctgaaagtagaggtaccgaggatagcaccaagaggcgacggttgtcttcagctaaacaaggaaatgacagttcgacatctggtgatgaaaacctttctgcaccaccttgtgttgtgacatttaatactggagtgagaataacggcagtagctgctggtggtcgccatacattagcattatcagattttggtcaggtatggggttggggatatggaggagaagggcaactgggtctggggtccagaattcgtacagtttcctcccctcaccctataccttgcattgaatcaacatcgtatggcaaggatcggttatcagctatgaaaggcaacaaaaacgctgaagggcaaattaataaagtaacaggaaatcgtgtgacggccattgcgtgtggaggccgccatagtgttgtggtaacggattcaggagcacttcttgcatttgggtggggactgtacgggcagtgtggacaagggaatacagatgatgtgttgagcccaacatgtgtatcagctattctaggagtcaagatgcaagatgttgccgcagggttatggcatacagtatccatatctgcagatggtgatgtctattcgtttggaggcaaccagttcgggcagctggggattggttctgatcaagctgagactataccaaaactggtggatgcccccagcttggaaaataagaatgcaagatcggtgtcttgtggagctcgtcatagtgcaataataacagatgaaggcgaagtcttctgctggggatggaacaagtacggtcagctgggcctcggcgactctatggacaggaacgtgccctgcatcgtccccgtggatgcgtaccacccgctgaatgtgtcgtgcggctggtggcacaccttagtgctcgccgagtctcctacgtgagccaaaccgaaccctagcgaagaaggagctgaactacccggtaggtcaggtgacaattttgttaggagtttggtagacccatcatccatccaggtcccttgtacatacatgacggtgcatacagtgacattgtgtatccatccattcttccctgtgcaccgctgcagagtgcagcattggacggacaggtttgtattgcgctgtgtgtatacggtcgagttaggaggatttgctctgcctgtaccgcttgcactgtttgattgtgtatacttacattctagtaggttgaaagtgggcgttatttgtgcctgtacggtgccctggcatttccagctttgttctgctcggtggttccttgagaattttgcactatgttggccacagatggcagatatcagctcgaaagtagaaacgggtcacagcagcaaagaaccgtcgacaactcatcaatccagcatctttgacaggctgcacaagtatgaaagatgctgagcggggggg

SEQ ID NO: 1608 - DNA, 1651 bp, Triticum aestivum
caggtggtgctgatgtggggctacctccccggcgtctcgccgcagcgctccccgctgctgggccccgtgcccgtcaggctgccccccgcggcggccggcgacgcctggagggatgtctgcggcggcgggtgcggcttcgccatggccatctccgagtctggaaaactcctcacctggggctctactgacgatatgggtcaaagttatgtgacggctgggaagcacgaggagactccagaggcttttcctcttcctagtgatgttacgatagcgagggctgatgctgggtgggctcattgtgttgcaataacggatgaaggagttgtctatacatggggttggaaagaatgtgttccaactggaagggtcattacagaccaagcttcagttggaactttggaaaaggatgaaagacagagcgcaattgccaacaaccaagtgagccccaggtcacaggcgtctaggacaagcagtggagcagcatctggtccttctgaaagtagaggtaccgaggatagcaccaagaggcgacggttgtcttcagctaaacaaggaaatgacagttcgacatctggtgatgaaaacctttctgcaccaccttgtgttgtgacatttaatactggggtgaaaataacggcagtagctgctggtggtcgccatacattagcattatcagattttggtcaggtatggggttggggatatggaggagaagggcaactgggtctggggtccagaattcgtacagtttcctcccctcaccctataccttgcattgaatcaacatcgtacggcaaggatcggctatcagctatgaaaggcaacaaaaacgctgaagggcaaattaataaagtaacaggaaatcgtgtgacggccattgcgtgtggaggccgccatagtgttgtggtaacggattcaggagcacttcttgcatttgggtggggactgtacgggcagtgtggacaagggaatacagatgatgtgttgagcccaacatgtgtatcagctattctgggagtcaagatgcaagatgttgccgcagggttatggcatacagtatccatatctgcagatggtgatgtctattcgtttggaggcaaccagttcgggcagctggggattggttctgatcaagctgagactataccaaaactggtggatgcccccagcttggaaaataagaatgcaagatcagtgtcttgtggagctcgtcatagtgcaataataacagatgagggcgaagtcttctgctggggatggaacaagtacggccagctgggcctcggcgactccatggacagaaacgtgccctgcatcgtccccgtggacgagtaccacccgctgaacgtgtcgtgcggctggtggcacaccttagtgctcgcggagtccccgacgtgatgccgaacccctagcgaaggaggagctgaactgcccccgtaggtcaggtgacaattttgttaggagtttggtagacccttcatccacccaggtcccttgtacatacatgaatgagggtgcatacagtgacattgtgtatccatccattcttccctgtgccggtacagagtgcagcattggacggacagatttgtatcgcgctgtgtgtatacggtcgagttaggaggatttgctcgcactgtttgattgtgta

SEQ ID NO: 1609 - DNA, 1178 bp, Setaria italica
gtggcgccgcggatgcgcctcatctccccggcggccaccgcgcgcggtttagatttccctgggcccccctcgcggtaccgtcacatatttttggcgcctcttcttctgcgcccctctcctcccgaaccgcagataccacagagagtcggcagctgaacacaagcaacaagcaagggatccatggcggctcaggctctcctctccggccggcagctgctcggccgccccgtgcaagccgtctcccggtcgtccgcgaggaaggcgcccttcgtcgtcagggccagctccagccctccggccaagcaaggcgctgacaggcagctgtggttcgcgtccaagcaatccctctcctacctcgatggcacgctgcccggcgactacggtttcgacccgctgggcctctccgacccggagggcaccggcggcttcatcgagcccaagtggctggcctacggggaggtgatcaacgggcgcttcgccatgctgggcgctgcgggcgccatcgctccggaggtcttcggcaagctgggcctcatcccgccggagacggcgctgccgtggttcaagacgggggtcatcccgccggcgggcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcggcccgctcttcaacccgctcgggttcggaaagaccgagaaggagatgaaggagctcaagctcaaggagatcaagaacggcaggctcgccatgctcgccatcctcgggtacttcatccaggggctcgtcaccggcgtcggccccttccagaacctgctcgaccacctcgccgaccccgtcaacaacaacgtcctcaccagcctcaagttccactagagcattgctgcctgttgtgttgtagtggaagcgagacgtgatgtgtgcatgattcatggcctactcgctgcttataacaaattagtaatcgatcctgttaattgagaccagaaattgtatcacacatggtaaatcattgtacaattccgaccgactctagtgttatatatatggtgagcgaacgtgttatttcatct

SEQ ID NO: 1610 - DNA, 1070 bp, Pennisetum glaucum
accacagttgtcggcagctcaacgcacaagcaaacaagcaagtgatccatggcggctcaggctctcctctccggccggcagctgctcggccgccccgtgcaagccgtctcccggtcgtcggcgaggaaggcacccttcgtcgtcagggccagctccagccctccggccaagcaaggcgccgacaggcagctgtggttcgcgtccaagcaatccctcagctacctcgatggcacgctgcccggtgactacggcttcgacccgttgggcctgtcggacccggagggcaccggcggcttcatcgagcccaagtggctggcatacggggaggtgatcaacgggcggttcgccatgctgggcgcagcgggcgccatcgccccggaggtcttcggcaagcttggcctgatcccaccggagacggcgctgccgtggttcaagaccggggtcatcccgccggcgggcacctacaactactgggccgactcgtacacgctcttcgtcttcaacatggcgctcatgggcttcgccgagcaccgccgcctccaggactggtacaacccggggtccatgggcaagcagtacttcctcggcctcgagaagttcctcggcggctccggcgacccgtcctaccccggcggcccgctcttcaacccgctcgggttcggcaagactgagaaggagatgaatgagctcaagctcaaggagatcaagaacggcaggctcgccatgctcgccatcctcgggtacttcatccaggggctcgtcaccggcgtcggcccgttccagaacctgctcgaccacctctccgaccccgtcaacaacaacgtcctcaccagcctcaagttccactagagcattgctgccctgttgttgctgtacgtagtggaagcgagacattggtgtgttgttcatatgcacgtacgctgggctggctgatggaaatgggattgaggcgtttgcgtcatgcatgattcatatggctagccctgcttgctgcctgtaacaaattagtaatggatcgatcctgttaattgagaccagacattgtactgcacgtggtaaatcaatataca

SEQ ID NO: 1611 - DNA, 1259 bp, Panicum virgatum
gcgcctcttcttgtgcgcccctctcctcctcccgaaccgcacgcagacaccacagaccgcagggcaccccgtgtcggcagcggagcagaagcagcgagcgatccatggcggcccaggctctcctctccgggcggcagctgctcggccgccccgtgcagtcggccgtctcccggtcctcgtcggccaggaaggcgcccttcgtcgtcagggccagctccagcccgccggccaagcaaggcgccgaccggcagctgtggttcgcgtccaagcagtccctctcctacctcgatggcacgctgcccggcgactacggcttcgacccgctggggctgtcggacccggagggcaccggggggttcatcgagcccaagtggctggcctacggcgaggtgatcaacggccggttcgccatgctgggcgcggcaggcgccatcgccccggagatcttcggcaagctgggcatcatcccggcggagacggcgctgccgtggttcaagacgggggtcatcccgcccgcgggcacctacaactactgggccgactcgtacacgctcttcgtcttcaacatggcgctcatgggcttcgccgagcaccgccgcctccaggactggtacaacccgggctccatgggcaagcagtacttcctcgggcttgagaagttcctcggcggctccggcgacccctcctacccggggggcccgctcttcaacccgctcgggttcggcaagacggagaaggagatgaaggagctcaagctcaaggagatcaagaacggcaggctcgccatgctcgccatcctcggatacttcatccaggggctcgtcaccggcgtcggcccctaccagaacctgctcgaccacctcgccgaccccgtcaacaacaacgtgctcaccagcctcaagttccactagatgccgccgccgccgcctgttgtcgttgtagtggaagcgagaggtgatcgtcgatgtgctgttcatatgctggcgggctggctggctgatggaagaggtttgcatcgtgcatgatctatccatggccggcctgcttgctgcttgtaacaaattagtaaatccatcctgttaattgagaccagaaattgtattgcacatggtaaatcaatgtacaattccgatcgattggggtgatgtcattgtatatggtcatatggtgggcgacgagccgacgacgtccatttcatcttaccatcagttcatggttgtctaccctctatagaacaaaaacaaaaagattatgagcgc

SEQ ID NO: 1612 - DNA, 1218 bp, Panicum virgatum
attctccgcgcgctcttcttctgcgcccctctcctcccgaacagcagataccacacaagcagcggcagcgagtgatccatggcggcccaggctctcctctccgggcggcagctgctcggccgccccgtgcagtcggccgtgtcccggtcctcgtcggccaggaaggcgcccttcgtcgtcagggccagctccagcccgccggccaagcaaggcgccgacaggcagctgtggttcgcgtccaagcagtccctctcctacctcgatggcacgctgcccggcgactacgggttcgacccgctggggctgtcggacccggagggcacaggggggttcatcgagcccaagtggctggcctacggcgaggtgatcaacggccggttcgccatgctgggcgcggcgggcgccatcgccccggaggtcttcggcaagctgggcatcatcccggcggagaccgcgctgccgtggttcaagacgggcgtgatcccgcccgcgggcacctacaactactgggccgactcgtacacgctcttcgtcttcaacatggcgctcatgggcttcgcggagcaccgccgcctccaggactggtacaacccgggctccatgggcaaacagtacttcctcggcctcgagaagttcctcggcggctccggcgacccctcctaccccgggggcccgctcttcaacccgctcggcttcggcaagacggagaaggagatgaaggagctcaagctcaaggagatcaagaacggcaggctcgccatgctcgccatcctcggctacttcatccaggggctcgtcaccggcgtcggcccctaccagaacctgctcgaccacctcgccgaccccgtcaacaacaacgtgctcaccagcctcaagttccactagagatgccgccggccgccgcctgttgttgtagtgggagcgagagaggtgatcgtcgatgtgtgttcgtcatgtgctggctgatgggaaggattattccgaggcgctgcatgatccgtccattgcccggcctgctcgctgcttgtaacaaattagtaatccatccatcctgttaattcagacccaggaactgtactactgcacatggtaaatcaatgtacaattccgatcgactccagtgtcattatatatgttgagcgacgacggcgtccatttcatcttaccatcagttcatggttgtctaattaaccctccagaacaaaaaagaagaacatt

SEQ ID NO: 1613 - DNA, 1449 bp, Sorghum bicolor
gtggccccgcggatgcggcctcatctccccggcgcggttttagatttccctgggcccctccgatccaccacctcgcggcagccacggtcatcacatactttccgcgcctcttcttctgtgctgtgcccctctcctcccacccaaactgcggaggtacagcagcgacacgatctcgccaccgcacgcaccttgtccgaagctcagcaccgatctatggcggctcaggctctcctctcccgcccggccgtgcagtcggccgtctccaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggattcgacccgctggggctctcggacccggagggcaccggcggcttcatcgagcccaagtggctggcctacggcgaggtgatcaacgggcgcttcgcgatgctgggagcggcgggcgccatcgccccggaggtcttcgggaagctgggcatcatcccgccggagacggcgctgccgtggttcaagacgggggtgatcccgccggcgggcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcggcccactcttcaacccgctcggcttcggcaagaccgagaaggagatgaatgagctcaagctcaaggagatcaagaacggcaggctcgccatgctcgccatcctcggctacttcatccaggggctcgtcaccggcgtcggcccgttccagaacctgctcgaccacctctccgaccccgtcaacaacaacgtgctcaccagcctcaagttccactagaacgtccgttggttgctgcatcatacctgttgttcatatgctctggcttggctgatgcatggaaaggagcctgaagcgttgcatcaggactcatggccagcctgctgctgcttgtaacaaattagtattgatcttgttgagaccacaaactatattgcacatggtaaatcaatgtacaattccctccctagacgctgaaaaattgatcttaagggcacacatcccctaggcatccaatggtggatgcacgtggggatgtatgtgtagcagaactgcagaagagagcatgtactctatgtgtattcaatggtgatgcacatgggagcacgtatgcttagagacaaaacagcattacattaccttcccttctgttttttgtcaatatttgcggccaatgaaagagcgaagttttgtatcatttcacggtgctaattaacctaccctagc

SEQ ID NO: 1614 - DNA, 1747 bp, Sorghum bicolor
gacttttcctctataggcttcgtttgagccaaaaacgtctcatccacattcagataggccaaattatccaacatccatcaccagcgtaccatacgtacgcgtggtcgtgccctgggggcagttgggcggaaaaaagaaaatctcggccaagtgttgaggcgtgcgtgcatgccagcggcccagcgactgccaacgcctgcgagccacatgcccctggcgcccccttatcccatcgtagccgccacacggcgcgccgccagtggccccgcggatgcggcctcatctccccggcgcggttttagatttccctgggcccctccgatccaccacctcgcggcagccacggtcatcacatactttccgcgcctcttcttctgtgctgtgcccctctcctcccacccaaactgcggaggtacagcagcgacacgatctcgccaccgcacgcaccttgtccgaagctcagcaccgatctatggcggctcaggctctcctctcccgcccggccgtgcagtcggccgtctccaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggattcgacccgctggggctctcggacccggagggcaccggcggcttcatcgagcccaagtggctggcctacggcgaggtgatcaacgggcgcttcgcgatgctgggagcggcgggcgccatcgccccggaggtcttcgggaagctgggcatcatcccgccggagacggcgctgccgtggttcaagacgggggtgatcccgccggcgggcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcggcccactcttcaacccgctcggcttcggcaagaccgagaaggagatgaatgagctcaagctcaaggagatcaagaacggcaggctcgccatgctcgccatcctcggctacttcatccaggggctcgtcaccggcgtcggcccgttccagaacctgctcgaccacctctccgaccccgtcaacaacaacgtgctcaccagcctcaagttccactagaacgtccgttggttgctgcatcatacctgttgttcatatgctctggcttggctgatgcatggaaaggagcctgaagcgttgcatcaggactcatggccagcctgctgctgcttgtaacaaattagtattgatcttgttgagaccacaaactatattgcacatggtaaatcaatgtacaattccctccctagacgctgaaaaattgatcttaagggcacacatcccctaggcatccaatggtggatgcacgtggggatgtatgtgtagcagaactgcagaagagagcatgtactctatgtgtattcaatggtgatgcacatgggagcacgtatgcttagagacaaaacagcattacattaccttcccttctgttttttgtcaatatttgcggccaatgaaagagcgaagttttgtatcatttcacggtgctaattaacctaccctagcaaaaatgagtatatctggtttagcaaaattctttttttt

SEQ ID NO: 1615 - DNA, 1078 bp, Cynodon dactylon
cgggggcagaccagcagcgaccacacagtagttgaagctaggaagcagtaatggcgactcaggctctcctctctggccggcagctgctcggccggcccgtgcagtccgccgtgtcccgggcgtcgtcgtccaggaagccgttcgtcgtcagggccagctccagccctcccgccaagcaaggagcggacaggcagctgtggttcgcgtccaagcagtccctcacctacctcgatggaacgctgcccggcgacttcgggttcgacccgttgggtctgtctgacccggagggcaccggcgggttcatcgagcccaagtggctggcgtacggcgaggtgatcaacgggcggttcgctatgctgggcgcggcgggcgccatcgcgccggagatcttcggcaagctgggcctcatcccggaggagacggcgctgccgtggttcaagacgggcgtcatcccacctgctggcacctacaactactgggccgacccctacacgctcttcgtcttcaacatggcgctcatgggcttcgccgagcaccgcaggctgcaggactggtacaaccccggctccatgggcaagcagtacttcctcggcctcgagaagttcctcgccggctccggcgaccccgcctaccccggcgggcccatcttcaacccgcttggcttcggcaaggacgagaagtccatgaaggagctcaagctcaaggagatcaagaacggcaggctcgccatgctcgccatcctcggctacttcatccagggcctcgtcacaggcgtcggaccctaccagaacctgctcgaccacctctccgaccccgtcaacaacaacgtgctcaccagcctcaagttccactaaaagattgctacgttgttgctggcttgctgctgcctgttgatgcaagcggcgagatgtgtgtgtattcgtgtgctggctgacgaggaagcgtttgaggcaatactgtatcacgtatgaatcgtggccagccttctcgctgcatgtaacaaattagcaattgatcgtgttgagaccagatattgtatcgcacatggtaaattaatgtacaacaccctctccgtttt

SEQ ID NO: 1616 - DNA, 855 bp, Saccharum officinarum
atactttccgcgcctcttcttctgtgcccctctcctcccaaactgcggatagagcagcgacgcgatcgcgagcgcacgcacgcacgttgtcggaagctcaagttagaagcaccggtgcctgatcgatggcggctcaggctctcctctccggccggcagctgctgggccgccccgtgcagtcggccgtctccaggtcgtcggcgaggaaggcgcccttcgtcgtcagggccagctccagccctccagccaagcaaggtgccgacaggcagctgtggttcgcctccaagcagtccctctcctacctcgatggcacgctgcccggcgactatgggttcgacccgctggggctctcggacccggagggcaccggcggcttcatcgagcccaagtggctggcctacggcgaggtgatcaacgggcgcttcgccatgctgggcgcggcgggcgccatcgcgccggaggtcttcggcaagctgggcatcatcccgccggagacggcgctgccgtggttcaagacgggcgtcatccctcccgcgggcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgttctaccccggcgggcccctcttcaacccgctcggcttcggcaagaccgagaaggagatgaatgagctcaagctcaaggagatcaagaacggcacgctcgccatgctcggcatcctcggctactttatccaggggctcgtcaccggggtcggcc

SEQ ID NO: 1617 - DNA, 1084 bp, Phalaenopsis aphrodite
tttcaaaaggaaaccagaactcaattttgttccttcaaatccaataaggaagcgaaaactatacaatgacttctgctcaagctctgctctcgtcaatggaggccggaaggcagctccttggtggcaggatactgcagtcttcttcttcttctaaaaacattggttctcagagaaggccctcttttgtagtcagagcttcttcttcccctcctgctcggcaaggagcagaccggcagctatggtttgcttccaaacaatctctctcatacttggatggaagccttcccggcgactatgggttcgacccattgggcctttcagatccagagggcactggtgggttcatcgagcccaaatggctggcttatggtgaggtcatcaacggtcgctacgccatgctcggtgctgttggggccatcgccccagagatcctcggcaaactgggcctcatcccgcctgagacggcccttccctggttcaaaaccggcgtcattcctcctgcgggcacgtacgactattgggccgacccttacacgctatttgtgtttgagatggctctaatgggctttgccgaacaccgtcggtttcaggactgggccaacccgggctccatggggaagcagtactttcttgggttggaaaagttcttgggcggatcgggcgatccagcctacccaggcggcccgcttttcaacccgctaggatttgggaaggatgagaagtctttcaaagagttgaagctgaaggaggtgaagaatgggaggctggccatgctggctatattgggctattttatacagggactggtgactggggtggggcccttccagaatcttctggatcatttggctgacccggtcaacaataatgtgttgaccagtcttaagttccactagtgagagtgagagagaggatctgctttgatctgccttggtgtattcttgggggttgattgtgtaatatcatgtgtttaatggtgtttttgtatgatacttagttttctgttaggttatgcatgttaaattgatagctgaaaacatgttagaatctaaaatttgtgtttaaacaaaaatatcattggttt

SEQ ID NO: 1618 - DNA, 1008 bp, Phalaenopsis aphrodite
caatgacttctgctcaagctctgctctcgtcaatggaggccggaaggcagctccttggtggcaggatactgcagtcttcttcttcctctaaaaacattggttctcagagaaggccctcttttgtagtcagagcttcttcttcccctcctgctcggcaaggagcagaccggcagctatggtttgcttccaaacaatctctctcctacttggatggaagccttcccggcgactatgggttcgacccattgggcctttcagatccagagggcactggtgggttcatcgagcccaaatggctggcttatggtgaggtcatcaacggtcgctacgccatgctcggtgctgttggggccatcgccccagagatcctcggcaaactgggcctcatcccgcctgagacggcccttccctggttcaaaaccggcgtcattcctcctgcgggcacgtacgactattgggccgacccttacacgctatttgtgtttgagatggctctaatgggctttgccgaacaccgtcggtttcaggactgggccaacccgggctccatggggaagcagtactttcttgggttggaaaagttcttgggcggatcgggcgatccagcctacccaggcggcccgcttttcaacccgctaggatttgggaaggatgagaagtctttcaaagagttgaagctgaaggaggtgaagaatgggaggctggccatgctggctatattgggctattttatacagggactggtgactggggtggggcccttccagaatcttctggatcatttggctgacccggtcaacaataatgtgttgaccagtcttaagttccactagtgagagtgagagagtggatctgctttgatctgccttggtgtattcttgggggttgattgtgtaatatcatgtgtttaatggtgtttttgtatgatacttagttttctgttaggttatccatgttaaattgatagctgaaaacatgttagaatctaaaatttgtgcttaaacaaaa

SEQ ID NO: 1619 - DNA, 1068 bp, Phalaenopsis aphrodite
caaaaggaaaccagaactcaattttgttccttcaaatccaataaggaagagaaaactatacaatgacttctgctcaagctctgctctcgtcgatggaggccggaaggcagctccttggaggcaggatactgcagtcttcttcttcctctaaaaacattggttctcagagaaggccctcttttgtaatcagagcttcttcttcccctcctgctcggcaaggagcagaccggcagctatggtttgcttccaaacaatctctctcctacttggatggaagccttcccggcgactatgggttcgacccattgggcctttcagatccagagggcactggtgggttcatcgagcccaaatggctggcttatggtgaggtcatcaacggtcgctacgccatgctcggtgctgttggggccatcgccccagagatcctcggcaaactgggcctcatcccgcctgagacggcccttccctggttcaaaaccggcgtcattcctcctgcgggcacgtacgactattgggccgacccttacacgctatttgtgtttgagatggctctaatgggctttgccgaacaccgtcggtttcaggactgggccaacccgggctccatggggaagcagtactttcttgggttggaaaagttcttgggcggatcgggcgatccagcctacccaggcggcccgcttttcaacccgctaggatttgggaaggatgagaagtctttcaaagagttgaagctgaaggaggtgaagaatgggaggctggccatgctggctatattgggctattttatacagggactggtgactggggtggggcccttccagaatcttctggatcatttggctgacccggtcaacaataatgtgttgaccagtcttaagttccactagtgagagtgagagagaggatctgctttgatctgccttggtgtattcttgagggttgattgtgcaatatcatgtgtttaatggtgtttttgtatgatacttagttttctgttaggttatgcatgttaaattgatagctgaaaacatgttagaatctaaaatttgtgtttaaacaaaa

SEQ ID NO: 1620 - DNA, 1060 bp, Manihot esculenta
gatttagatttgctcttgtttcctgctctgtttttttctttattttatagttggcagggcttgtagctgctaagcaaagactcaaaaatggcaacacaagcacttgtatcatcttctcttacatcttcagtggagactgcaagacaaatacttggagcaagaccatcccagtcttcttttgggtcttcaaggaagagctccttcgttgttagggcttcttctactcctcctgttaagcaaggagcagacagacaactatggtttgcttccaagcaaagcctttcttacttggatggcagtcttcctggtgactacggatttgatccgcttggtctttcagaccctgaaggtacaggaggattcattgagccaaaatggttagcttacggtgaagtcatcaatggaagatatgccatgttgggggcagtaggtgccattgcaccagaaattctaggcaaggcaggtctcatccccgccgaaacagcactcccctggttcaaaaccggcgtgatcccaccggctggtacatacgattactgggcggacccatacacactgtttgtgctggaaatggcactcatgggttttgcggagcacaggagatttcaagattgggcaaacccaggctccatgggcaagcagtatttcttgggattggaaaagtacttggggggatctggagacccagcctaccctggaggacccctgttcaaccctcttgggtttggtaaagatgagaaatcaatgaaggaattgaagctcaaggaggtgaagaatgggaggttagctatgttggcaatcttgggttacttcatacaaggactagtgacaggagttggaccataccaaaatctcctggatcacctggctgacccagttaacaacaatgtcttgactagcctcaagttccattagagccaattcttgtctatttggggatagggacagcctatgcagtttccttttccttttgcttttcttgtctctcctactcaatgtaaccatcgtgtgaaaaagccctactgtaattttctgtaacaaaggacatgttaagatcaag

SEQ ID NO: 1621 - DNA, 1009 bp, Musa acuminata
gaactcactcctctctggtttcatttccatcccccccagctacgaccgacagggagaggcaggcaagagcggcagcaaacaccgatggcaacccaggcttttctctcctcggtggaggctggaaggcagctcctcgggggaaggcccctccggtctgctccctcgagatctcttggttcttcgaggaaggcttcgttcgccgtcagagcagcttccacgcctcccgtcaagcaaggagcagacagacagctctggtttgcctccaagcagtccctcacctacttggacggaagcctccccggtgactacggctttgacccccttggcctgtcggaccccgaaggcaccggaggattcatcgagcccaaatggctggcctacggtgaggtcatcaacgggaggtatgccatgctgggggcagtaggcgccatcgcgcccgagatcttcggaaagctcgggtggataccacctgagaccgcactaccctggttcaagactggcgtctttccaccggccggcacttacaactactgggcagacccctacacgctgttcgtgctggagatggcgctcatggggttcgcggagcaccggagattccaggactgggcaaatccaggctccatggggaagcagtacttcttaggtctcgagaagtggttgggggggtcgggaaaccctatataccctggaggacctctcttcaaccctctcggctttgggaaggacgagaagtcgatgaacgatctgaagctgaaggaggtgaagaatgggaggctggccatgctggccatcctgggctactttgcgcaggcggcgttgaccggagttgggccgttccagaacctgttggatcacttggccgaccctgtgcacaacaacatcttgaccagcttcaagttccactgagggtgctgcagctcatcgtgacatgctttgttgccacagatttatctatcccttgtaacatcctatccatatgaaaggcatttgtgactggattaatatc

SEQ ID NO: 1622 - DNA, 1101 bp, Elaeis guineensis
acaaagatcaacaccggaggagacattctataattttgagtgaaaacttctgtagagtaggaaaggaaaggaacagagggaggacatacaaaaagccaatggcaacccagactcttctctcatcaatggaggctggaagacaacttctaggaggaaggccccttcaatccactccctcgcgatcttttgggtctccaagaaaggcctcctttgttgttagagcagcctccacacccccagcaaagcaaggagcagacagacagctatggtttgcatccaagcagtccctcacctacttagatggaagcctccccggcgactacggcttcgacccgctcggcctgtcggaccccgagggcaccggtggattcatcgagcccaaatggctagcctatggcgaggtcatcaatggaaggtacgccatgctcggtgcagttggtgcaattgcacccgagatcttgggccagctcggcctaattccggcggagaccgccctcccgtggttcaagaccggagtcatccccccggcagggacctacaactactgggctgacccctacaccctctttgtgtttgagatggccctcatggggttcgccgagcaccggcggttccaggactgggccaagccaggctccatggggaagcagtactttctggggcttgagaagtacttgggtggatccgggaaccctatataccctggaggtcccttgttcaaccctctggggtttgggaaggatgagaagtccatgaaagacttgaagcttaaggaggtgaagaatgggaggttggccatgctggctatcgtggggtactttgttcaggccctggcgactggggtggggccctaccagaatctgttggaccacttggctgacccggtcaacaacaacatcttgaccagcctcaagttccactaagattacggttttggactattggtctgagactggtgttactctctctgtttgcgtggtgacatttaattttgtgaaggctttgtgaatggtgtatcattagctgcggacatgttggaaaaactgtaacctatgtagttatgatcctgatctctgttaattaataagttgcagaacttgt

SEQ ID NO: 1623 - DNA, 1047 bp, Allium cepa
ggggacacctctaaaactaaaacaaccgcctgaaacaaaaacaaatgacaactcaagctcttctgtcatcaatggaggcaggaaggcaacttcttggaggacggccccttaccagcagtactgtttctaggtcgtttgggacttccagacgaggttcttttgttgttaaagctgcttccactccgcctgttaagcaaggagcaaacaggcagctctggtttgcatctaaacaatcgctctcgtacttagatggaagcttgccaggagattttggattcgatccgttgggcctttcggatccagaaggaaccggagggttcatcgagcccaaatggctggcatacggtgaagtcatcaacggtcgttatgcgatgcttggggcggctggtgccattgcacccgaaatccttggaaagctgggttggatccctccagaaactgccctcccatggttccaaactggggtcatcccacctgcaggcacctacaactactgggccgacccgttcactctattcgtactcgaaatggccctcatgggctttgcagagcacagaagatttcaggattgggccaaacctgggtcgatgggcaaacaatactttttaggctttgagaagtttcttggtgggtcaggcgatccagcttaccctggtgggcccctgttcaacccgttgggcttcggcaaaactgaaaaggcgatgaaagagttgaagctcaaggagattaagaatgggaggttggccatgttggccgttttgggctattttattcaggggttggtgaccggtgtcggcccgtatcagaaccttttggatcatctggctgatccagttaacaataacatcttgactagcctcaagttccattagagagagtgatatggaaaggttgagctttgtaacaaacttgtgatatgtgttatgatgccttgtaatttatgtgctataacattttatatggtttgatgtatctattattgtacacattgcctcatgtctgctatctgaagggtgcattactttgaatgaactaattctttaaatc

SEQ ID NO: 1624 - DNA, 975 bp, Allium cepa
  misc_feature (733)..(733): n is a, c, g, or t
ccagtacacctctaaaactaaaacaaccgcctgaaacaaaaacaaatgacaactcaagctcttctgtcatcaatggaggcaggaaggcaacttcttggaggacggccccttaccagcagtactgtttctaggtcgtttgggacttccagacgaggttcttttgttgttaaagctgcttccactccgcctgttaagcaaggagcaaacagacagctctggtttgcatctaaacaatcgctctcgtacttagatggaagcttgccaggagattttggattcgatccgttgggcctttcggatccagaaggaaccggagggttcatcgagcccaaatggctggcatacggtgaagtcatcaacggtcgttatgcgatgcttggggcggctggtgccattgcacccgaaatccttggaaagctgggttggatccctccagaaactgccctcccatggttccaaactggggtcatcccacctgcaggcacctacaactactgggccgacccgttcactctattcgtactcgaaatggccctcatgggctttgcagagcacagaagatttcaggattgggccaaacctgggtcgatgggcaaacaatactttttaggctttgagaagtttctttggtgggtcaggcgatccagcttaccctggtgggcccctgttcaacccgttgggcttcggcaaaactgaaaaggcgatgaaagagttgaagctcaaggagattaanaatgggaggttggccatgttggccgttttgggctatttattcaggggttggtgaccggtgtcggcccgtatcagaaccttttggatcatctggctgatccagttaacaataacatcttgactagcctcaagttccattagagagagtgatatggaaaggttgagctttgtaacaaacttgtgatatgtgttatgatgccttgtaatttatgtgctataacattttatatggtttgatgtatc

SEQ ID NO: 1625 - DNA, 956 bp, Cucurbita pepo
actccactgcccattttgaagcctgcttctctgcaacaaagctatggccactcaggctcttgtttcatcctcgtctttgacctcttcagtgggcgctgccagacagcgattaggaccaaagccctcccttggttcctccagaaaggcagcttctttcgttgttagagctgaagccactcctcctgttaagcaaggagctaacagacaattatggttcgcttctaaacaaagtcttacgtatttggatggaagtcttccgggcgattacgggttcgatccattgggactatcagaccccgagggcacaggagggttcatcgagccgaaatggttggcatacggcgaggtgatcaacgggaggttcgcgatgttaggagccgctggagccattgccccagagatctttggatcactagggttaatcccaccagaaacagccctcccatggttcaaaactggagtgatcccaccagcagggacctacaactactgggcagacccctacacactgtttgtgcttgagatggctctaatgggttttgctgaacacagaagatttcaagattggtacaacccaggatccatgggaaagcaatactttttagggttagagaagttcttgggtgggtcaggtgaccctgcttacccaggtggccccttgttcaaccctttagggtttgggaaagatgagaaatcaatgaaggaattgaagctgaaggagatcaagaatgggaggcttgcaatgttggctatcttgggttacttcatacaaggccttgtcactggcgttggcccttaccaaaaccttttggatcacttgtctgaccctgtcaacaacaacgttttgacaagcctcaagttccactagaatgggatgtgtgatttgtaatttgtgtattataaacttgtctcccactctctattgtagcatgaattgaggataaacttttctgtga

SEQ ID NO: 1626 - DNA, 954 bp, Taraxacum officinale
cggggagcaccacgaccacttactcttctcaagaaaatggctacacaggctttggtctcatcgtcttccctcacctcctccgtcgagtccgctaggcagatcttagcacaaaggccggttcttcactcttcaagaaaggtcaactttgtcgtcaaagcctcttccagccctcccgttaagcaaggagacagacaactatggtttgcatccaagcaatctctctcttacctcgatggaagtctccccggcgactttggattcgacccacttggtctctcggacccagaaggaaccggaggattcattgaaccgaaatggctagcttacggcgaggttatcaacggacgtttcgcgatgttgggagccgccggagccattgcaccggaggtgttcggaaagcttggactcatcccaccggagaccgccctcccatggttccagaccggtgtgattccccccgccgggacatacaactactgggccgacaattacaccctatttgtgttagagatggcgttgatgggtttcgccgagcaccggagacttcaagattggtacaaccccgggtcaatgggaaagcaatactttttagggttggagaaagggttttccgggtcgggtgacccggcgtacccaggtgggccgttctttaacccactcgggtttgggaaagatgagaagtcgatgaaggaactgaagctaaaggaaatcaagaatggaagattggcgatgttagccatcttgggttacttcattcaggctttggtgactggggttggacctttccagaaccttctggaccatttggctgatccggtcaacaacaatctcttgaccagccttaagttccactagagtctctattttcattcctatatgtaatatcatattgtgcagatctatttcttcggatactattattattttgtacaggattaataatatataacggaa

SEQ ID NO: 1627 - DNA, 1097 bp, Juglans hindsii x Juglans regia
  misc_feature (50)..(50): n is a, c, g, or t
  misc_feature (68)..(68): n is a, c, g, or t
  misc_feature (973)..(973): n is a, c, g, or t
  misc_feature (981)..(981): n is a, c, g, or t
  misc_feature (1017)..(1017): n is a, c, g, or t
  misc_feature (1019)..(1019): n is a, c, g, or t
  misc_feature (1096)..(1096): n is a, c, g, or t
agtccctagataatcaattctctgaggctaccaaccacttcgataagaanactgctgtagagagcganaggttagaggagagaagaagaaaatatggcaacacaagctctggtatcgtcatcgtctcttacctcttcggtggtggctaccaggcagatacttggaccaagatcactccaatcaccaattggttcatcaagaaaagcttccttcattgtaagggcagcgtccactccacctgttaagcaaggagcagatagacccttgtggtttgcatccaagcagagcctttcttacttggacggcagcctcccgggtgactatggattcgaccctctagggctctcggatcccgaaggtacaggagggttcatcgagccaaaatggttggcctacggtgaagtcatcaacggacgttatgccatgttgggtgcagtgggagccatagcacccgagatcttagggaagcttggtctcattcctccggaaacagccctcccttggttcaaaacaggagtaatcccgccagcagggacatacaattactgggcagatccttacacattatttgtcttcgagatggcactcatgggatttgctgagcacaggagatttcaagactgggccaagccaggatccatgggaaaacagtacttcctggggttcgagaagtatttgggagggtctggtgacccagcctaccctggtggacccctatttaaccctctcggctttggaaaggacgagaagtcgctcaaagacttgaagctgaaggaggtaaagaatgggaggttggccatgttggctatcttgggttactttatacaaggtcttgtgaccggcgttgggcctttccaaaatctcctggatcacttggccgatcctgtcaacaacaacgtcttgactagcctcaagttccactaagagagttacatgtaatatttcctgctcgtacgtcttcttgtttggaacnatcttcgngtgcgtgtgtttgtgtctatggcttataacatgatntnggtgtgtaagtcttgtgctccttgtgtaactgtacgaattgacatcatgaggactaaaaatagacttgttaattccnc

SEQ ID NO: 1628 - DNA, 1137 bp, Brachypodium distachyon
cctctctccttttctagcagtgaacggtttcagagcacacactttcatctcaccacacactgcactttcctcatctccccgaaagcaggagctagaggaggagcttgcaggaacaatggcggctcagggtcttctatctgggaggcagctgctggggaggcccctgcagtcctccttctccaggtcgtcttcctccaggaagtcccccttcatcgtcagggcagagtccagcccccctgccaagcaaaatgataacaggcagctgtggttcgcgtccaagcagtccctgagctaccttgatggaacactgccgggtgacttcggcttcgacccgctgggcctgtcggacccggagggcaccggcgggttcatcgagcccaagtggctggcctacggcgaggtcttcaacgggcggacggcgatgatgggcgtggtgggcatgatcgcaccggaggccttgggcaaggtcgggcttgtcccgccggagacggcgatcccgtggttccaggcgggcgccatcccgcctgcgggcacgtaccagtactgggccgacccctacacgctgttcgtgttcgagatggcgctgatcgggttcgcggagcaccggcggctgcaggactggtacaacccaggctccatggggaagcagtacttcctgggcctggagaagttcctcggcggctccggcgaccccgcctaccccggcgggcccatcttcaacccgctcggcttcggcaccaagagcgacaaggagttggcagagctcaagctcaaggagatcaagaacggccgccttgccatgctcgccttcctcggcatgtccatccaggccatcttcaccggcgtcggccccttccagaacctcctcgaccacctctccgaccccgtcaacaacaacatcctcaccagcctcaagttccactaaaggcatcatcaaatcgatcgatcgatccgtgcatcgccatgatggtacccatcgtccatggaatgtagtgcgtgagagaggtttaaaatgctgagggtgggtgtaacatgtaaatttgtacgcgtgctgcgtgcacgcttgtaatatttattatattgtgctcttagtgtgcattgcatctctgatcactcttcaccaatacctgcgtcttt

SEQ ID NO: 1629 - DNA, 1499 bp, Brachypodium distachyon
ctcctgtgagatgtgctgttgtcctgtccacaagcctggacagaaggcaaaaaagaaaatctcagccaagggaatgctgggaggccaggtggcaaccccccttatctcaccaaacctgccacgtggcgtgcttctactgggtccacagatgccctcatccactcagctgccatctcacacctgaattagatttccccggccccactcccgcccagccacaagccttgtacctctctccttttctagcagtgaacggtttcagagcacacactttcatctcaccacacactgcactttcctcatctccccgaaagcaggagctagaggaggagcttgcaggaacaatggcggctcagggtcttctatctgggaggcagctgctggggaggcccctgcagtcctccttctccaggtcgtcttcctccaggaagtcccccttcatcgtcagggcagagtccagcccccctgccaagcaaaatgataacaggcagctgtggttcgcgtccaagcagtccctgagctaccttgatggaacactgccgggtgacttcggcttcgacccgctgggcctgtcggacccggagggcaccggcgggttcatcgagcccaagtggctggcctacggcgaggtcttcaacgggcggacggcgatgatgggcgtggtgggcatgatcgcaccggaggccttgggcaaggtcgggcttgtcccgccggagacggcgatcccgtggttccaggcgggcgccatcccgcctgcgggcacgtaccagtactgggccgacccctacacgctgttcgtgttcgagatggcgctgatcgggttcgcggagcaccggcggctgcaggactggtacaacccaggctccatggggaagcagtacttcctgggcctggagaagttcctcggcggctccggcgaccccgcctaccccggcgggcccatcttcaacccgctcggcttcggcaccaagagcgacaaggagttggcagagctcaagctcaaggagatcaagaacggccgccttgccatgctcgccttcctcggcatgtccatccaggccatcttcaccggcgtcggccccttccagaacctcctcgaccacctctccgaccccgtcaacaacaacatcctcaccagcctcaagttccactaaaggcatcatcaaatcgatcgatcgatccgtgcatcgccatgatggtacccatcgtccatggaatgtagtgcgtgagagaggtttaaaatgctgagggtgggtgtaacatgtaaatttgtacgcgtgctgcgtgcacgcttgtaatatttattatattgtgctcttagtgtgcattgcatctctgatcactcttcaccaatacctgcgtctttgatctttcgagttttgagttgaaagtttcatgtattcatgatctagaatgttcgtggaggtgagggagaggaggctgccatgtggtggtttaaccttaccataatcttcatcagcagccaatctaccgaactg

SEQ ID NO: 1630 - DNA, 1495 bp, Oryza sativa
cccttttccatggccacaagcacagcacccctgcaaccttgtgttcccctcatcccccttttctagcactcaccaagtttaatttggagcacacatttcagctcaccactgctagcttgggaagaggaggaggagcttgagcttggagagagacaacaatggcggctcaggctcttctctctgggaggcagctgctggggaggccattgcaatcttcagtctccaggtcttcttcctccaggaaggcacccttcatggtcagggcagaggccactccccctgccaagcaaggtgctgacaggcagctgtggttcgcatccaagcagtccctgagctacctggatggcacgcttccgggagacttcgggttcgacccgctggggctatcggacccggaggggaccggtgggttcatcgagccacggtggctggcctacggcgaggtgttcaacggccggacggcgatgatgggcgtcgtcggcatggtcgccccggagctcctcggcaagctgggcctcgtccccgccgagacggcgatcccgtggttccagaccggcgtgatcccccccgcgggcacctacacctactgggccgacccttacactctcttcgtcttcgagctcgccctcgtcggcttcgccgagcaccgccgcttccaggactggtacacgccgggctccatggggaagcagtacttcctcggcctcgagaagtacctcgccggctccggcgagccggcctaccccggcggcccgctcttcaacccgctcggcttcgggaccaagagcgaggcggagatgaaggagctcaagctcaaggagatcaagaatggcaggctcgccatgctcgccttcctcggcttctccgtccaggcgctcttcaccggggttggccccgtgcagaacctgcttgatcacctcgctgatcccgtccacaacaacatcctcaccagcctcaagttccattagagatgccatcaactacgtatttaattaattacgagtttttaattatgtatgtatgtacgtgcgtatgcgtatatgtgtgtacgtatgtatgtacgcaactttgtacgatcgatggtgcgtgtgatcgagaggggtatgtatgtacgtacgtatatacgatgtattattatgcatgggtgtagggtgtgggtgtaacatgtaaatttgtgctccaactgatttgcacgcatggtcgcatggatcgatttgctagcttgtctctcttttgttgggcatataactatttactacttttgttgattaaaagtttgtcactcaaagttccagtgataaatttttaattaacacttataaacgtggtaaatagttaaatatctcccttttattaggcggtagaactaggagtgtcccgtgtattttattttctccgtttttaaattattgtcatccacatgctacgctatgtaagatgtttcttagaagtatgtttatccctgacagtaaagaggaaaaaaatttttccggaa

SEQ ID NO: 1631 - DNA, 1327 bp, Oryza sativa
acaagcacagcacccctgcaaccttgtgttcccctcatcccccttttctagcactcaccaagtttaatttggagcacacatttcagctcaccactgctagcttgggaagaggaggaggagcttgagcttggagagagacaacaatggcggctcaggctcttctctctgggaggcagctgctggggaggccattgcaatcttcagtctccaggtcttcttcctccaggaaggcacccttcatggtcagggcagaggccactccccctgccaagcaaggtgctgacaggcagctgtggttcgcatccaagcagtccctgagctacctggatggcacgcttccgggagacttcgggttcgacccgctggggctatcggacccggaggggaccggtgggttcatcgagccacggtggctggcctacggcgaggtgttcaacggccggacggcgatgatgggcgtcgtcggcatggtcgccccggagctcctcggcaagctgggcctcgtccccgccgagacggcgatcccgtggttccagaccggcgtgatcccccccgcgggcacctacacctactgggccgacccttacactctcttcgtcttcgagctcgccctcgtcggcttcgccgagcaccgccgcttccaggactggtacacgccgggctccatggggaagcagtacttcctcggcctcgagaagtacctcgccggctccggcgagccggcctaccccggcggcccgctcttcaacccgctcggcttcgggaccaagagcgaggcggagatgaaggagctcaagctcaaggagatcaagaatggcaggctcgccatgctcgccttcctcggcttctccgtccaggcgctcttcaccggggttggccccgtgcagaacctgcttgatcacctcgctgatcccgtccacaacaacatcctcaccagcctcaagttccattagagatgccatcaactacgtatttaattaattacgagtttttaattatgtatgtatgtacgtgcgtatgcgtatatgtgtgtacgtatgtatgtacgcaactttgtacgatcgatggtgcgtgtgatcgagaggggtatgtatgtacgtacgtatatacgatgtattattatgcatgggtgtagggtgtgggtgtaacatgtaaatttgtgctccaactgatttgcacgcatggtcgcatggatcgatttgctagcttgtctctcttttgttgggcatataactatttactacttttgttgattaaaagtttgtcactcaaagttccagtgataaatttttaattaacacttataaacgtggtaaatagttaaata

SEQ ID NO: 1632 - DNA, 904 bp, Arnica chamissonis
tcatcactcatctcctcagtggagtctgctaggcaaatgcttggagctaggccacttcacacaccttcaagaaagatctcttttcttgtcaaagctagttcctcccctcctgttaagcaaggagcaaacagacaactgtggtttgcatccaaacaatctctttcttacctggatggaagtctaccaggtgactttggatttgacccacttggtctttcagacccagaagggactggtggattcattgaacccaagtggctagcttatggagaggttatcaatggccggttcgccatgttgggtgcagctggagccattgcacccgagattttcggcaagcttgggctcatcccagcggaaaccgccctgccgtggttcaagacaggtgtcattcccccggccggcacatacaactactgggctgaccctttcaccctatttgtattagaaatggcacttatgggttttgcagaacacagaaggctacaagattggtataacccagggtcaatggggaaacaatacttttgggtttggagaaaggatttccgggtcgggcgatccagcatacccgggcgggccgttcttcaacccattagggtttggaaaagatgagaagtcaatgaaagatttgaagctaaaagagataaaaaatggtagattggctatgttggccattttgggttacttcattcagggtttggtcacgggtgttggacctttccagaaccttctggaccatttggctgatccagtcaacaacaatgtcttgaccagccttaagttccactagagttttatcttatgtgcagaatttgtggaaatattattgttaatttgttacgaaattaatgatatgttaatgaatccaaaaaaccttatctcgttgtaatacatgtagtta

SEQ ID NO: 1633 - DNA, 906 bp, Flaveria ramosissima
ctaagaaaataggcaacacaagcattggcttccacctcctcagttgagtctgcaaggcagatccttggagctagaccatttcagacaccttcaagaaagatctcttttcttgtcaaagctgcttccacccctcctgttaagcaaggagcagacagacagctgtggtttgcatccaaacagtctctttcttacctggatggaagtctcccaggtgactttggatttgacccacttggtctttcagacccagaaggcaccggtgggttcatcgagcccaagtggctagcttacggagaggtcatcaacggacggttcgccatgttgggtgcagccggagccattgcacccgagattcttggcaagcttgggctcatcccagccgaaaccgccctcccttggttcaagaccggtgtcatccccccggccggcacatacgactactgggccgacccgttcaccctatttgttctagaaatggcacttatgggctttgcagaacacagaagactacaagattggtacaacccgggttcaatgggaaaacaatactttttgggcctagagaaaggctttgccgggtcgggcgaccccgcatacccaggcggcccgttcttcaacccgctagggttcggaaaagatgagaagtcaatgaaggaattgaagctaaaagagatcaagaatggtagattggctatgttggccattttgggctacttcattcagggtttggtgactggtgttgggccttaccagaaccttttggaccatttggctgatccagtcaacaacaatgtgttgaccagccttaagtttcactagagtcacaatcttccttcctatatgtaatatcatgtgcagaatttcttgaaatattattattaatttgtaacgggtttaatgatatgt

SEQ ID NO: 1634 - DNA, 1120 bp, Amsonia hubrichtii
aacttcagtggcctggcttggcccttatttgcaccagagtgttttattctttccaagccctggtgctattcttgctcagagtagccagtttggaaaacaatatcacacaaacaaccactaaaatggcaactcaagcactgatctcctcatcatctatcactgcttctgcagaagccaccagacagattctaggagccaggtctgttcaatcatccacaaggaaagtctcctttgttgtccgagctgcatctacaccccctgctaagcaaggagcagacagacaactgtggtttgcatccaaacagagcctttcttacttggatggcagtctccctggtgactacggatttgatccactggggctctcagatcctgaaggtactggaggcttcattgaacccaaatggctagcctatggagaagtcatcaatggacgatatgcaatgttgggagcagtaggggccatcgcacctgagattcttggtaaagctgggctcattccagctgaaacggccctcccatggttcaaaacaggagtaattcctcctgctggtacatacgactactgggctgacccttacaccctatttgtctttgagatggcactcatgggatttgctgagcacaggagattccaggactgggctaagccaggatctatgggcaagcagtacttcctgggatttgagaaatacttgggaggctctggtgatccagcataccctgggggacccatcttcaaccctcttgggttcggaaaagatgagaaatcaatgaaggacttgaagttgaaggagattaagaatggaaggttggctatgttggcaatattgggttactttgtacaaggattggtgactggagttggaccataccaaaaccttctggatcatttgtctgatccggtgaacaacaacgtattgaccagcctcaaattccactagaatggcagcagctctcttctctccctacgttttccccctatcaaatttgtaacacatgtgcagatattttcagcatgtcatctgtaatcttatcaaaagacatgttcaggcctttgaaaaccatgaacaattcggagctcagtgaaaagtttgtagttaatgcctgtgctagacga

SEQ ID NO: 1635 - DNA, 1030 bp, Allium cepa
cgcttggaacaaaagaaatgaccactcaagctcccctgtaatcaatggaggcaggaaggcagcttttaggaggacgaccccttaccggtggtactgtttctaggtcgtttggtacttcccgacgagcttcctttgtagttaaagctgcttccactcctcctgtcaagcaaggagcaaacaggcagctttggtttgcatctaaacaatcgctctcatatttagacggaagcttgccaggtgattttggattcgacccattgggactttcggacccagaagggaccggagggttcatcgagccaaaatggctagcatacggtgaagtcatcaacggtcggttcgcgatgcttggggctgctggtgccattgcacccgaaatctttggaaagctgggtctgatccctgcagaaacagcccttccatggttccaaactggggtcatcccacctgcaggcacctacagctactgggccgaccctttcactctattcgtgctcgaaatggcgctcatgggctttgcagagcacagaagatttcaggattgggccaagcccgggtctatgggcaagcagtactttttaggctttgagaagtttctcggcgggtcgggcgatccagcataccccggcgggccaatcttcaacccgttgggctttggtaaaactgaaaaggctatgaaggagttgaagctcaaggagattaagaatgggaggctggctatgttggccattttgggctatttcattcaaggattggtgactggtgtaggaccatatcagaaccttctggatcatctggctgacccagttaacaataacgtcttgactagcctcaagttccactagagtctagagagagtgagtgatataggaggctggggatctgtaacaagcttgtgatgtgtgttatgatgccttgtaatttatgtgctataacattttatatggtttgatgtatgtattattgaacacattgcctcatgtctactatgctacctgaacggtgcatccttttggatgaactaattctt

SEQ ID NO: 1636 - DNA, 1318 bp, Hordeum vulgare
cagatgccctcatccgctgaggctccacctcacatcggaataagatttccctggccccacccccgcccagcctcaggccgtcaggcgcacgttcctctctccttttgtagcagtgggtgagttttggagcacacactttcatctcagtctctaccacacacaccgcgtctgcctcatctctcggagcagcaggaggaggagcttgcaggaacaatggcggcccagggtcttctctctgggaggcagctgctgggtaggcctctgcagtcttccttctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcctggtgactttggcttcgaccccttggggctgtccgacccggagggcaccggcgggttcatcgagcccaggtggctggcctacggcgagatcttcaacggccggacggcgatgatgggggtggtgggcatgatcgccccggaggccctgggcaaggtgggtctggtgcccccggagacggcgatcccgtggttccaggcgggcgccatcccgccggcaggcacctaccagtactgggccgacccctacacgctcttcgtgttcgagatggcactgatcggcttcgcagagcaccggcggctccaggactggtacaacccgggttccatggggaagcagtacttcctgggtctcgagaagtacctcggcggctccggcgaccccgcctaccccggcgggcccatcttcaacccactcgggttcggcaccaagagcgagaaggagatgaaggagctcaagctcaaggagatcaagaacggccgtctcgccatgctcgccttcctcggcatgtcgctgcaggccatcttcaccggcgtcgggcccttccagaacctcctcgaccacctctccgaccccgtcaacaacaacatcctcaccagcctcaagttccactaggcgaaatccgagcatcgtcgtcctgtgcatggtacccgtctgtcgtcgtgggaaacgtgagcgcgcgagcggtatatatgcgagggtgggtgtaaaatgtaaatttgtacgcgtgctgcgtgcatgcttgtaatatttatatcgtgctatgaaaattagtgcattgcatctctcaccatcttcacttgttcagcagcatctgctagctttttctaccccctcccccctcctcatctgatcacccatgcaaattaccgttgccctattagacattcaaacaaatataaataaagaa

SEQ ID NO: 1637 - DNA, 825 bp, Papaver somniferum
ggaagctgctagacaagtattcagaggaagaccacttcaatatgcaactgttaacgttggctcttcaaggaagggttcatttgttgttagagctgctgccactccacctgttaagcaaggagcaaacagacagctttggtttgcatccaaacagagtctttcttacttagacggcagtctcccaggtgatttcgggtttgacccacttggactttcagatccagaaggaacaggaggatttattgaaccaaaatggctagcatatggtgaaattatcaacggacgttttgctatgttaggagcagcaggagcaatcgcaccggaagtcttcggcaaactcggacttatcccacctgaaaccgcactcccatggttccaaactggagtgattccacctgccggaacttacagttactgggcagaccccttcacactatttgtgctagaaatggctcttatgggttttgccgagcacaggagattgcaagactggtacaaccctggatccatgggcaaacaatatttcttaggtttggaaaagggtttgggtggatcaggtaaccctgcttacccgggtggacctttcttcaacccattaggatttggaaaagatgagaagtcaatgaatgaactgaaattgaaggaagtgaagaacggaagattagctatgttggccattttaggttatttcattcaaggtttagtcacaggagttgggcctttccagaacttgttggaccatttggctgatccagtcaacaacaatgtcttgactagtctcaagttccactaaattgtctgcccaggttcttgtactatgaggct

SEQ ID NO: 1638 - DNA, 1090 bp, Secale cereale
cacaccacgcctacctcatctctcggagcagcaggaggaggagcttgcaggaacaatggcggcccagggtcttctctctgggaggcagctgctggggaggcctctgcagtcttccatctccaggtcgtcttcctcccggaagtccgccttcgtcgtcagggcatcgtccagcccccctgccaagcaaaatgacaacaggcagctgtggttcgcctccaagcagtccctcacctacctcgacggcacgctgcctggtgactttggcttcgaccccttggggctgtccgacccggagggcactggcgggttcatcgagcccaggtggctggcctacggcgagatcttcaacggccggacggcgatgatgggggtggtgggcatgatcgccccggaggccctgggcaaggtgggtttggtgcccccggagacggcgatcccatggttccaggcaggcgcgatcccgccggcaggcacctaccagtactgggccgacccctacacgctcttcgtgttcgagatggcgctgattggcttcgcggagcaccggcgactccaggactggtacaacccgggctccatggggaagcagtacttcctgggccttgagaagtacctcggcggctccggtgaccccgcctaccccggcgggcccatcttcaacccgctcgggttcggcaccaagagtgagaaggagatgaaggagctcaagctcaaggagatcaagaacggccgcctcgccatgctcgccttcctcggcatgtcgctgcaggccatcttcaccggcgtcgggcccttccagaacctcctcgaccacctcgccgaccccgtcaacaacaacatcctcaccagcctcaagttccactaggcgaaatccgagcatcgtcgtcctgtgcatggtacccgtccgtcgtcgtgggaaacgtgagcgcgcgagcggtatatatgcgagggttgggtgtaaaatgtaaatttgtacgcgtgctgcgtgcatgcttgtaatatttatatcgtgctatgaaaattagtgcattgcgtaaaaaaaaaaaaaaaaaaaaaaaaaaaaaaaaaaaaaaaaaaaaaaaaaaaaaaa

SEQ ID NO: 1639 - DNA, 1076 bp, Triticum aestivum
acacactttcatctcagtctgtaccacacaccacgcctgcctcatctctcggagcaggaggaggaggagcttgcaggaacaatggcggcccagggtcttctctctgggaggcagctgctggggaggcctctgcagtcttccatctccaggtcgtcttcctcccggaagtcccccttcgtcgtcagggcatcttccagcccccctgccaagcaaaatgacaacaggcagctgtggtttgcgtccaagcagtccctcacctacctcgacggcacgctgcccggtgactttggcttcgaccccttggggctgtccgacccagagggcaccggcgggttcatcgagcccaggtggctggcctacggcgagatcttcaacggccggacggcgatgatgggggtggtgggcatgatcgccccggaggccctgggcaaggtgggtctggtgcccccggagacggcgatcccgtggttccaggcaggcgcgatcccgccggcaggcacctaccagtactgggccgacccctacacgctcttcgtgttcgagatggcgctcatcggcttcgcggagcaccggcggctccaggactggtacaacccgggctccatgggcaagcagtacttcctgggcctcgagaagtacctcggtggctccggcgaccccgcctaccccggcgggcccatcttcaacccgctcgggttcggcaccaagagcgagaaggagatgaaggagctcaagctcaaggagatcaagaacggccgcctcgccatgctcgccttcctcggcatgtccctgcaggccatcttcaccggcgtcgggcccttccagaacctcctcgaccacctctccgaccccgtcaacaacaacatcctcaccagcctcaagttccactaggcgaaatcgatccgatccgatccgagcatcgtcgtcctgtgcatggtacccgtcgtcgtgggaaacgtgagcgtgcgagaggtatacatgcgagggtgggtgtaaaatgtaaatttgtacgcgtgctgcgtgcatgcttgtaatatttatatcgtgctatgaaaattagtgcattgcatctctca

SEQ ID NO: 1640 - DNA, 1344 bp, Triticum aestivum
cagcccccttatcccagcgcacccgccacatgtcgggcttctactgggtccacagatgccctcatccgctgaggctccacctcacatcggaataagatttccctgaccccacccccgcccagcctcaggcgcacgttcctctctccttttgtagcagtgggtgagttttggagcacacactttcatctcagtctgtaccacacaccacgcctgcctcatctctcggagcaggaggaggaggagcttgcaggaacaatggcggcccagggtcttctctctgggaggcagctgctggggaggcctctgcagtcttccatctccaggtcgtcttcctcccggaagtcccccttcgtcgtcagggcatcttccagcccccctgccaagcaaaatgacaacaggcagctgtggtttgcgtccaagcagtccctcacctacctcgacggcacgctgcccggtgactttggcttcgaccccttggggctgtccgacccagagggcaccggcgggttcatcgagcccaggtggctggcctacggcgagatcttcaacggccggacggcgatgatgggggtggtgggcatgatcgccccggaggccctgggcaaggtgggtctggtgcccccggagacggcgatcccgtggttccaggcaggcgcgatcccgccggcaggcacctaccagtactgggccgacccctacacgctcttcgtgttcgagatggcgctcatcggcttcgcggagcaccggcggctccaggactggtacaacccgggctccatggggaagcagtacttcctgggcctcgagaagtacctcggtggctccggcgaccccgcctaccccggcgggcccatcttcaacccgctcgggttcggcaccaagagcgagaaggagatgaaggagctcaagctcaaggagatcaagaacggccgcctcgccatgctcgccttcctcggcatgtctctgcaggccatcttcaccggcgtcggacccttccagaacctcctcgaccacctctccgaccccgtcaacaacaacatcctcaccagcctcaagttccactaggcgaaatccatccgatccgatccgagcatcgtcgtcctgtgcatggtacccgtcgtcgtgggaaacgtgagcgtgcgagaggtatatatgcgagggtgggtgtaaaatgtaaatttgtacgcgtgctgcgtgcatgcttgtaatatttatatcgtgctatgaaaattagtgcattgcatctctcatcatcttcaccaacgtctgtgtctttctttccccgctcctcttctggttattgtacgtgcattttttgcatagtaatacgtgtctcatttatat

SEQ ID NO: 1641 - DNA, 1266 bp, Triticum aestivum
gttcctctctccttttgtagcagtgggtgagttttggagcaaacactttcatctcagtctgtaccacacaccacgcctgcctcatctctcggagcaggaggaggagcttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggcctacggcgagatcttcaacggccggacggcgatgatgggggtggtgggcatgatcgccccggaggccctgggcaaggtgggcctggtgcccccggagacggcgatcccgtggttccaggcaggcgcgatcccgccggcaggcacctaccagtactgggccgacccatacacgctcttcgtgttcgagatggcgctcatcggcttcgcggagcaccggcggctccaggactggtacaacccgggctccatgggcaagcagtacttcctgggcctcgagaagtacctcggtggctccggcgaccccgcctaccccggcgggcccatcttcaacccgctcgggttcggcaccaagagcgagaaggagatgaaggagctcaagctcaaggagatcaagaacggccgcctcgccatgctcgccttcctcggcatgtccctgcaggccatcttcaccggcgtcgggcccttccagaacctcctcgaccacctctccgaccccgtcaacaacaacatcctcaccagcctcaagttccactaggcgaaatcgatccgatccgatccgagcatcgtcgtcctgtgcatggtacccgtcgtcgtgggaaacgtgagcgtgcgagaggtatacatgcgagggtgggtgtaaaatgtaaatttgtacgcgtgctgcgtgcatgcttgtaatatttatatcgtgctatgaaaattagtgcattgcatctctcatcatcttcaccaacgtctgtgtctttctttccccgctcctcttctggttattgtacgtgcattttttgcatggtaatacgtgtctcatttatatcataaaggtcatagtacaaaccacgtacaaaccgatctgaaaaaactgaaaagacaaca

SEQ ID NO: 1642 - DNA, 1124 bp, Hordeum vulgare
cgttcctctctccttttgtagcagtgggtgagttttggagcacacactttcatctcagtctctaccacacacaccgcgtctgcctcatctctcggagcagcaggaggaggagcttgcaggaacaatggcggcccagggtcttctctctgggaggcagctgctgggtaggcctctgcagtcttccttctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcctggtgactttggcttcgaccccttggggctgtccgacccggagggcaccggcgggttcatcgagcccaggtggctggcctacggcgagatcttcaacggccggacggcgatgatgggggtggtgggcatgatcgccccggaggccctgggcaaggtgggtctggtgcccccggagacggcgatcccgtggttccaggcgggcgccatcccgccggcaggcacctaccagtactgggccgacccctacacgctcttcgtgttcgagatggcactgatcggcttcgcagagcaccggcggctccaggactggtacaacccgggttccatggggaagcagtacttcctgggtctcgagaagtacctcggcggctccggcgaccccgcctaccccggcgggcccatcttcaacccactcgggttcggcaccaagagcgagaaggagatgaaggagctcaagctcaaggagatcaagaacggccgtctcgccatgctcgccttcctcggcatgtcgctgcaggccatcttcaccggcgtcgggcccttccagaacctcctcgaccacctctccgaccccgtcaacaacaacatcctcaccagcctcaagttccactaggcgaaatccgagcatcgtcgtcctgtgcatggtacccgtctgtcgtcgtgggaaacgtgagcgcgcgagcggtatatatgcgagggtgggtgtaaaatgtaaatttgtacgcgtgctgcgtgcatgcttgtaatatttatatcgtgctatgaaaattagtgcattgcatctctcaccaaaaaaaaaaaaa

SEQ ID NO: 1643 - DNA, 1064 bp, Pseudoroegneria spicata
accacacacaccgcgcctgcctcatctctcggagcaggaggaggaggaacttgcaggaacaatggcggcccagggtcttctctctgggaggcagctgctggggaggcctctgcagtcttccttctccaggtcgtcttcctcccggaagtccccgttcgtcgtcagggcatcgtccagcccccctgccaagcaaaatgacaacaggcagctgtggtttgcgtccaagcagtccctcacctaccttgacggcacgctgcccggtgactttggcttcgaccccttggggctgtccgacccggagggcaccggcggcttcatcgagcccaggtggctggcctacggcgagatcttcaacggccggacggcaatgatgggggtggtgggcatgatcgccccggaggccctgggcaaggtgggcctggtgcccccggagacggcgatcccgtggttccaggcgggcgcgatcccgccggcgggcacctaccagtactgggccgacccctacacgctcttcgtgttcgagatggcgctcatcggcttcgcggagcaccggcggctccaggactggtacaacccgggctccatggggaagcagtacttcctgggcctcgaaaagtacctcggcggctccggcgaccccgcctaccccggcgggcccatcttcaacccgctcgggttcggcaccaagagcgagaaggagatgaaggagctcaagctcaaggagatcaagaacggccgcctcgccatgcttgccttcctcggcatgtccctgcaggccatcttcaccggcgtcgggcccttccagaacctcctcgaccacctctccgacccggtcaacaacaacatcctcaccagcctcaagttccactaggcgaaatcgatccgatccgagcatcttcgtcctgtgcatggtacccgtccgtcgtcgtgggaaacgtgagcgtgcgagcggtatatatgcgagggtgggtgtaaaatgtaaatttgtacgcgtgctgcgtgcatgcttgtaatatttatatcgtgctatgaaaattagtgcattgcatctctcaaaaaaaaaa

SEQ ID NO: 1644 - DNA, 1015 bp, Tragopogon dubius
acgacacgaccctctaatcttctgaagaatatggctgctcaggcattggtctcatcgtcgtcgctctcctcctccgtggagtctgctaggcaaatcctagcagcacggccacttatcacaccaccttcaagaaaggtctcctttatcgtcaaagctgcttccacccctcctgttaagcaaggagctaacagacaactgtggtttgcttccaagcaatctctatcttacctggatggaagtctcccaggcgactttgggttcgacccacttggtctctcagacccagaaggaaccggaggattcattgaacccaagtggctagcttacggagaggttatcaatgggcggttcgccatgttgggtgcagccggagctattgcaccggagattttcgggaagcttgggctcatcccaccggagaccgccctcccttggttccagaccggtgtcattcccccagccggcacatacaactactgggccgacccttacaccctttttgtattggagatggcactcatggggttcgcagagcacagaagactccaagattggtataacccggggtcaatggggaagcaatatttcttggggatggagaaagggtttgccgggtctggcgacccggcgtacccaggcgggccgttctttaacccactcgggttcgggaaagacgagaagtcgatgaaggaactgaagctaaaagaaatcaagaatggtagattggctatgttagccatcttgggttacttcatccagggcttggtgacaggggttggaccattccagaacctcctcgaccatttggctgatcctgtcaacaacaatctcttgaccagccttaagttccactagactctccactttccttcctatatgtaatattatgtgcagaatttcttcggaatgctattattaatttgtaacaaagttaataatatatcaacgaaactgaaaccttgttgctatcgaaaccctactaattaaatacatatgcatgcacgtgccctataag

SEQ ID NO: 1645 - DNA, 1221 bp, Triticum aestivum
ggttcctctctccttttgtagcagtgggtgagttttggagcaaacactttcatctcagtctgtaccacacaccacgcctgcctcatctctcggagcagcaggaggaggagcttgcaggaacaatggcggcccagggtcttctctctgggaggcagctgctggggaggcctctgcagtcttccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggcttcgaccccttggggctgtccgacccggagggcaccggcgggttcatcgagcccaggtggctggcctacggcgagatcttcaacggccggacggcgatgatgggggtggtgggcatgatcgccccggaggccctgggcaaggtgggcctggtgcccccggagacggcgatcccgtggttccaggcaggcgcgatcccgccggcgggcacctaccagtactgggccgacccctacacgctcttcgtgttcgagatggcgctcatcggcttcgcggagcaccggcggctccaggactggtacaacccgggctccatggggaagcagtacttcctgggcctcgagaagtacctcggtggctccggcgaccccgcctaccccggcgggcccatcttcaacccgctcgggttcggcaccaagagcgagaaggagatgaaggagctcaagctcaaggagatcaagaacggccgcctcgccatgctcgccttcctcggcatgtccctgcaggccatcttcaccggcgtcgggcccttccagaacctcctcgaccacctctccgaccccgtcaacaacaacatcctcaccagcctcaagttccactaggcgaaatcgatccgatccgatccgagcatcgtcgtcctgtgcatggtacccgtcgtcgtgggaaacgtgagcgtgcgagaggtatatatgcgagggtgggtgtaaaatgtaaatttgtacgcgtgctgcgtgcatgcttgtaatatttatatcgtgctatgaaaattagtgcattgcatctctcgtcatcttcatcaacatctgtgtctttctttccccgctcctcttctggttatcgtacgtgcaattaggcggctaggttttgacgatagtggccgtatcttcttaa

SEQ ID NO: 1646 - DNA, 1251 bp, Triticum aestivum
ggcgcacgttcctctctccttttgtagcagtgggtgagtttttggagcaaacactttcatctcagtctgtaccacacaccacgcctgcctcatctctcggagcaggaggaggagcttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggcctacggcgagatcttcaacggccggacggcgatgatgggggtggtgggcatgatcgccccggaggccctgggcaaggtgggcctggtgcccccggagacggcgatcccgtggttccaggcaggcgcgatcccgccggcgggcacctaccagtactgggccgacccatacacgctcttcgtgttcgagatggcgctcatcggcttcgcggagcaccggcggctccaggactggtacaacccgggctccatggggaagcagtacttcctgggccttgagaagtacctcggcggctccggcgaccccgcctaccccggcgggcccatcttcaacccgctcgggttcgggaccaagagcgagaaggagatgaaggagctcaagctcaaggagatcaagaacggccgcctcgccatgctcgccttcctcggcatgtccctgcaggccatcttcaccggcgtcgggcccttccagaacctcctcgaccacctctcagaccccgtcaacaacaacatcctcaccagcctcaagttccactaggcgaaatcgatccgatccgatccgagcatcgtcgtcctgtgcatggtacccgtcgtcgtgggaaacgtgagcgtgcgagaggtatatatgcgagggtgggtgtaaaatgtaaatttgtacgcgtgctgcgtgcatgcttgtaatatttatatcgtgctacgaaaattagtgcattgcatctctcgtcatcttcatcaacatctgtgtctttctttccccgctcctcttctggttatcgtacgtgcaattaggcggctaggttttgacgatagtggccgtatcttctttataattctcatgaataaaatggttatt

SEQ ID NO: 1647 - DNA, 995 bp, Cichorium intybus
ccctcccttctcgtaatgcagccacacacgaccatctaatcttctcaaggaaatggctacacaagctttggtctcatcgtcatcgctcacctcctccgtggagtcagctaggcaaatcctagcagccaggccacttcactcaacatcttcaagaaaggtctcctttgttgtcaaagctgcttccacccctcctgttaagcaaggagctaacagacaactgtggtttgcatccaagcaatctctctcttacctcgatggaagtctcccaggcgactttggattcgacccacttggtctctcagacccagaaggaaccggaggattcattgagcccaagtggctagcctacggcgaggttatcaatggacgattcgccatgttgggtgcagctggagccattgcaccagagatcttcggaaagcttgggctcatcccaccggagaccgccctcccttggttccagaccggcgttattcccccagccgggcaatacaactactgggctgacccttacaccctattcgtattggaaatggcactgatgggtttcgcagaacacagaagactccaagactggtacaacccaggttcaatggggaagcaatacttcttggggttggagaaagggtttgcaggttccggtgacccggcatacccaggcgggccgttctttaacccacttgggtttgggaaagacgagaagtcgatgaaggaactgaagctaaaagaaatcaagaatggaagattggctatgttagccatcttgggttacttcattcagggtttggtgaccggggttgggcctttccagaaccttctggaccatttggctgatcctgtcaacaacaatctcttgaccagccttaagttccactagacgactcttccattttcctttctatatgttatatcatgtgcagatctatttcttcggaatactattattaatttgtaacgaaattaataatatataacggaaaccttgttgctactag

SEQ ID NO: 1648 - DNA, 1137 bp, Cirsium arvense
ttaatactttgatctcatggcaactcaagcattggtttcatcttcatcactcacctcctcagtggagtctgctagacaaatctttggagcaagaccactcctttcttcttcaagaaagctctcctttcttgtcaaagctgcttccactcctcctgttaagcaaggagcaaacaggcagctatggtttgcatccaagcaatctctctcttaccttgatggaagtctcccaggtgacttcggattcgacccactcggtctctcagacccagaaggcaccggaggcttcatcgaacccaggtggctagcttacggagaagtcatcaacggacgattcgccatgttaggcgcagccggagccatcgcgcccgagattttcggcaaactcgggctcatcccacccgagaccgccctcccatggttccagaccggtgtcatcccaccagccggaacctacaactactgggccgacccttacaccctattcgttatggaaatggccttcatgggcttcgcggagcacagaaggttccaagattggtacaacccgggctcaatggggaaacaatacttcttgggcctagaaaagggcttttccgggtcgggtgaccccgcatacccaggtgggccgttctttaacccgttgggattcgggaaagatgagaagtcaatgaaggagttgaagttgaaggagatcaagaatggaagattggctatgttggccattttgggttacttcattcaaggattggtgactggggttggacctttccagaaccttctggaccatttggctgacccggtcaacaacaatgttttgaccagccttaagttccactagatgatcacacggtcgagttttatttacttgctgttactatatgtgcagaatttggtccaaatattttattatgattattaatttgtaacaaaagtaatggtatgttaaggaaactgaaaccttgttggtggtactctctatccatatgatgttgtgtagattcatagattctgtattttcaattgcaattaccaaaagttgcatgaaatcagatttcaaaaatagatttaattaaataaatatttataggtaaaaaagaaccaagtaactgtatattatatcatcgtcgtgaaaagaca

SEQ ID NO: 1649 - DNA, 1004 bp, Lactuca sativa
ttcccctccccttatgtttcccctctcccttctcctaatgcagccacacacgatcatctaatcttctcaaggaaaatggctacacaggctttggtctcatcgtcttcgctcacctcctccgtggagtctgctaggcaaatcctagcagccaggccacttcacacaacatcttcaagaaaggtctcctttgttgtcaaagctgcttccacccctcctgttaagcaaggagctaacagacagttgtggtttgcatccaagcaatctctctcttaccttgatggaagtctcccaggcgactttgggttcgacccacttggtctctcagacccagaaggaaccggaggattcatcgaacccaagtggctagcatacggcgaggttatcaatggacgtttcgccatgttgggtgcagctggcgccattgcaccagagatcttcggcaagcttgggctcatcccaccggaaaccgccctcccttggttcaagaccggtgtcattcccccagccggaacatacaactactgggcagaccctttcaccctatttgtattggaaatggcgttgatgggtttcgcagagcatagaagactccaagactggtataacccagggtcaatggggaagcaatacttcttggggttggagaaaggtttttcagggtcgggtgacccggcatacccaggtgggccgttctttaacccactcgggttcgggaaagatgagaagtcaatgaaggaactgaagctaaaagaaatcaagaatggaagattggctatgttagcaatcttgggttacttcattcagggtttggtgaccggggttggacctttcgagaacctgctggaccatttggctgatcctgtcaacaacaatgtcttgactagcctcaagttccactagactctccattttctttcctatatcatatgtaatatcatgtgcagatcgatctatttcttcggaatactattattaatttgtaacaaaattaatgatatataacg

SEQ ID NO: 1650 - DNA, 1399 bp, Lactuca sativa
ttcccatatgaccacttgaccagacaattgaaggccacgaaagtagtaagtaaatgtgtacaaacaagaagttagataaaaatctcttatccaagtaagacatgccacatgtgctaacctcattggaacaaaagatcccaaacctcatctccgaattcaggttgcctcaacacaaaccacaaactcacctaccccacacccttcaccctccccttatgtttcccctctcccttctcctaatgcagccacacacgatcatctaatcttctcaaggaaaatggctacacaggctttggtctcatcgtcttcgctcacctcctccgtggagtctgctaggcaaatcctagcagccaggccacttcacacaacatcttcaagaaaggtctcctttgttgtcaaagctgcttccacccctcctgttaagcaaggagctaacagacagttgtggtttgcatccaagcaatctctctcttaccttgatggaagtctcccaggcgactttgggttcgacccacttggtctctcggacccagaaggaaccggaggattcatcgaacccaagtggctagcatacggcgaggttatcaatggacgtttcgccatgttgggtgcagctggcgccattgcaccagagatcttcggcaagcttgggctcatcccaccggaaaccgccctcccttggttcaagaccggtgtcattcccccagccggaacatacaactactgggcagaccctttcaccctatttgtattggaaatggcgttgatgggtttcgcagagcatagaagactccaagactggtataacccagggtcaatggggaagcaatacttcttggggttggagaaaggtttttcagggtcgggtgacccggcatacccaggtgggccgttctttaacccactcgggttcgggaaagatgagaagtcaatgaaggaactgaagctaaaagaaatcaagaatggaagattggctatgttagcaatcttgggttacttcattcagggtttggtgaccggggttggacctttcgagaacctgctggaccatttggctgatcctgtcaacaacaatgtcttgactagcctcaagttccactagactctccattttctttcctacatcatatgtaatatcatgtgcagatcgatctatttcttcggaatactattattaatttgtaacaaaattaatgatatataacggaaaccttgttgctactatatgcttgtgttggacaatataggatcaattctatgctcaaatcagtaagccaaacttggtttttggggctgtggaaaataggggaaagaggggctgtatgtgtagccgaaaactgatttttactctttatagttttctttttcttcaaactactaagggtgcatttggttgtgg

SEQ ID NO: 1651 - DNA, 1290 bp, Cucumis melo
agcatcttagcttatcttattcgttcccatttccattttatgattcctatttctaattctcagctctcacatcatcacttcaccaaccctctctggaaaaacaaagcctaacatatggccactcaggctcttgtttcttcttctttaacctcttcagtgggtgctgccagacagagattaggggcaaaaccgtcttttggatcttccaggaaatcagcttcttttgtagttagagctggagccactcctcctgttaagcaaggagcagacaggcaactgtggtttgcttcaaaacaaagtcttacttacttggatggaagtttgccaggcgattttgggttcgacccattggggctatctgatcccgaaggcacaggagggttcatcgagccaaaatggttggcatacggcgaagtgatcaacggaaggtttgcaatgttgggagcagcaggagccatagccccagagatctttggatcactggggttgatcccaccagaaacagccctcccatggttcaaaacaggggtcatcccaccagcagggacctacaactattgggcagacccttacacactctttgtattggaaatggctctgatgggctttgctgaacacagaagatttcaagattgggccaagccagggtccatgggaaaacaatactttttgggcttagagaagttcttgggtggatcaggggacccagcttaccctggtgggccattgttcaacccactagggtttgggaaagatgagaagtcaatgaaggaattgaagttgaaggaaattaagaatggaaggctagcaatgttggcaattttgggttactttatacaaggtcttgttactggtgttggaccttaccaaaatcttttggatcatttgtctgaccctgtcaacaacaatattttgaccagccttaaattccactagaagggtttatatgtgaattgtaatttgtgtaatgtatattaatatggatcacaatcccctttgggttgcttttgagctttcaaaaattgtttcccccactctattgtaacatgatttgaggaaaaacttttctctaatattttgcatcttcctctttgtaagagtatgggcatacgtatatttaaaaattagtataagattctacaagatattttatatgaggaaacaaatgttttagtcacattttaatagaactattataaggtagaagacatatgtcaaaaacaagaaatatggaacgagtgaattgtgcattttggatatgtttaaatgtgcaatatataagtatactat

SEQ ID NO: 1652 - DNA, 908 bp, Flaveria ramosissima
atggcaacacaagcattggcttcatcgtcatcactcacctcctcagttgagtctgcaaggcagatcggtgaggctagccacttcacacaccaacaagaaagatctcttttcttgtcaaagctgcttccacccctcctgttaagcaaggagctgacagacaactgtggtttgcatccaaacagtctctttcttaccttgatggaagtctcccaggtgactttggatttgacccacttggtctttcagacccagaagggaccggtgggttcatcgaacccaagtggctagcttacggagaggttatcaacggacggttcgccatgttgggagcagctggagccattgcacccgagattcttggcaagctcgggctcatcccagccgaaaccgccctcccatggttcaagacaggtgtcatccccccagccggaacatacgactactgggccgacccattcaccctatttgtattagaaatggcacttatgggctttgccgaacacagaagactccaagattggtacaacccgggttcaatgggaaaacaatactttttgggcctagagaaagggttctcggggtcgggtgaccccgcctacccgggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgacccagtcaacaacaatgtgttgaccagccttaagtttcactagagtcactatcttccttcctatatgtaatatcatgtgcagaatttcttgaaatattattattaatttgtgacgggtttaatgatatgt

SEQ ID NO: 1653 - DNA, 1176 bp, Lippia dulcis
ctcccgctgtccgtatccgcagccttgtgttccttattgtgagctactaattctcatttcttcatattttcttcactacaaccaaactcgaagagcaaaaatggcgacacaagcattggtctcttcatcatccatctgctcttccgctgaggccaccagaagggcctttggtggcaggtccgtcagatcttccaggaaggtttccttcgttgtcaaggcttcttctactccgcctgtcaagcaaggagcagacaggcagctctggtttgcatccgagcagagtctttcttacttggatggaagtctccctggtgacttcggattcgacccgttgggcctatccgacccagaaggccccggagggttcatcgaacctagatggctagcttatggagagatcatcaacgggcgttatgctatgttgggtgcagttggagccattgcacctgaaatcctaggaaaggctggcctgatcccgcccgaaactgccctcccatggttcaaaaccggagtcatcccaccggcgggtacatatgactactgggccgacccatacaccctatttgttttggaaatggcccttatgggctttgcggagcacaggaggtttcaggactggtacaaccctggatccatgggaaagcagtattttctgggcttggaaaagggtttcgccgggtcgggcgaccccgcatacccaggtggcccgtttttcaacccgctagggttcgggaaggatgagaaatcgatgaaggaattgaagttgaaggaggtgaagaatgggagattggcaatgctggcaatcttgggttattttatacagggtttggtcacgggcgttggcccgttccaaaacctgttggatcacttggctgacccagtccacaacaatgtgttgaccagcctcaagttccactaaaaatttgtagtgatattaatgtgaatttacactccatttcctggagttcagatttgtgatatccattatgtgcagagtattattgagcttactacgtgtgatgttcatgtaatgcatgagaatagatataatgtcgagcttgttgctatgccaaacccaatttgaggatttgcatgacacttctaaatgaggatgctaagagatgaacagccacactcataatagatgattttgttgggatccaaaccaatgtatta

SEQ ID NO: 1654 - DNA, 1103 bp, Prunus persica
atgccacagtgcccacaagttttggtggcccctggcccatgggagagagagagagagagagagagcaagggaggaaaagaaaagagaaaaatggccacacaagctctggtatcatcttcatccttaacagcctcaaaggaggctgcaaggcatttactaggaggaaaggcagtccaatctccatttgggtcaagaaaatctgcttcctttgtagtcagggcagcctctacaccccctgttaagcaaggagcagacagacaattgtggtttgcatccaagcagagccttacttacttggatggcagccttcctggtgactttggatttgatccgttggggctgtctgacccggaaggcacaggagggttcattgagccgagatggctagcgtatggagaggtcatcaatggacgttatgccatgctgggtgcagttggtgccatagcaccagagattcttggaaagcttggcctaatcccaccagagacagccctcccctggttccaaacaggggtgatccctccagctggaacctacaactactgggctgacccctatacactctttgtctttgagctagccctcatgggctttgcagagcacaggaggttccaggactggtacaatccagggtccatgggcaagcagtactttttgggcttggagaagtacttgggtggctcaggggacccagcttacccgggtgggcccctcttcaaccctctgggatttggcaaagatgagaagtctttgaaggacttgaagctcaaggaggtgaagaatgggaggctggctatgttggcaattttgggttacttcatacaaggccttgtgactggtgtggggcccttccagaaccttctggatcatttggctgaccctgtgaacaacaacgtcttgaccagcctcaagttccattgacagagatttgtacaatatatcttggttgctttgcttggaatatgatgaccctttgggtctctctctcctctttctcttcttcctatctcattgtaagattatgtgagaacagtttgttgttattatctgtctgtgactctctgtaagaaatgacatggtaaaagagctatttagaaccctaa

SEQ ID NO: 1655 - DNA, 1227 bp, Aristolochia fimbriata
atccgggggccttcattctaaaaatctgcgacgcaccacaagaagcagagaaaacatatcaaatggcagcagcaactcaggctcttgtatcagttgcttccagcagctcttcaatggaggccggacgccaacttcttggaggcagacctcttcaaacgcttccgtctagatccgtcggatcaccccgaagatcttcttttgtcgtccgagctgcttctactcctcccgcaaagcaaggagcaaacagacaactctggttcgcatcgaaacagagcctttcctacttggacggaactctcccaggcgactacgggttcgatcccctcggactctctgatccagaaggaaccggaggcttcatcgagcccaagtggctggcctatggggaggtcatcaacggccgcttcgccatgctcggagccgtcggcgccatcgcgccggaaatcttcggcaaattgggtctaattccggcggagaccgcactcccctggttcaagaccggggtcatccccccggccggcacgtacaactactgggccgacccctacactctcttcgtcttcgagatggctctcatgggcttcgccgagcacaggcggttccaggactgggccaaccccggatccatgggaaaacaatacttcttgggactggagaagggccttggtggatcgggcgaccctgcgtacccgggtgggcctttcttcaacccccttggattcggaaaagatgagaaatccatgaaggatttgaagcttaaggagatcaagaacgggagattggccatgctggccatcttgggttacttcattcaagggttggtgacaggggttggacccttccagaatctgctggaccacctgtccgaccctgtcaacaacaatgtcttgaccagcctcaagttccactgagctctgctctgccatttgtttaaatccctctcttctctactgtaacatgttgtgaacataagtgtaattttgggtgtttaccggtatgacatgttagactcatcagacttggagacttgtaattgatattttggtactccctcccaggtcgatttggttcgaatgcataatcaaggcctataatcaatgttttaaaaactggacaggccattaaaccggttagaccgggttggaccatggttcaacaattgaatattacacccaatattttgtatatatttaatgcttctacgtttttaaaacactgcttctatag

SEQ ID NO: 1656 - DNA, 1149 bp, Linum usitatissimum
ctgatttcttctttcaacctcagacaatagaagcttggggacacctgctatcaaaccaccaacaatggcggcacaggctctgctatcatcctccctcacatcttcagttgaatccgccaggcagattctaggaccaaggactagattcgggtcctccaggaaaggatcctttgttgtcagggccgcttccactccccctgtcaagcaaggggctgacagacaactatggtttgcatccaagcagagtctgtcttaccttgatggaagcctaccaggtgacttcggattcgacccacttggtctctcagacccagaaggtacaggaggattcatcgagccgaaatggttggcttatggtgagataatcaacgggcggttcgccatgttgggagctgctggcgccattgcccctgaaattctggggaaagccggtctcatcccggccgaaacagcccttccttggttccagaccggggtgatccctccggccggaacatacagctactgggcagactcatatacacttttcgtgctagagatggcactgatgggattcgccgagcaccggaggctccaggactggtacaacccgggatccatggggaagcagtacttcttggggtttgagaagttccttggaggctcaggtgaccctgcttaccctggaggacccattttcaaccctcttggctttgggaaagacgagaagtcgctcaaggaattgaagctgaaggaggtgaagaatgggaggctggccatgttggctatcttgggttactttatacagggtctagtaactggtgttggtccataccagaacctccttgaccacttggctgatcctgtcaacaacaacatcttgacaagcctcaagttccattagagctcattctggtcgtaatcttttttctcctgccctttgtaagcatgcttgttgtgaaaaggaaaaaactgctactgtaatttctctaaggaatgtggagtgctaaggatcaagatataaccttttattggtactgtcttgtgtatccgaatggtaatgaaccaagtacgtgagagattcaccatgcctcgactgatccattccccaaggcaacgcaaaacctgtagatctaccatagtaatgaagagaacagaaaggtttgatca

SEQ ID NO: 1657 - DNA, 1058 bp, Linum usitatissimum
gacaataagagcttggggacacctgcaatcaaaccaccaacaatggctgcacaggctctgttatcatcctccctcacatcttcagttgaatccgccaggcagattctaggaccaaggactagattcgggtcctccaggaaaggatcctttgttgtcagggccgcttccactccccctgtcaagcaaggggccgacagacagctatggtttgcatccaagcagagtctgtcttaccttgatggaagcctaccaggtgactttggattcgacccacttggtctctcagaccctgaaggcacaggaggattcattgagccgaaatggttggcttatggtgagatcatcaacgggcggttcgccatgttgggagctgccggcgcaattgcccccgagattctggggaaagccggtctcatcccagccgagacagcccttccttggttccagaccggggtcatcccaccggccggcacatacagctactgggcagactcgtacacactgttcgtgctggagatggcactgatgggattcgctgagcatcggagactccaggactggtacaacccgggatccatggggaagcagtatttcctggggtttgagaagttcttgggaggctcaggtgaccctgcttaccccggaggacccattttcaacccacttggatttgggaaagacgagaagtcgctcaaggaattgaagctcaaggaggtgaagaatgggaggctagccatgttggctatcttgggttactttatacagggtctagtaactggtgttggtccataccagaacctccttgaccacttggctgatcctgtcaataacaacatcttgacaagcctcaagttccattagagctcattctggttgtaatcttttttctcctgccctttgtaagcatgcttgtgaaaaggacaaaactgctactgtaatttctgtaagaaatgcggagtgctaaggatcaagatataacctgttattggtactgtcttgtgtatttgaatggtaatgaaccaagtacgtgagagattcaccatgccttgactgatccg

SEQ ID NO: 1658 - DNA, 1238 bp, Triticum aestivum
ccgccacatggcgggcttctactgggtccacagatgccctcatccgctgaggctccacatcacatcggaataagatttccctgaccccacccccgcccagcctcaggcgcacgttcctctctccttttgtagcagtgggtgagttttggagcacacactttcatctcagtctgtaccacacaccacgcctgcctcatctctcggagcagcagcaggaggagcttgcaggaacaatggcggcccagggtcttctctctgggaggcagctgcttgggaggcctctgcagtcttccatctccaggtcgtcttcctcccggaagtccgccttcgtcgtcagggcatcgtccagcccccctgccaagcaaaatgacaacaggcagctgtggttcgcgtccaagcagtccctcacctacctggacggcacgctgcccggtgactttggcttcgaccccttggggctgtccgacccggagggcaccggcgggttcatcgagcccaggtggctggcctacggcgagatcttcaacggccggacggcgatgatgggcgtggtgggcatgatcgccccggaggccctgggcaaggtgggcctggtgcccccggagacggcgatcccgtggttccaggccggcgcgatcccgccagcgggcacctaccagtactgggccgacccctacacgctcttcgtgttcgagatggcgctcatcggcttcgcggagcaccggcggctccaggactggtacaacccgggctccatggggaagcagtacttcctgggcctcgagaagtacctcggtggctccggcgaccccgcctaccccggcgggcccatcttcaacccgctcgggttcggcaccaagagcgagaaggagatgaaggagctcaagctcaaggagatcaagaacggccgcctcgccatgctcgccttcctcggcatgtccctgcaggccatcttcaccggcgtcgggcccttccagaacctcctcgaccacctctccgaccccgtcaacaacaacatcctcaccagcctcaagttccactaggcgaaatcgatccgatccgatccgagcatcgtcgtcctgtgcatggtacccgtcgtcgtgggaaacgtgagcgtgcgagaggtatatatgcgagggtgggtgtaaaatgtaaatttgtacgcgtgctgcgtgcatgcttgtaatatttatatcgtgctacgaaaattagtgcattgcatctctcgtcatcttcat

SEQ ID NO: 1659 - DNA, 1543 bp, Triticum aestivum
aggcgcacgttcctctctccttttgtagcagtgggtgagttttggagcacacactttcatctcagtctgtaccacacaccacgcctgcctcatctctcggagcagcagcaggaggagcttgcaggaacaatggcggcccagggtcttctctctgggaggcagctgcttgggaggcctctgcagtcttccatctccaggtcgtcttcctcccggaagtccgccttcgtcgtcagggcatcgtccagcccccctgccaagcaaaatgacaacaggcagctgtggttcgcgtccaagcagtccctcacctacctggacggcacgctgcccggtgactttggcttcgaccccttggggctgtccgacccggagggcaccggcgggttcatcgagcccaggtggctggcctacggcgagatcttcaacggccggacggcgatgatgggcgtggtgggcatgatcgccccggaggccctgggcaaggtgggcctggtgcccccggagacggcgatcccgtggttccaggccggcgcgatcccgccagcgggcacctaccagtactgggccgacccctacacgctcttcgtgttcgagatggcgctcatcggcttcgcggagcaccggcggctccaggactggtacaacccgggctccatggggaagcagtacttcctgggcctcgagaagtacctcggtggctccggcgaccccgcctaccccggcgggcccatcttcaacccgctcgggttcggcaccaagagcgagaaggagatgaaggagctcaagctcaaggagatcaagaacggccgcctcgccatgctcgccttcctcggcatgtctctgcaggccatcttcaccggcgtcggacccttccagaacctcctcgaccacctctccgaccccgtcaacaacaacatcctcaccagcctcaagttccactaggagaaatccatccgatccgatccgagcatcgtcgtcctgtgcatggtacccgtcgtcgtgggaaacgtgagcgtgcgagaggtatatatgcgagggtgggtgtaaaatgtaaatttgtacgcgtgctgcgtgcatgcttgtaatatttatatcgtgctatgaaaattagtgcattgcatctctcatcatcttcaccaacgtctgtgtctttctttccccgctcctcttctggttattgtacgtgcattttttgcatggtaatacgtgtctcatttatatcataatgatcatattacaagccacgtacataccaacctgacaatactgaaaagacaacagaacactagcctttgcacataggagcaccagccaagaagtaaaattacaaacaagactgaagaatcctctgagcttgacaccaacgtccgtcacctgcgtttggcaccaccataacagccatcaaaggagaaaatgacggatcaccttcacacccgagctcgacgcggctccatcgctgatatgcagctttgcggacctccaaggtggctcgccaataaaggcggagccattgccgttgaacgaatcagaccggggcaacaccccg

SEQ ID NO: 1660 - DNA, 1009 bp, Cucumis sativus
gctcttgtttcttcttctttaacctcttcagtgggtgctgccagacagagattaggggcaaggccttcttttggatcttccaggaaatcagcttcttttgttgttagagctgaagccactcctcctgttaagcaaggagcagacaggcaactctggttcgcttcaaaacaaagtctttcttacttggatggaagtctgccaggcgatttcgggtttgacccactggggctatctgatcccgaaggcacaggagggttcatcgagccaagatggttggcatacggcgaagtgatcaacggaaggtttgcaatgttgggagcagcaggagccatagccccagaaatctttggatcactggggttaatcccaccagaaacagccctcccatggttcaaaacaggggtcatcccaccagcagggacctacaactattgggcagacccttacacactctttgtatttgaaatggctctgatgggctttgctgaacacagaagatttcaagattgggccaagccaggatccatgggaaaacaatactttttgggcctggagaagttcttgggtggatcaggggacccagcttaccctggcgggccattgttcaacccactagggtttgggaaagatgagaagtcaatgaaggaattgaagttgaaggaaattaagaatggaaggcttgcaatgttggcaattttgggttactttatacaaggtcttgttactggtgttggaccttaccaaaaccttttggatcatttgtctgaccctgtcaacaacaatgttttgaccagccttaaattccactagaagggtttatatatgaattgtaatttgtgtaatgtatattaatatggatcacaatcccctttgggttgctttggagctttcaaaaattgtttccccccactctattgtaacatgatttgaggaaaaacttttctctaatattttgcatcttcctagatctttctaagagtatggacatatatattacatattaagtata

SEQ ID NO: 1661 - DNA, 1001 bp, Helianthus annuus
ggtgccacaaacaaccttctaatctcttgaagaaaatggcaacacaagcattggtatcatcatcacttacctcctcagtggagtctgctagacaaatccttggagcaaggtcacttcacacaccttcaagaaaggtttcttttgttgtcaaagctgcttccacccctcctgttaagcaaggagcaaacagacagctgtggtttgcatcaaagcagtctctttcttaccttgatggaagtcttccaggtgacttcggattcgacccacttggtctttcagacccagaagggaccggtggattcattgaacccaaatggctagcttacggagaggtcatcaacggacggttcgccatgttaggcgcagccggagccatagcacccgagattctaggcaagctcgggctcatcccagcggaaaccgccctcccctggttcaagaccggtgtcatccccccagcaggcacatacgactattgggccgacccatttaccctatttgtcctagaaatggcactaatgggctttgcagaacacagaagactccaagattggtacaacccagggtcaatgggaaaacaatactttttgggcttggagaaagggttttccgggtcgggtgacccagcgtacccgggtgggccgttctttaacccattagggtttggtaaagatgagaagtcaatgaaggaattgaagctaaaagaaatcaagaatggtagattggctatgttggccattttgggctacttcattcagggtttggtgactggggttgggccttaccagaaccttctggaccatttggctgacccggtcaacaacaatgtcttgaccagccttaagttccattagagagttttatctttgttccattatatgatgtcatgtgcagaatttctttgagatactattattaatttgtgacaaaattaatgatatgttacacttacggaccgaaaaaaaaaatcgcgccaatacacaccccccatgtcggttgtt

SEQ ID NO: 1662 - DNA, 1049 bp, Helianthus annuus
cgcggtattgtgttggcactccgggaattcgggcattacgggcgggggagtgccacaaacaaccttctaatctcttgaagaaaatggcaacacaagcattggtatcatcatcacttacctcctcagtggagtctgctagacaaatccttggagcaaggtcacttcacacaccttcaagaaaggtttcttttgttgtcaaagctgcttccacccctcctgttaagcaaggagcaaacagacagctgtggtttgcatcaaagcagtctctttcttaccttgatggaagtcttccaggtgacttcggattcgacccacttggtctttcagacccagaagggaccggtggattcattgaacccaaatggctagcttacggagaggtcatcaacggacggttcgccatgttaggcgcagccggagccatagcacccgagattctaggcaagctcgggctcatcccagcggaaaccgccctcccctggttcaagaccggtgtcatccccccagcaggcacatacgactattgggccgacccatttaccctatttgtcctagaaatggcactaatgggctttgcagaacacagaagactccaagattggtacaacccagggtcaatgggaaaacaatactttttgggcttggagaaagggttttccgggtcgggtgacccagcgtacccgggtgggccgttctttaacccattagggtttggtaaagatgagaagtcaatgaaggaattgaagctaaaagaaatcaagaatggtagattggctatgttggccattttgggctacttcattcagggtttggtgactggggttgggccttaccagaaccttctggaccatttggctgacccggtcaacaacaatgtcttgaccagccttaagttccattagagagttttatctttgttccattatatgatgtcatgtgcagaatttctttgagatactattattaatttgtgacaaaattaatgatatgttacacttacggaccgaaaaaaaaaatcgcgccaatacacaccccccatgtcggttgtt

SEQ ID NO: 1663 - DNA, 1086 bp, Papaver somniferum
agaaaaacaatggcaacccacactttggtttcatcttctcttacttcatcttctcttacttcatcttcttcatcttcaatggaagctgctagacaagtattcagaggaagaccacttcaatatgcaactgttaacgttggctcttcaaggaagggttcatttgttgttagagctgctgccactccacctgttaagcaaggagcaaacagacagctttggtttgcatccaaacagagtctttcttacttggacggcagcctcccaggtgatttcgggtttgacccacttggcctttcagatccagaaggaacaggaggatttattgaaccaaaatggctagcatatggtgaaattatcaacggacgttttgccatgttaggagcagcaggagcaatcgcaccagaagtcttcggcaaactcggtcttatcccacctgaaaccgcactcccatggttccaaactggagtgattccacccgccggaacttacagttactgggcagaccccttcacactatttgtactagaaatggctcttatgggttttgctgagcacaggagattgcaagactggtacaaccctggatccatgggcaaacaatatttcttaggtttggaaaagggtttgggtggatcgggtaaccctgcttacccgggtggacctttctttaacccactaggatttggaaaagatgagaagtcaatgaaggaattgaagttgaaggaagtgaagaatggaagattggccatgttggctattttaggttatttcattcaaggtttagtcacaggagttggacctttccagaacttgttggaccatttggctgatccagtcaacaacaatgtcttgaccagtctcaagttccattaaatttctatgcccaggttcttgtactctgggacttcattattctcttctctattttcctttttattttctccttttctctttatttgtgaaagtttatggagactcttgtaatttgtaattaagattagataaactggtttatattatggtgaatttattttaaataatatcatcttaaataattgcaagtcttgccaaataaaaaaaaaaaaa

SEQ ID NO: 1664 - DNA, 1016 bp, Papaver somniferum
ggcaacccagactttggtttcatcttctcttacttcatcttcttcctcttctatggaagctgctagacaagtattcagaggaagaccacttcaatatgcaactgttaacgttggctcttcaaggaagggttcatttgttgttagaggtgctgccactccacctgttaagcaaggagcaaacagacagctttggtttgcatccaaacagagtctttcttacttagacggcagtctcccaggtgatttcgggtttgacccacttggactttcagatccagaaggaacaggaggatttattgaaccaaaatggctagcatatggtgaaattatcaacggacgttttgccatgttaggagcagcaggagcaatcgcacccgaagtcttcggcaaactcggtcttatcccacctgaaaccgcactcccatggttccaaactggagtgattccacccgccggaacatacagttactgggcagaccccttcacactatttgtactagaaatggctcttatgggttttgctgagcacaggagattgcaagactggtacaaccctggatccatgggcaaacaatatttcttaggtttggaaaagggtttgggtggatcaggtaaccctgcttacccaggtggacctttcttcaacccattaggatttggaaaagacgagaagtcaatgaatgaactgaaattgaaggaagtgaagaacggaagattagctatgttggccattttaggttatttcattcaaggtttagtcacaggagttggacctttccagaacttgttggaccatttggctgatccagtcaacaacaatgtcttgactagtctcaagttccactaaatttctctgcccaggttcttgtactctgaggcttcattattctcttctctacttttctttttatctccttttttcctaccttttttctctatttgtgaaagtttatggagactcttgtaatttgtaattaaggttagataaaatggtttatattatggtaaatttattt

SEQ ID NO: 1665 - DNA, 940 bp, Flaveria ramosissima
atcatcactcacctcctcagttgagtctgcaaggcagatccttggagctagaccacttcacacaccaacaagaaagatctctttcttgtcaaagctgcttccacccctcctgttaagcaaggagcagacagacaactgtggtttgcatccaaacagtctctttcttaccttgatggaagtctcccaggtgactttggatttgacccacttggtctttcagacccagaagggaccggtgggttcatcgaacccaagtggctagcttacggagaggttatcaacggacggttcgccatgttgggtgcagccggagccattgcacccgagattcttggcaagctcgggctcatcccagccgaaaccgccctcccatggttcaagacaggtgtcatccccccagccggaacatacgactactgggccgacccattcaccctatttgtattagaaatggcacttatgggctttgccgaacacagaagactccaagattggtacaacccgggttcaatgggaaaacaatactttttgggcctagagaaagggttctcggggtcgggcgaccccgcctacccaggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgacccagtcaacaacaatgtgttgaccagccttaagtttcactagagtcactatcttccttcctatatgtaatatcatgtgcagaatttcttgaaatattattattaatttgtgacgggtttaatgatatgttaaggataccaaaaccttgttgtaatatgtagttactaaacatgtttgtttgtgcatg

SEQ ID NO: 1666 - DNA, 954 bp, Flaveria ramosissima
caccatgcttcattcactcatcactcacctcctcagttgagtctgcaaggcagatccttggagctagaccacttcacacaccaacaagaaagatctcttttcttgtcaaagctgcttccacccctcctgttaagcaaggagctgacagacaactgtggtttgcatccaagcagtctctttcttaccttgatggaagtctcccaggtgactttggatttgacccacttggtctttcagacccagaagggaccggtgggttcatcgaacccaagtggctagcttacggagaggttatcaacggccggttcgccatgttgggtgcagccggagccattgcacccgagattcttggcaagctcgggctcatcccagccgaaaccgccctcccatggttcaagacaggtgtcatccccccagccggaacatacgactactgggccgacccattcaccctatttgtattagaaatggcacttatgggctttgccgaacacagaagactccaagattggtacaacccgggttcaatgggaaaacaatactttttgggcctagagaaagggttctccgggtcgggtgaccccgcctacccgggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgacccagtcaacaacaatgtgttgaccagccttaagtttcactagagtcactatcttccttcctatatgtaatatcatgtgcagaatttcttgaaatattattattaatttgtgacgggtttaatgatatgttaaggataccaaaaccttgttgtaatatgtagttactaaacatgtttgtttgtgc

SEQ ID NO: 1667 - DNA, 805 bp, Flaveria ramosissima
cagatccttggagctagaccatttcagacaccttcaagaaagatctctttcttgtcaaagctgcttccacccctcctgttaagcaaggagcagacagacagctgtggtttgcatccaaacagtctctttcttacctggatggaagtctcccaggtgactttggatttgacccacttggtctttcagacccagaaggcaccggtgggttcatcgagcccaagtggctagcttacggagaggtcatcaacggacggttcgccatgttgggtgcagccggagccattgcacccgagattcttggcaagcttgggctcatcccagccgaaaccgccctcccttggttcaagaccggtgtcatccccccggccggcacatacgactactgggccgacccgttcaccctatttgttctagaaatggcacttatgggctttgcagaacacagaagactacaagattggtacaacccgggttcaatgggaaaacaatactttttgggcctagagaaaggctttgccgggtcgggcgaccccgcatacccaggcggcccgttcttcaacccgctagggttcggaaaagatgagaagtcaatgaaggaattgaagctaaaagagatcaagaatggtagattggctatgttggccattttgggctacttcattcagggtttggtgactggtgttgggccttaccagaaccttttggaccatttggctgatccagtcaacaacaatgtgttgaccagccttaagtttcactagagtcacaatcttccttcctatatgtaatatcatgtgcagaattt

SEQ ID NO: 1668 - DNA, 974 bp, Ipomoea batatas
gcacaggctctgatctcttcttcatccattgcctcttcagctgaggctgcaaggcaggttcttggagcaaggcctgtccaatcttcttctaggaaggtttcttttgttgttagggctgcctctactccccctgttaagcaaggaacagataggcagctatggtttgcatccaagcagagccccacctacttggatgggagccttccaggtgactatggatttgatccactgggactgtcagaccctgaagggccaggagggttcatagagccaagatggctagcatatggggaggtgatcaacgggcgttacgcgatgatgggggcagtaggagccatagcaccagagattcttgggaagcttggtctgatcccaccagaaacagccctgccatggttcaagactggagtgatcccccctgcaggaacatacaactactgggcagatccttacactctattcgtgttcgagatggctctgatggggtttgcagagcacaggagattccaggactgggcaaaccctggatcaatgggaaagcagtacttcctggggctggagaaggggctaggagggtcaggtgacccagcataccctggtggccctatcttcaaccccttgggggtttggcaaagatgagaaatcattgaaggatttgaagctgaaagaagtgaagaatggaaggctggctatgttggccattctgggatacttcatccaagctttggtcactggagttggtcccttccaaaacctgcttgatcatttggctgatcctgtaaacaacaacatcttgaccgaccttaaattcccctaaaccagatacatatatatatatatgtatgtatccccatgtgcccatattgctatctgcatcccatctgtaatcagtaatctccaagaaaaaggatatgtagctttgagcccctgtttgttccttattcagtcttagttgaagctttctttctgttgtc

SEQ ID NO: 1669 - DNA, 1187 bp, Ipomoea batatas
tttctctccacagtatccaactgcaaaaatcacacacccaaagatggcagcacaggctttgatctcttcttcttccataacctcttctgcagaggttgccaggcaggttcttggaggaaggcctctccaatcttccaggaaagtttcctttgttgtaagggcttcttcttctactccccctgtcaagcaaggagcagataggcctctctggtttgcatccaaacagagccttagctacttggatggcagccttcctggtgactatgggtttgatccactggggctctcagacccggaagggaccggaggtttcattgagccgaaatggctagcatatggagagatcatcaacgggcgttttgccatgttgggagcagtaggggctattgcaccagagattcttggaaaggccggcctcattccggctgaaaccgccctcccatggttcaagactggagtaattcctccggcaggaacatacaactactgggctgatccttacactctattcgtcctggagatggctctcatgggattcgcagagcaccggagattccaggactgggcaaaaccaggttcaatggggaagcagtacttcctaggactagagaaaggcttaggaggctcaggcgatccggcataccccgggtggacctctcttcaacccccttggatttggaaaggatgagaaatcaatgaaggatttgaagctgaaggaagtgaagaatggaagattggcaatgttggccatcctgggatacttcatccaaggcttggtgactggtgttggcccataccaaaaccttctcgaccatttggctgatcctgtcaacaacaacatcttgaccaaccttaaattccactaaacttgtagcaaaccatcatttcttcttcacagatatgtaacatcatctgtcgacattattttgcatgtcatctgtattccacaaggacatgtaccaattgaaacactgcaactattcagagttgtagtcagaaaattttcactgtattatcatctgtcagtcagttgggcaaatatgactagaaaaagtccaaggaaaattttccatggaactaaaccacataaattaacagtgcagatgaaaaattatattcaagtttacatgtaaaaactgttgcatttaaaactactattgaaataaatcgaggattatcaacctaaa

SEQ ID NO: 1670 - DNA, 1147 bp, Artemisia annua
cgtgtctctacagtggtatcaacgcagtactccgacgggaagaaaatggcaacacaagcattggtgtcatcatcatctcttacatcctcagttgaggctaataggcaaatcttgagtggaagaacacttcaagtttcatccaggaaggtttcatttgttgtcaaagctgctgctactccccctgttaagcaaaatacaaacaggcagctgtggtttgcatccaaacaatctctatcttatctagatggaagtctaccaggtgactttgggttcgacccactcggtctttcggacccagaaggcactggtgggttcattgaacccaaatggctagcctacggagaagtcatcaacggacgtttcgccatgctcggcgctgctggagccattgcacccgaaatttttggaaagcttggactcatcccggctgaaactgcactcccatggttcaaaaccggtgtcatcccaccagcaggcacatacaactactgggccgacccattcacactattcgtgttcgaaatggcactcatgggtttcgcagagcaccgaagactccaagactggtacaaccccgggtcaatggggaaacaatactttttaggtctagagaaaggcttttccgggtcaggtgacccagcataccccggcgggccatttttcaacccactcggttttgggaaagacgagaagtcaatgaaggagttgaagttgaaggaaataaaaaacggtagactagctatgttggcgatcttaggttactttattcagggtttggtcacgggggttggaccgttccagaaccttttggaccatttggccgacccggttaacaacaatgtgttgaccagccttaagtttcattagacttgtttcacttatttaatattatgtgcagagtttattcggaatactataaattaatctttgtaacaaaacttatgatgtcttccaggcttatcgaaaccttgttactactattcatacatttggcaacttggaacaaagatccgtgctaaatgtacatgcacattatagctaaccaacaaaaatacgataaatgatatcacccgatcatgctgcttgagctaaagcttcaggtgcatcggccctctgaagtccttctccaacttctactcttaaaaag

SEQ ID NO: 1671 - DNA, 995 bp, Flaveria ramosissima
tcactcacctcctcagttgagtctgcaaggcagatccttggagctagaccacttcacacaccaacaagaaagatctcttttcttgtcaaagctgcttccacccctcctgttaagcaaggagctgacagacaactgtggtttgcatccaaacagtctctttcttaccttgatggaagtctcccaggtgactttggatttgacccacttggtctttcagacccagaagggaccggtgggttcatcgaacccaagtggctagcttacggagaggttatcaacggacggttcgccatgttgggagcagctggagccattgcacccgagattcttggcaagctcgggctcatcccagccgaaaccgccctcccatggttcaagacaggtgtcatccccccagccggaacatacgactactgggccgacccattcaccctatttgtattagaaatggcacttatgggctttgccgaacacagaagactccaagattggtacaacccgggttcaatgggaaaacaatactttttgggcctagagaaagggttctccgggtcgggtgaccccgcctacccgggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgatccagtcaacaacaatgtgttgaccagccttaagtttcactagagtcactatcttccttcctatatgtaatatcatgtgcagaatcttgaaatattaatattaatttgtgacgggtttaatgatatgttaaggataccaaaaccttattgtaatatgtagttactaaacatgtttgtttgtgcatgcatgtaagtaagcacaacgagttatattaaatactctatgatttcatacgtaggagataa

SEQ ID NO: 1672 - DNA, 918 bp, Helianthus annuus
attgcttcagaaatggcaacacaagcattggcttcttcatcatcactcagctcctcagtggagtctgcaaggcaaatccttggagctaggccacttcacacatcttcaagaaaggtctcttttcttgtcaaagctgcatccacccctcctgttaagcaaggagcaaacagacaactttggtttgcatccaagcaatctctttcttacctggatggaagtctcccaggtgactatggatttgacccacttggtctttcagacccagaaggtactggtggattcattgaacccaagtggctagcttatggagaggttatcaacggtcggttcgccatgttgggtgcagctggagccattgcacctgagatatttggcaagcttgggctcatcccagccgaaaccgccctcccgtggttcaagaccggtgtcatccccccagcgggcacacacgactactgggcagaccctttcaccctgtttgtatttgaaatggcacttatgggttttgcagaacacagaagactacaagactggtacaaccctggttcaatgggaaaacaatactttttgggcttggagaaaggttttgccgggtcgggtgacccagcatacccaggtgggccgtttttcaacccattagggtttggaaaagatgagaagtcaatgaaggaattgaagcttaaagagatcaagaatggtagattggctatgttggccattttgggttacttcattcagggtttggtgactggtgttggacctttcgagaaccttctggatcacttggctgatccagtcaacaacaatgtcttgaccagccttaagttccactagagacttttaaatgtaatatcatgtgcagtagtttacaaatgatattattaatttgtaacgaaaattatgtgatatgttaaggag

SEQ ID NO: 1673 - DNA, 1086 bp, Flaveria ramosissima
attgggggcaccaacaacctgcaattaaccttttctaagaaatagcgaacacaagcattggcttcatcatcatcactcacatcctcagttgagtctgcaaggcagatccgttggaggctagaccacttcacacaccaacaagaaagatctcttttcttgtcaaagctgcttccacccctcctgttaagcaaggagcagacagacaactgtggtttgcatctaaacaatctctttcttaccttgatggaagtctcccaggtgactttggatttgacccacttggtctttcagacccagaaggaaccggtgggttcatcgaacccaagtggctagcttacggagaggttatcaacggacggttcgccatgttgggagcagctggagccattgcacccgagattcttggcaagctcgggcttatcccagccgaaaccgccctcccatggttcaagaccggtgtcatcccccggccggcacatacgactattgggctgacccattcaccctatttgtattagaaatggcacttatgggctttgccgaacacagaagactccaagattggtacaacccgggttcaatgggaaaacaatactttttgggcctagagaaagggttctccgggtcgggtgaccccgcctacccaggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttaccagaaccttttggaccatttggctgatccagtcaacaacaatgtgttgaccagccttaagtttcactagagtcactatcttccttcctatatgtcatatcatgtgcagaatttcttgaaatattattattaatttgtaacgggtttaatgatatgttaaggataccaaaaccttgttgtaatatgtagttactaaacatgtttgtttgtgcatgcatgtacttgagcaaaacgggttatgttaaatctcatgatctttgaaaaaaaaaaatcacagaattgacgaaaatg

SEQ ID NO: 1674 - DNA, 1037 bp, Vaccinium corymbosum
tttggtgaagaataagagacattctcctccagagtttggcaatcaaaaacattaacacaacaaaaatggcaactcaagcactgctttcatcttctattgcctcctcagtagaggctactagaaagattgtaggaggaaggccaacccaatctcctaggagggtgtcctttgttgttagggcagcttctactccccctgttaagcaaggagatagacccctttggtttgcttccaagcagagcctttcttatttggatggcagcttgcccggtgactatggattcgacccgcttgggctgtcagacccagaaggcacaggaggcttcatagagcccaaatggctagcctatggagaggtcatcaacggccgatacgctatgttgggggtggtcggttgtcttgcaccggaaatccttggaaaactcggcctcatcccgccggagaccgccctcccctggttccaaaccggggtgattccaccggcagggacatacaactactgggcagacccttacaccctatttgtgctggaactagcactgatgggctttgcagagcacaggagattccaagactggtacaaccctgggtccatggggaaacaatactttttggggttggagaagttcttgggcgggtcgggtgacccggcttaccctggtggacccctcttcaacccgcttgggtttgggaaggatgagaagtctatgaaggaattgaagttgaaagaggtcaagaatgggaggttggccatgttggctattttggggttctttatccaagggctggtgaccggagtcggacctttccagaatttactggatcatttggcggatcctgtgaacaacaatgtcttgactagcctcaagtttcattgagagatcccatgctctctctcactccctccctcttttgtgaaaccatgtgcatactttatttggtgtatctatgtgtaacctgtaaaacaaatgaagtatcctgggtttgagaaccttctagttttgacattcctatttggcgtgagcttcaacagtggt

SEQ ID NO: 1675 - DNA, 987 bp, Beta vulgaris
ggttggatagagtactgaaagagtactctattgagtattcacttcatctaatttcatcaaagaattaacttttctacccttttctaagaataagtaatggcaacacaagctttggtctcatcttctttaacttcttcagtggaaactgcaagacaaattctaggtgctaggtcaggaatttctccttcttcaaagaagaactcttttgttgtcagagcatctgctactcctcccgttaagcaaggagcaaacaggcccctttggtttgcatcgaagcagagcctttcatacttggatggcagtcttccaggagatttcgggttcgacccactaggactctcagacccagaaggcactggtgggttcattgagcctagatggttagcctatggtgagatcatcaacggtcgtttcgctatgctaggtgcagcaggtgcaatcgcgcccgaaatcctaggaaaagctggtctgatcccagctgaaacagccctcccatggttccaaactggtgtgatcccaccagcaggcacctacaattactgggctgacccttacacattgtttgtgtttgagatggcactaatgggcttcgccgagcaccgtagattgcaggattggtacaacccagggtccatgggaaagcaatacttcttgggcctagagaaaggctttgctggatcaggtgacccagcttacccaggtgggcctattttcaacccattgggctttggaaaggatgagaagtccatgaaggagcttaagcttaaggaagtaaagaatggcaggttggctatgttggctatcttgggctactttattcaaggtcttgtaactggtgttgggccataccaaaacctccttgatcacttggctgatccagtcaacaacaacgtcttgactagtctcaagttccactaagaaattctctcacatcttttttttttctcatggtcaattatgttttgtacctcggccgcgaccacgcta

SEQ ID NO: 1676 - DNA, 979 bp, Gerbera hybrid cultivar
caagcattggcttcatcttcatcactcacctcttcaatggaggttgctaggcaacttctaggagcaaggccacttcattcttcttcaagaaaaatttcctttcttgtcaaagccgcttccactcctcctgttaagcaaggagcagacagacaactctggtttgcatccaagcaatctctctcttacttggatggcagtctcccaggcgactacgggttcgacccacttggtctttcagacccggaaggcaccggagggttcattgaacccaagtggctagcctacggtgaggttttcaatggacggttcgccatgttgggtgcggtcggagccatcgcaccagagatttttggcaagcttgggctcatcccagccgaaacggcacttccctggttcaagaccggtgtcatccccccagccggcacatacgactactgggccgacccgtacaccctatttgtgttcgaaatggcactaatgggctttgctgaacacagaagattccaagactggtataacccgggctcaatggggaaacaatacttcttggggttggagaaagggttcgctgggtcgggtgacccggcgtacccaggcgggcccttctttaacccactagggtttgggaaagatgagaagtcactgaaggacttgaagctgaaagagatcaagaatggtagattggcaatgttggctatcttgggttacttcattcagggtctggtgacaggggttgggcctttccagaaccttctggaccatctggctgacccggtcaacaacaatgtcttgaccagccttaagttccactagacaactctctatttcatcttcatgtatgtaatatcatgtgcagagtttattgggaatactattgttaatttgtaatgaaattaacgattatgttaagtaaacttaaaccttgtttgtaattgtaaactacaaataccagaaatatgatgtaaactctcagcatcta

SEQ ID NO: 1677 - DNA, 1045 bp, Triticum aestivum
actttcatctcagtctgtaccacacaccacgcctgcctcatctctcggagcagcagcaggaggagcttgcaggaacaatggcggcccagggtcttctctctgggaggcagctgcttgggaggcctctgcagtcttccatctccaggtcgtcttcctcccggaagtccgccttcgtcgtcagggcatcgtccagccccctgccaagcaaaatgacaacaggcagctgtggttcgcgtccaagcagtccctcacctacctggacggcacgctgcccggtgactttggcttcgaccccttggggctgtccgacccggagggcaccggcgggttcatcgagcccaggtggctggcctacggcgagatcttcaacggccggacggcgatgatgggcgtggtgggcatgatcgccccggaggccctgggcaaggtgggcctggtgcccccggagacggcgatcccgtggttccaggccggcgcgatcccgccagcgggcacctaccagtactgggccgacccctacacgctcttcgtgttcgagatggcgctcatcggcttcgcggagcaccggcggctccaggactggtacaacccgggctccatggggaagcagtacttcctgggcctcgagaagtacctcggtggctccggcgaccccgcctaccccggcgggcccatcttcaacccgctcgggttcggcaccaagagcgagaaggagatgaaggagctcaagctcaaggagatcaagaacggccgcctcgccatgctcgccttcctcggcatgtctctgcaggccatcttcaccggcgtcggacccttccagaacctcctcgaccacctctccgaccccgtcaacaacaacatcctcaccagcctcaagttccactaggcgaaatccatccgatccgatccgagcatcgtcgtcctgtgcatggtacccgtcgtcgtgggaaacgtgagcgtgcgagaggtatatatgcgagggtgggtgtaaaatgtaaatttgtacgcgtgctgcgtgcatgcttgtaatatttatatcgtgcta

SEQ ID NO: 1678 - DNA, 1214 bp, Malus domestica
caccaattccgtatcttccttattacatgtaggaagttgtggtgtgtgagagactgagcaaaatatttgagtggccggaggagagagagagagagagagagagcgcgcgctagagagagaaaatggcagcacaagctctggtttcatcatcttctttaacagcctcaaaggaggttgctaggcagatatttggaggaacaaaggctgtccaatctccatttgggtcgagaaaatctgcttcctttgtagtaagggcggcatctactcctcccgttaagcaaggagcagacagacagttgtggtttgcttccaagcagagcctttcttacttggatggcagccttcccggcgacttcggattcgatccattgggcctctctgacccagaaggcacaggtgggttcatcgagcccagatggctagcctacggtgaagtcatcaacggacgttacgccatgctgggtgcagttggtgcaattgccccagaaatcctgggcaagctcggccttatcccggccgagactgcccttccttggttccaaaccggagttatcccgccagccgggacctacaactactgggccgacccctacacactctttgtcttcgagctcgccctaatgggcttcgccgagcaccggaggttccaggactggtacaaccccgggtccatgagcaagcaatacttcttgggccttgagaagtacttgggcgggtcgggtaacccagcttaccccggtgggcctttgttcaacccgctagggtttgggaaagacgagaagtcgatgaatgagttgaagctcaaggaagtgaagaatgggaggcttgccatgctggcaattttgggttattttattcagggtcttgtgactggtgtggggccctaccagaaccttctggatcacttggctgacccggtcaacaacaacatcttgaccagcctcaagttccattaagtctgtacaacttaatttggcctctcattgtgcaagattatatgatataatctttgttgtttgatcttgttttctgtgactctttgtaagaaatgacatgttaaaaagagctatattagaaccctaattaatgttatcagatttcatgaattacaatacagatgctcattaaatttatattttatcgtacttaatagatatatttttgttgtaactttgagaactttttaaaacatttattcaaactttctttgctta

SEQ ID NO: 1679 - DNA, 1053 bp, Festuca arundinacea
cacacaccgcacctgcctcatcatctctctctgagcagcaggagggggagcttgcaggaacaatggcggctcagggtcttctgtcagggaggcagctgctggggaggccactgcagtcttccatctcgaggtcgtcttcctcccggaagtcatccttcatcgtcagggcatcgtcctctccccctgccaagcaaggtaacaggcagctgtggttcgcgtccaagcagtccctcacctaccttgacggcactctgcccggtgactttggcttcgaccccttgggtctgtcagacccggagggcaccggcggcttcatcgagcccaggtggctggcctacggcgagatcttcaacggccggacggcgatgatgggggtggtgggcatgatcgccccggaggccctgggcaaggtgggtcttgtcccctcggagacagccatcccgtggttccaggctggcgcgatcccgccggcgggcacctaccagtactgggctgacccctacacgctattcgtcttcgagatggcgctgatcgggttcgccgagcaccggcggctccaggactggtacaaccccggctccatgggtaagcagtacttcctgggcctcgagaagtacctcggcggctccggtgaccccgcctaccccggcggccccatcttcaacccgctcgggttcggcaccaagagcgagaaggagatgaaggagctcaagctcaaggagatcaagaacggccgcctcgccatgctcgccttcctaggcatgtccctccaggccatcttcaccggcgtcggccccttccagaacctgctcgaccacctctccgaccccgtcaacaacaacatcctcaccagcctcaagttccactaggccaaaagcatcgtcgtcctgtgcatggtatacccgtcgtcgatggaaatgtgtgcgcgcgagaggtatagatgtgcgagggtggggtgtgaaatgtaaatttgtacgcgtgctccgcgcatgcttgtaatatctatattgtgctattaatttagtgcattgcatctctgatcatcttcagcaa

SEQ ID NO: 1680 - DNA, 1135 bp, Actinidia deliciosa
  misc_feature (1081)..(1082): n is a, c, g, or t
  misc_feature (1084)..(1084): n is a, c, g, or t
  misc_feature (1087)..(1087): n is a, c, g, or t
ctgtttttgtttaatggtactgcatgcgtgagggagagagctattctcatacagagtgagcccaaaacagtcacgaaatggcaacacaagcactggtctcatcagcatctcttacctcctccgtggagtctgccaggcagattctaagaggaaggtcagccctaacacctgctagaaaggtttcatttgttgtcagggcagcttctactccccctgttaagcaaggagcagatagacccctctggtttgcctccaagcaaagcctttcttatttggatggcagccttcccggtgactacggattcgacccgcttgggctctcggaccctgagggcactggatgtttcatcgagcccaaatggttagcctacggtgaggtcttcaacggccgttgcgccatgatgggggctgttggagccattgcgcctgagattctcgggaagctaggcctcatcccgcaggaaaccgccctcccgtggttcaagaccggtgttattcctccggccgggacgtacacctactgggcagacaattacaccctatttgtgttcgagatggcactggtgggatttgcagagcacaggaggttccaagactggtacaaccccgggtccatggggaaacagtacttcttggggttagagaagtacttgggcgggtcgggcgacccggcataccccgggggacccatcttcaaccctctgggatttgggaaggatgagaagtccatgagggatttgaagttgaaggagatcaagaatgggaggttggccatgttggctatcttagggtactttatacaggcgcctgtgacaggagttggacccttccagaatctcctggaccatttggctgaccctgtcaacaacaatctcttgactagcctcaagtttcattgagagagcctataatactgctctctctctctctctctctcatgtgcagagtttgtgtggtgtattatgtgttctctgtaacaaatgacatattctggacgtacatatcctattgatgttccaatagggtggaatcataatgatggcttacatgcaaatctaaatatctcttcgtcctcattcannanaanattgcaacccacacaaaagaagaggaacatttatttcttgatgtatct

SEQ ID NO: 1681 - DNA, 1080 bp, Leymus cinereus x Leymus triticoides
  misc_feature (183)..(183): n is a, c, g, or t
gcacgaggctttcatctcagtctctaccacacaccgcgcttgcctcatctctcggagcaggaggaggaggagcttgcaggaacaatggcggcccagggtcttctctctgggaggcagctgctggggaggcctctgcagtcttccttctccaggtcgtcttcctcccggaagtcccccttcatngtcagggcagagtccagcccccctgccaagcaaaatgacaacaggcagctgtggttcgcgtccaagcagtccctcacctacctcgacggcacgctgcctggtgactttggcttcgaccccttggggctgtctgacccggagggcaccggcgggttcatcgagcccaggtggctggcctacggcgagatcttcaacggccggacggcgatgatgggggtggtgggcatgatcgccccggaggccctgggcaaggtgggcctggtgcccccggagacggcgatcccgtggttccaggcgggcgcgatcccgccggcgggcacctaccagtactgggccgacccctacacgctcttcgtgttcgagatggcgctgatcggcttcgcggagcaccggcggctccaggactggtacaacccgggctccatggggaagcagtacttcctgggcctcgagaagtacctcggcggctccggcgaccccgcctaccccggcgggcccatcttcaacccgctcgggttcggcaccaagagcgagaaggagatgaaggagctcaagctcaaggagatcaagaacggccgcctcgccatgctcgccttcctcggcatgtccctgcaggccatcttcaccggcgtcgggcccttccagaacctcctcgaccacctctccgaccccgtcaacaacaacatcctcaccagcctcaagttccactaggcgaaatcggagcctcgtcgtcctgtgcatggtacccgtccgtcgtcgtgggaaacgtgagcgtgcgagcggtatatatgcgagggtgggtgtaaaatgtaaatttgtacgcgtgctgcgtgcatgcttgtaatatttatatcgtgctatgaaaattagtgcattgcatctctcattaaaaaaaaa

SEQ ID NO: 1682 - DNA, 1036 bp, Lolium multiflorum
ctcaccacaccgcacctgcctcatcatctctctctgagcagcaggaggaggaggttgcaggaacaatggcggctcagggtcttctgtcagggaggcagctgctggggaggccactgcagtcttccatctcgaggtcgtcttcctcccggaagtcctccttcatcgtcagggcatcgtcctctccccctgccaagcaaggtaacaggcagctgtggttcgcgtccaagcagtccctcacctaccttgacggcactctgcccggcgactttggcttcgaccccttgggtctgtccgacccagagggcaccggcggcttcatcgagcccaggtggctggcctacggcgagatcttcaacggccggacggcgatgatgggggtggtgggcatgatcgccccggaggccctgggtaaggtgggtcttgtcccctcggagacagccatcccgtggttccaggctggcgcgatcccgccggcgggcacctaccagtactgggccgacccctacacgctattcgtgttcgagatggcgctgatcgggttcgccgagcaccggcggctccaggactggtacaaccccggctccatgggtaagcagtacttcctgggcctcgagaagtacctcggcggctccggcgacccagcctaccccggcggccccatcttcaacccgctcgggttcggcaccaagagcgagaaggagatgaaggagctcaagctcaaggagatcaagaacggccgcctcgccatgctcgccttcctgggcatgtccctccaggccatcttcaccggcgtcggccccttccagaacctcctcgaccacctctccgaccccgtcaacaacaacatcctcaccagcctcaagttccactaggccaaaagcatcgtcgtcctgtgcatggtatacccgtcgtcgatggaaatgtgtgcgcgcgagaggtatagatgtgcgagggtggggtgtgaaatgtaaatttgtacgcgtgctccgcgcatgcttgtaatatctatattgtgctattaatttagtgcattgca

SEQ ID NO: 1683 - DNA, 1150 bp, Avena sativa
agcacacgttcctctctccttttgtagcagtgacgagtttggagcacacactttcatcccagtctcgccgcacacaccacacctgcctcatcgtctctctctgagcagcagcagcagcagcagcaggaggaggagcttgcaggaacaatggcggctcagggtcttctttccgggaggcagctgctggggaggccactgcagtcctccatctccaggtcgtcttcctcccggaagtcctccttcatcgtcagggcatcgtcctctccccctgccaagcaaaatgataacaggcagctgtggttcgcctccaagcagtccctcacctacctcgacggcactctgcccggtgactttggcttcgaccccttgggtctgtcagacccggagggcaccggcggcttcatcgagcccaggtggctagcctacggcgagatcttcaacggccggacggcgatgatgggtgtggtgggcatgatcgccccggaggccctgggcaaggtgggtctggttcccccggagacggccatcccgtggttccaggctggcgcgatcccgccagcgggcacctaccagtactgggctgacccctacacgctgttcgtgttcgagatggcgctcatcgggttcgctgagcaccggcggctccaggactggtacaacccgggctccatggggaagcagtacttcctgggcctcgagaagtacctcggcggctccggcgaccctgcctaccccggtggccccatcttcaacccgctcgggttcggcaccaagagtgagaaggagatgaaggagctcaagctcaaggagatcaagaacggccgcctcgccatgctcgccttcctgggtatgtccctccaggccatcttcaccggcgtcggccccttccagaacctcctcgaccacctctccgaccccgtcaacaacaacatcctcaccagcctcaagttccactaggccgaatgcatcgtccctcctgtgcatggtattggtatacccgtcgtcgttgatggaaatgtgtgcgcgcgcgagaggtgtatatgtctatgtgcgagagggtgggtgtgaaatgtaaatttgtacgcgtgctccgcgcatgcttgtaatatctataatattgtgctattgatttagtgcatcgcatctctga

SEQ ID NO: 1684 - DNA, 1085 bp, Avena sativa
gcacacactttcatcccagtctcgccgcacacaccacacctgcctcatcgtctctctctgaccagcagcagcagcagcaggaggagcttgcaggaacaatggcggctcagggtcttctttccgggaggcagctgctggggaggccactgcagtcctccatctccaggtcgtcttcctcccggaagtcctccttcatcgtcagggcatcgtcctctccccctgccaagcaaaatgataacaggcagctgtggttcgcctccaagcagtccctcacctacctcgacggcactctgcccggtgactttggcttcgaccccttgggtctgtcagacccggagggcaccggcggcttcatcgagcccaggtggctagcctacggcgagatcttcaacggccggacggcgatgatgggtgttgtgggcatgatcgctcctgaggcccttggcaaggtgggtctggtgcccccggagacggccatcccgtggttccaggctggcgcgatcccgccagcggggacctaccagtactgggctgacccctacacgctgtttgtgttcgagatggcgctgatcgggttcgctgagcaccggcggctccaggactggtacaacccgggctccatggggaagcagtacttcctgggcctcgagaagtacctcggcggctccggcgaccctgcctaccccggtggccccatcttcaacccgcttgggttcggcaccaagagcgagaaggagatgaaggagctcaagctcaaggagatcaagaacggccgcctcgccatgctcgccttcctgggtatgtccctacaggccatcttcaccggcgtcggccccttccagaacctcctcgaccacctctccgaccccgtcaacaacaacatcctcaccagcctcaagttccactaggccgaatgcatcgttgctcctgtgcatggtattggtatacccgtcgtcgttgatggaaatgtgtgcgcgcgcgagaggtgtatatgccgatgtgcgagggtgggtgtgaaatgtaaatttgtacgcgtgctccgcgcatgcttgtaatatctatattgtgctattgatttagtgcat

SEQ ID NO: 1685 - DNA, 924 bp, Triticum aestivum
cacacaccacgcctgcctcatctctcggagcaggaggaggagcttgcaggaacaatggcagcccagggtcttctctctgggaggcagctgctggggaggcctctgcagtcctccatctccaggtcgtcttcctcccggaagtccccttgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggcctacggcgagatcttcaacggccggacggcgatgatgggggtgtgggcatgatcgccccggaggccctgggcaaggtgggcctgggtgcccccggagacggcgatcccgtggttccaggcaggcgcgatcccgccggcgggcacctaccagtactgggccgacccatacacgctcttcgtgttcgagatggcgctcatcggcttcgcggagcaccggcggctccaggactggtacaacccgggctccatggggaagcagtacttcctgggccttgagaagtacctcggcggctccggcgaccccgcctaccccggcgggcccatcttcaacccgctcgggttcgggaccaagagcgagaaggagatgaaggagctcaagctcaaggagatcaagaacggccgcctcgccatgctcgccttcctcggcatgtccctgcaggccatcttcaccggcgtcgggcccttccagaacctcctcgaccacctctcagaccccgtcaacaacaacatcctcaccagcctcaagttccactaggcgaaatcgatccgatccgatccgagcatcgtcgtcctgtgcatggtacccgtcgtcgtggg

SEQ ID NO: 1686 - DNA, 1014 bp, Plantago ovata
cggccggggggctgctgccatgtcttaatgtattcattcttctccagctttggacatcaatagctgctctgcagaacattacacttggaaagcaagaaatggcaacacaggcattggtctcttcttcatcaatctgctcttcagctgatgttgcaagacaaacttttggaggaattaggccactccactcttcacggaaggtttgcttcgttgtcaaggccgcctcctcgcctcccgttaagtcaggagcagataggccactatggtttgcatccaagcagagcctgtcctatttagatggcagcctccccggtgattacggattcgatccattaggcctatcagacccagaaggcaccggaggattcattgagccaaaatggctagcatacggagaggtgatcaatgggaggttcgctatgctgggagcagcaggagccattgcaccagaaattctagggaaagctggcctaatcccaccagagacagcactcgcatggttccaaaccggagtcattccaccagccggtacatacaactactgggccgatggatacaccctatttgtccttgagatggccctgatgggtttcgcggaacacaggaggctccaggactggtacaacccaggttcaatgggaaagcagtacttcttgggactcgaaaagggcttctcagggtctggtgaccctgcctaccctggtggaccgttcttcaacccactaggattcgggaaagatgagaaatccatgaaggagttaaagcttaaggagattaagaatggaagattggctatgttggctatcttgggctactttattcagggactagttactggtgtcggtccataccagaacctgttggatcacttggctgatccagtcaacaacaatgtgttaacaagcctcaaattccactagacttgtaacaaattaaatcttgttatatcctatcctaaacttgtgcagagtattgttaaacatttgagctgtaatctaatcaggagcttcttca

SEQ ID NO: 1687 - DNA, 1111 bp, Citrullus lanatus
actccaccaataacccattttcaaagcctttcttccctttttttttcttctttggaaacaaaccctaatatggctactcaggcacttgtctcatcttctttaacctcttcagtgggtgcagccagacagagattaggggcaaaaccgtcttttggatcttccagaaaatcagcttcttttgttgttagagctcaagccactcctcctgttaagcaaggagcagatagacaactgtggttcgcttcaaaacaaagtctttcttacttggatggaagtctcccgggtgattacggatttgacccattggggctatcagaccccgaaggaacaggagggtttatcgagccaagatggttggcatacggtgaggtgatcaacgggaggttcgcgatgttgggagcagccggagccattgccccagagatctttggatccctagggttaatcccaccagaaacagccctcccatggttcaaaacaggggtcatcccaccagcaggaacctacaactattgggcagacccttacacactctttgtattagaaatggctctaatgggctttgctgaacacagaagatttcaagattggtccaagccagggtccatgggaaaacaatactttttgggcctagagaagttcttgggtgggtcaggggacccagcttacccaggtgggcccttgttcaacccattagggtttgggaaagatgagaagtcattgaaggatttgaagctgaaggaagtgaagaatggaaggcttgcaatgttggcaatattgggttattttgtacaaggtcttgtcactggtgttgggccttaccaaaaccttttggatcatttgtctgacccagtcaacaacaatgttttgaccagccttaaattccactagaagaagggatattatgtgaattgtaatttgtgcattgtatattaatatgggtcacagtccctttgggttgttttggagctttcaaaatttgtttccccctctctttctctctattgtaacatgatttgaggaaaaaacttttctctaatattttgcccatctttctctacgtaataatattgacatatatgttaattacctatctagtatcaattgatgc

SEQ ID NO: 1688 - DNA, 1188 bp, Ambrosia trifida
catccttctaactgtttgaaagaaaatggcaacacaagcattggcttcatcatcatcactcacctcctcagtggagtctgctaggcaaatccttggagctaggccacttcacacatcttcaaggaaggtctcttttgttgtcaaagctgcttccacccctcctgtaaagcaaggagcaaatagacaactgtggtttgcatccaagcaatctctttcttacctggatggaagtctcccaggtgactatggattcgacccactcggtctttcggacccagaaggtaccggtgggttcattgaacccaagtggctagcgtatggagaagttatcaatgggcggtttgccatgttgggtgcagctggagccattgcacccgagatattcggcaaacttgggctcatcccacccgaaaccgccctcccatggttcaagaccggtgtcatccccccggccggcacatacgagtactgggctgacccattcaccctatttgtatttgaaatggcacttatgggctttgcagaacaccgaagactacaagattggtacaacccgggttcaatggggaaacaatactttttgggcttggagaaagggtttgccgggtctggtgacccggcatacccgggtgggccgtttttcaacccattagggtttggaaaagatgagaagtcaatgaaggaattgaagcttaaagagatcaagaatggtagattggctatgttggctattttgggttacttcattcagggcttggtgactggtgttgggcctttccaaaaccttttggaccatttggctgatccagtcaacaacaatgtcttgaccagccttaagttccactagagagagactcttatcttccttctacttatatgtaatattattatgtgcagtattttcgaaatattattgttaatttgtcgaaattaatgatatgttaaggaaccaaaaccttgtcatgtaatatgtagttgtagttcctacatatgtaagtcttgtttgtgcgtgcatgtacttatgcaacacggacttaatattagttctatcatattattagatttttccaataggaattggattgttagagtggatttataacccacgttttcctttgtccagctcattgtaattcttcgaaatttaaacgaaaaaggtaccacaacttcacagaggctaaaaaagaa

SEQ ID NO: 1689 - DNA, 1163 bp, Castanea mollissima
ccagatttcattctttagataatcaatcatatagtactctaatctacctactactactttgatcacaaaactttgggagagagaagaaagaggaaaatggcaacacaagcacttgtatcatcatcatctctgacctcttcagtggaggcagctaggaaggtacttggagcaagatcttcaattgggtcctcaagaaaagcttccttttcagtaagggcagcgaccactccacctgttaagcaaggagcagatagacccttgtggtttgcatccaagcagagtcttacttacttggacggcagcctccctggtgactatggattcgaccctctgggcctctcggacccagagggtacaggagggttcattgaacccagatggttagcctatggtgaggtaatcaacggacgttatgccatgttgggtgcagttggtgccatagcacccgagattttagggcagcttggcctcattcctccggaaacagccctcccttggttcaaaactggagtcatcccaccggccgggacatacgactactgggcagacccttacacactttttgtatttgagttggcactgatgggatttgcagagcacaggaggttccaagactggtacaatccagggtctatgagcaaacagtacttcttggggttagagaagtatttgggagggtctgataacccagcctaccctggtggacccttgtttaacccacttggctttggaaaggacgagaagtcattgaatgacttgaagctcaaggagatcaagaacggaaggttggccatgttagctatcttgggttactttgttcaaggtcttgttacaggtgttggaccttaccaaaacctcttggatcatctggctgaccctgtcaacaacaatgtcttgactagcctcaagttccattaaggggattatatatattatatttactcctcttgttgtttggaacaacccacccgaccacttctctctctctccctctccctctccctctctgctgtaacatgatgtctacctatcctgtgatccttgtctagttctgtaagaaatgagatgttaaggactgaaaatagacctgttaattaatgccttcattatgtaatcaatcttaatatgtagcaaatcagagcatttatctttaaaaaaaaaaa

SEQ ID NO: 1690 - DNA, 1016 bp, Plantago ovata
cggccggggggctgctgccatgtcttaatgtattcattcttctccagctttggacatcaatagctgctctgcagaacattacacttggaaagcaagaaatggcaacacaggcattggtctcttcttcatcaatctgctcttcagctgatgttgcaagacaaacttttggaggaattaggccactccactcttcacggaaggtttgcttcgttgtcaaggccgcctcctcgcctcccgttaagtcaggagcagataggccactatggtttgcatccaagcagagcctgtcctatttagatggcagcctccccggtgattacggattcgatccattaggcctatcagacccagaaggcaccggaggattcattgagccaaaatggctagcatacggagaggtgatcaatgggaggttcgctatgctgggagcagcaggagccattgcaccagaaattctagggaaagctggcctaatcccaccagagacagcactcgcatggttccaaaccggagtcattccaccagccggtacatacaactactgggccgatggatacaccctatttgtccttgagatggccctgatgggtttcgcggaacacaggaggctccaggactggtacaacccaggttcaatgggaaagcagtacttcttgggactcgaaaagggcttctcagggtctggtgaccctgcctaccctggtggaccgttcttcaacccactaggattcgggaaagatgagaaatccatgaaggagttaaagcttaaggagattaagaatggaagattggctatgttggctatcttgggctactttattcagggactagttactggtgtcggtccataccagaacctgttggatcacttggctgatccagtcaacaacaatgtgttaacaagcctcaaattccactagacttgtaacaaattaaatcttgttatatcctatcctaaacttgtgcagagtattgttaaacatttgagctgtaatctaatcaggagcttcttcata

SEQ ID NO: 1691 - DNA, 1004 bp, Flaveria ramosissima
aacctgcaaatcttttcaagaaaatggcaacacaagcattggcttcatcatcatcactcacctcctcagttgagtctgcaaggcagatccttggagctagaccatttcagacaccttcaagaaagatctctttcttgtcaaagctgcttccacccctcctcgttaagcaaggagcagacagacagctgtggtttgcatccaaacagtctctttcttacctggatggaagtctcccaggtgactttggatttgacccacttggtctttcagacccagaaggcaccggtgggttcatcgagcccaagtggctagcttacggagaggtcatcaacggacggttcgccatgttgggtgcagccggagccattgcacccgagattcttggcaagcttgggctcatcccagccgaaaccgccctcccttggttcaagaccggtgtcatccccccggccggcacatacgactactgggccgacccgttcaccctatttgttctagaaatggcacttatgggctttgcagaacacagaagactacaagattggtacaacccgggttcaatgggaaaacaatactttttgggcctagagaaaggctttgccgggtcgggcgaccccgcatacccaggcggcccgttcttcaacccgctagggttcggaaaagatgagaagtcaatgaaggaattgaagctaaaagagatcaagaatggtagattggctatgttggccattttgggctacttcattcagggtttggtgactggtgttgggccttaccagaaccttttggaccatttggctgatccagtcaacaacaatgtgttgaccagccttaagtttcactagagtcacaatcttccttcctatatgtaatatcatgtgcagaatttcttgaaatattattattaatttgtaacgggtttaatgatatgttaaggataccaaaaccttgttgtaatatgtagttactaaacatgtttgtttgtgcatgcatgtacttgagct

SEQ ID NO: 1692 - DNA, 1033 bp, Flaveria ramosissima
cgaccaacaacctgcaataatcttttctaagaaaataggcaacacaagcattggtttcatcatcatcactcacctcctcagttgagtctgcaaggcagatcggtgaggctagccacttcacacaccaacaagaaagatctcttttcttgtcaaagctgcttccacccctcctgttaagcaaggagctgacagacaactgtggtttgcatccaaacagtctctttcttaccttgatggaagtctcccaggtgactttggatttgacccacttggtctttcagacccagaagggaccggtgggttcatcgaacccaagtggctagcttacggagaggttatcaacggacggttcgccatgttgggagcagctggagccattgcacccgacgatcttggcaagctcgggctcatcccagccgaaaccgccctcccatggttcaagacaggtgtcatccccccacgccggaacatacgactactcggccgacccattcaccctatttgtattagaaatggcacttatgggctttgccgaacacagaagactccaagattggtacaacccgggttcaatgggaaaacaatactttttgggcctagagaaagggttctcggggtcgggtgaccccgcctacccgggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgacccagtcaacaacaatgtgttgaccagccttaagtttcactagagtcactatcttccttcctatatgtaatatcatgtgcagaatttcttgaaatattattattaatttgtgacgggtttaatgatatgttaaggataccaaaccttagttgtaatatgtagttactaaactatgtttgtttgtgtcatgcatgtacttaagcaaaggagttatagtac

SEQ ID NO: 1693 - DNA, 863 bp, Flaveria ramosissima
caacctgcaatatctttccaagaaaatggcaacacaagcattggcttcatcatcatcactcacatcctcagttgagtctgcaaggcagatacgggtagtaggcatcattcacacaacaagaagatctctttcttgtcaaagctgcttccacccctcctgttaagcaaggagctgacagacaactgtggtttgcatccaaacagtctctttcttaccttgatggaagtctcccaggtgactttggatttggacccacttggtctttcagacccagaaggaaccggtgggttcatcgaacccaagtggctagcttacggagaggttatcaacggacggttcgccatgttgggagcagctggagccattgcacccgagattcttggcaagctcgggctcatcccagccgaaaccgccctcccatggttcaagacaggtgtcatccccccagccggaacatacgactactgggccgacccattcaccctatttgtattagaaatggcacttatgggctttgccgaacacagaagactccaagattggtacaacccgggttcaatgggaaaacaatactttttgggcctagagaaagggttctcggggtcgggtgaccccgcctacccgggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgacccagtcaacaacaatgtgttgaccagccttaagtttcactagagtcactatcttccttccta

SEQ ID NO: 1694 - DNA, 1104 bp, Vaccinium corymbosum
aagaaagctagtgcccttatttgctgctattttgcttattgtttggtgaagaataagagacattctcctccagagtttggcaatcaaaaacattaacacaacaaaaatggcaactcaagcactgctttcatcttctattgcctcctcagtagaggctactagaaagattgtaggaggaaggccaacccaatctcctaggagggtgtcctttgttgttagggcagcttctactccccctgttaagcaaggagatagacccctttggtttgcttccaagcagagcctttcttatttggatggcagcttgcccggtgactatggattcgacccgcttgggctgtcagacccagaaggcacaggaggcttcatagagcccaaatggctagcctatggagaggtcatcaacggccgatacgctatgttgggggtggtcggttgtcttgcaccggaaatccttggaaaactcggcctcatcccgccggagaccgccctcccctggttccaaaccgggtgattccaccggcagggacatacaactactgggcagacccttacaccctatttgtgctggaactagcactgatgggctttgcagagcacaggagattccaagactggtacaaccctgggtccatggggaaacaatactttttggggttggagaagttcttgggcgggtcgggtgacccggcttaccctggtggacccctcttcaacccgcttgggtttgggaaggatgagaagtctatgaaggaattgaagttgaaagaggtcaagaatgggaggttggccatgttggctattttggggttctttatccaagggctggtgaccggagttggacctttccagaatttactggatcatttggcggatcctgtgaacaacaatgtcttgactagcctcaagtttcattgagagatcccatgctctctctcactccctccctcttttgtgaaaccatgtgcatactttatttggtgtatctatgtgtaacctgtaaaacaaatgaagtatcctgggtttgagaaccttctagtttttgacattcctatttggcgtgagcttcaacagtggttcacatgattatctaatctcaattca

SEQ ID NO: 1695 - DNA, 1160 bp, Ricinus communis
ccagatcctaacctaatctgaagcttcataccagccaagattttcaagctcgcaactagtggtttagctgagcccttatttgctgccattttttgtttattgtaggcactgctactacttactatcttttagttcagtagcacaacagattagaaagggaagacaaaaagaaaaagaaaaagaaacatattgagaaatggcaacacaagcacttgtgtcatcttctcttacttcttcagttgaaactgctagacaaattctaggtgctagatcttcctttgggtcttcaaggaagagcagctcctttgttgttagggcatcttctactcctcctgtcaagcaaggagcagacagacaattatggtttgcttcaaagcaaagtcttacttacttggatggcagccttccaggtgactttggatttgacccacttggactttcagacccagaaggtacaggagggttcattgagcccaaatggttagcctatggtgaaatcatcaatggaagatttgccatgttaggagcagcaggtgctattgcaccagaaattcttggaaaggcaggcctaattccaccagaaacagcactcccttggtttcaaactggagtgatcccaccagcagggacatacgactactgggcagacccatatacactgtttgtatttgagatggcactcatgggttttgcagagcacagaagattccaagactgggccaaaccaggatcaatgggtaagcaatatttcttgggattggagaagttcttgggtggttctggtgacccagcataccctggaggaccattgtttaacccacttgggttcggaaaagacgagaaatcaatgaaagaattgaagttgaaggaggtgaagaatggaagattggctatgttggcaatcttaggttattttgtacaaggtcttgtgactggagttggaccataccaaaacctgctggatcacttggctgatcctgttaacaacaatgtcttgactagcctcaagttccattagagatcatatcttctctccttcctttttatctctttgcttctctcctacccatttgtaaccactgtgtgaaaatgccctttcctattataattttatgtaagaaaagcacatttcatgatcaagatagacctgttaatgttac

SEQ ID NO: 1696 - DNA, 1073 bp, Carica papaya
acgatcagcttcataagttggcgcttattttcctgcctctgttttctgagttcaacacacaaaacttcactcgagaaaataacaaatggcaacacaagcacttgtatcttcttctcttagctcctccgtggagaccgccagacagattctaggagcaagaccagcacattctccaactggttgctcaagaaggggatccttcgttgtcagggcagcttctactcctcctgttaagcaaggagcagacagacccttgtggtttgcatccaaacaaagcctttcttacttggatggcagccttcccggtgactatggattcgacccactaggtctgtcagatcctgaaggccccggagggttcatcgagccaaaatggttagcttatggcgaggtcatcaatggccggtatgctatgttgggtgcagtgggtgctattgctcctgaaattctgggcaaggctggcctcattccaccagagacagctcttccctggttcaaaactggtgtgatcccaccagctggaacatacaactactgggcagacccttacacgctctttgtctttgagatggcactcatgggttttgcggagcacaggagattccaagactgggctaagcctggctccatggggaaacagtacttcctgggtttcgagaagtttttggggggatcaggagaaccggcttacccaggaggaccactctttaaccctcttgggttcgggaaagatgagaagtcgctcaaggatttgaagctcaaggaggtgaagaatgggagactggcaatgttggctatcttgggatactttgtacagggtcttgtaacaggagttggaccataccaaaaccttcttgatcacttagctgatcccttcaacaacaatgtcttgacaagcctcaagttccattaagatagctttctatttgcttttcggaactgttccatcaccagcccctgctttctcactctctctttctccctctcacactgtctagtctttgttcatgtcctgttgaaatatcatgtgaagaaatcattgtaatttgtaagaaattgacatggtaatgcct

SEQ ID NO: 1697 - DNA, 1339 bp, Arachis hypogaea
tgatagagcgagcagtgggtatcaacgcagatacgggggggactttgtagatatcattctttcttaatcctcctcctcaccagaatctaacattttagaacaaaactctctttggccgcagcaaagaagtatcatggctgcacaagctctggtatcatcttcatctcttaccttctcaggcgaggctgccaggcagagctttggatcaagacccaatggattctccaaaagggcctccttcttagtcagggcgtcttccactccacctgtcaagcaaggagcagacagacccttgtggtttgcatcaaaacagtctctctcttacttggatggcagcctccccggtgactatggatttgatccacttggactttcagaccctgaaggaacaggagggttcattgagccaagatggctggcatacggagagatcatcaacggtcgttacgcaatgttgggtgcagtcggtgccatagcacccgagattcttggcaaggctggtctgataccagaggagacagcactgccatggttcaagaccggtgtgatcccacctgcaggaacatacaactactgggcagacccttatacactctttgtcttggagatggcactcatgggatttgcagagcacagaaggttccaagattgggccaaacctggctccatgggaaagcaatacttcttaggactggagaagggtcttggaggttccggtgacccagcttaccccggaggacctttcttcaacccccttggttttggcaaggatgagaaatccttgaaggatttgaagctcaaggaagtgaagaatgggaggttggccatgttggcaatcttgggttactttgttcaaggtcttgtgacaggagttggcccttaccaaaacctccttgatcatctggctgatcccgtgcacaacaacgtattgaccagtcttaagttccactaaaatgtattgtatattttacaagaaatcttttgttactcttggtggttgttgttgtccagttgttgccattagcaaaaatcactatcaccaataaccttttgtatctcttttcactctttcgtgactgtggcctcatttggacattccatggtgtagccttgtaagaaatgacatgttaaacaactacaaacattattcatcatcgtgtgggtcgcagctgctactttctgttgctcagacctttagctgttcctaatccttaattatgacacaagcataaactctcatgcaaaatgttttaaagctgtgatttgcgtatagtttaaagagtcaaatcaagctagagtattattgttaaactaacatcttatctattcatatcatcag

SEQ ID NO: 1698 - DNA, 925 bp, Scabiosa columbaria
ctgaatctgcattaagatttctctaaatttgtatagaatggcaacacaagctcttgtatcttcttcatctattgcttcttcggccgaagctacgagacagctgttcgcgagaggaacccgacccctacattcgtcgacaaaaagagtttcgtttgttgttagggctgcttctactccccctgtcaagcaaggtgatagacccctctggtttgcatcaaaacagagcctttcttacttggatggcagcctccctggtgactatggattcgacccacttggcctgtctgacccagaaggaacaggaggatttattgagccaaaatggttagcttatggagaggtaatcaatggacggtttgctatgcttggagcatccggagccatcgcaccagagattctaggaaagctcgggctcattccaccagagaccgcacttccatggttcaaaaccggtgtgattcctccagccggtacctacaactattgggccgacggttacactctatttgtgttggaaatggcactgatgggattcgcagaacacaggagactacaagactggtacaacccagggtccatgggcaaacagtatttcttgggtcttgagaaaggcttttccgggtcaggcgacccagcctacccaggcgggcctttctttaaccctctagggttcgggaaagatgagaagtccatgaaagacttgaagctcaaagagatcaagaatggaaggttggctatgttggctattttgggttacttcattcaaggcttggtaaccggtgttggacctttccagaaccttctagatcatttggctgacccagtcaacaacaatctcttgaccagcttaaagttccactagtttggatttcctctatcttctctcattacatgtaatctatgacaatattaaacttgtttgaag

SEQ ID NO: 1699 - DNA, 1098 bp, Solanum phureja
gccccacaaaatactttgtccccttatttgccaccttttgtatttaatttattcttgtggagctaagtgttcatattattcttcttctcaaaaaaacaaaaacaaaaaaaaagagaagaaaaattatggcaactcaagcattgatctcttcatcatcaattagcacttcagctgaggctgcaagacaaattcttggatcaagaatttcacaatctgttactagaaaagcttcttttgttgtaagggcggcttccactccaccagtcaagcaaggagcaaataggcaactctggtttgcatccaagcaaagcctttcatacttagatggcagtcttcccggtgactttggctttgatcccttgggactctcggaccctgaaggcacaggaggtttcatcgagccgaaatggctagcatatggcgaggtcatcaatggtcggttcgccatgttaggagcagtagggtcaatagcaccagagattcttggtaaagctggtctcatcccacaagaaacagcacttgcatggttccaaactggtgttatcccaccagcaggaacatacaactactgggctgacaactacacattgtttgtccttgaaatggcactcatgggctttgctgagcacaggagattccaagattgggccaaacctggttcaatggggaaacaatacttcttaggccttgaaaagggtttgggtgggtcaggtgacccagcatacccaggtggccccttgtttaacccacttggatttgggaaagatgaaaagtccatgaaggaattgaagcttaaggagattaagaatggaagacttgctatgttggctattttgggatactttattcaagcattggttactggtgttggaccttaccaaaaccttcttgatcatttggctgatccagtaaacaacaatgtcttgactagtctcaagttccactagagcaaagcaatccactctttcttccaaatctcccccctctccttctcttacgtgtaatgtaacattatgtgcagataatatttttcatctcatctgtaatgctaaaacaaggacatgtcattttaaaaggcctgatatatatttttagagg

SEQ ID NO: 1700 - DNA, 1018 bp, Papaver somniferum
ctcttcaatggaagctgctagacaagtattcagaggaagaccacttcaatatgcaactgttaacgttggctcttcaaggaagggttcatttgttgttagagctgctgccactccacctgttaagcatggagcaaacagacagctttggtttgcatccaaacagagtctttcttacttagacggcagcctcccaggtgatttcgggtttgacccacttggcctttcagatccagaaggaacaggaggatttattgaaccaaaatggctagcatatggtgaaattatcaacggacgttttgccatgttaggagcagcaggagcaatcgcacccgaagtcttcggcaaactcggtcttatcccagctgaaaccgcactcccatggttccaaactggagtgattccacccgctggaacttacagttactgggcagaccccttcacactatttgtactagaaatggctcttatgggttttgctgagcacagaagattgcaagactggtacaaccctggatccatgggcaaacaatatttcttaggtttggaaaagggtttgggcggatcaggtaaccctgcttacccaggtggacctttctttaacccactaggatttggaaaagatgagaagtcaatgaaggaattgaagttgaaggaagtgaagaatggaagattagccatgttggctattttaggttatttcattcaaggtttagtcacaggagttggacctttccagaacttgttggaccatttggctgatccagtcaacaacaatgtcttgaccagtctcaagttccactaaatttctatgcccaggttcttgtactctgggacttcattctcttctctatttccttttatccttttcccctttctctctattgtgaaagtttatggaaactcttgtaatttgtaattaagattagataaactggtttatattatggtaaatttattttaagtaataccatttgaaataattgcaagtcttaccgaatgatatttgttaaaaggaaaa

SEQ ID NO: 1701 - DNA, 970 bp, Triticum aestivum
gaaaaattatggcaactcaagcattgatctcttcatcatcaattagcacttcagctgaagctgcaagacaaattattggatcaagaatttcacaatctgttactagaaaagcttcttttgttgtaagggctacttccactccaccagtcaagcaaggagcaaataggcaactctggtttgcatccaaacaaagcctttcatacttggatggaagtcttcccggtgactttggttttgatcccttgggactctcggaccctgaaggcacaggaggtttcatcgagccgaaatggctagcatatggcgaggtcatcaatggtcggttcgccatgttaggagctgcaggggcaatagcaccagagattcttggaaaagctggtctcatcccacaagaaacagcacttgcatggttccaaactggtgttatcccaccagcaggaacatacaactactgggctgacaattacacattgtttgttcttgaaatggcactcatgggctttgctgagcacaggagattccaagattgggccaaacctggttcaatggggaaacaatacttcttgggtcttgaaaagggtttgggtgggtcaggtgatccagcatacccaggtggcccattgtttaacccacttggatttggaaaagatgaaaagtctatgaaggaattgaagcttaaggagattaagaacggaagacttgctatgttggctgttttgggatactttatccaagcattggttactggtgttggaccttaccaaaaccttcttgatcatttggctgatccagtaaacaacaatgtcttgactagtctcaagtttcactaaactaagtagagcaaaagcaatccactctttcttctaaatctccctccctccccttctcttatgtgtaatgtaacattatgtgcagataatatttttcatctcatctgtaatgctaaaacaaggacatgtcatttttaaaa

SEQ ID NO: 1702 - DNA, 1149 bp, Malus domestica
taaaaaatattgagtggcagaagaaaagaagagagagagagagagagagagagaggtagagagagaaaatggcagctcaagctctggtttcatcatcttccctaacggcctcaaaggaggttgccaggcagatatttggaggagcaaaggccgtccaatctccatttgggtcgagaaaatctgcttcctttgtcgtaagggcggcctctactcctcctgttaagcaaggagcggacagacagttgtggtttgcttccaagcagagccttacttacttggatggcagcctacccggcgactatggattcgatccattgggcctctcagacccagaaggcacaggtgggttcatcgagcccagatggctagcctacggtgaagtcatcaacggacgttacgccatgcttggtgcagtgggtgcaattgccccagaaatcttgggcaagctcggcctaatcccgcccgagactgccctgccctggtttcaaacaggggtcatcccgccagccgggacctacaactactgggccgacccttacacgctctttgtctttgaacttgccctaatggggttcgccgagcaccggaggttccaggactggtacaaccccgggtccatgggcaagcaatacttcttggggtttgagaagtacttgggtgggtccgggaacccggcttaccctggtgggcccttgttcaacccgctagggtttgggaaagatgaaaagtcgttgaacgagttaaagctcaaggaagtgaagaatgggaggcttgccatgctggcaatattgggttattttattcagggtcttgtgactggtgtggggccttaccagaaccttctggatcatttggctgacccagttcacaacaacatcttgaccagcctcaagttccattaagtaacgtttgtacaattaatataatttggcctttgtttgttgtttgttatggttgtctgtgactctgtgtaagaaatgacatgttaaaagagctatattagaaccctaattaatgttgctagacttcatagttgacgtatggtgcatacatgcatttgttcttagttaagttcgttgtttcacgtgttatgatatagataatcgatgaattatattttacaaagagaaatgttaaggaaatttgttc

SEQ ID NO: 1703 - DNA, 832 bp, Flaveria ramosissima
agttgagtctgcaaggcagatccttgagctagaccattcagacaccttcaagaaagatctctttcttgtcaaagctgcttccacccctcctgttaagcaaggagcagacagacagctgtggtttgcatccaaacagtctctttcttacctggatggaagtctcccaggtgactttggatttgacccacttggtctttcagacccagaaggcaccggtgggttcatcgagcccaagtggctagcttacggagaggtcatcaacggacggttcgccatgttgggtgcagccggagccattgcacccgagattcttggcaagcttgggctcatcccagccgaaaccgccctcccttggttcaagaccggtgtcatccccccggccggcacatacgactactgggccgacccgttcaccctatttgttctagaaatggcacttatgggctttgcagaacacagaagactacaagattggtacaacccgggttcaatgggaaaacaatactttttgggcctagagaaaggctttgccgggtcgggcgaccccgcatacccaggcggcccgttcttcaacccgctagggttcggaaaagatgagaagtcaatgaaggaattgaagctaaaagagatcaagaatggtagattggctatgttggccattttgggctacttcattcagggtttggtgactggtgttgggccttaccagaaccttttggaccatttggctgatccagtcaacaacaatgtgttgaccagccttaagtttcactagagtcacaatcttccttcctatatgtaatatcatgtgcagaatttcttgaaatattat

SEQ ID NO: 1704 - DNA, 1029 bp, Leymus cinereus x Leymus triticoides
  misc_feature (815)..(815): n is a, c, g, or t
tgcctcatctctcggagcaggaggaggagcttgcaggaacaatggcggctcagggtcttctctctgggaggcagctgctggggaggcctctgcagtcttccttctccaggtcgtcttcctcgcggaagtcccccttcatcgtcagggcggcgtccactccccctgccaagcaaaatgacaacaggcagctgtggttcgcgtccaagcagtccctcacctacctcgacggcacgctgcccggtgactttggcttcgaccccttggggctgtctgacccggagggcaccggcgggttcatcgagcccaggtggctggcctacggcgagatcttcaacggccggacggcgatgatgggggtggtgggcatgatcgccccggaggccctgggcaaggtgggtctggtgcccccggagacggcgatcccatggttccaggcgggcgcgatcccgccagcaggcacctaccagtactgggctgacccctacacgctctttgtgttcgagatggcgctcatcggcttcgcggagcaccggcggctccaggactggtacaacccgggctccatggggaagcagtacttcctgggcctcgagaagtacctcggcggctccggcgaccccgcctaccccggcggccccatcttcaacccgctcgggttcggcaccaagagcgagaaggagatgaaggagctcaagctcaaggagatcaagaacggccgcctcgccatgctcgccttcctcgggatgtccctgcaggccatcttcaccggcgtcggccccttccagaacctcctggaccacctctctgaccccgtnaacaacaacatcctcaccagcctcaagttccactaggcgaaatcgatccgatccgagcatcgtcgtcctgtgcatggtacccgtcgtcgatggaaacgtgagcgtgcgagaggtatatatgcgagggtgggtgtaaaatgtaaatttgtacgcgtgctgcgtgcatgcttgtaatatttatatcgtgctatgaaaattagtgcattacatctct

SEQ ID NO: 1705 - DNA, 1038 bp, Senecio madagascariensis
agtggccattacggccgggagacaaacaactcacaaatcttctctcaagagaaaatggcaacacaagccttggtctcatcttcatcacttacctcctcagtggaatctgctagacagatccttggagcaagaccacttatcacatcttcaagaaaagtttcatttgttgtcaaagctgcttccacccctcctgttaagcaaggaaacagacaactatggtttgcatccaagcaatctctttcttaccttgatggaagtctcccaggtgactttggattcgacccacttggtctttctgacccagaagggaccggtggattcattgagcccaaatggctagcttacggagaagttatcaatggacgtttcgccatgttaggtgcagccggagccattgcacccgaggtattcggcaagcttggactcattccagccgaaaccgccctcccatggtttaaaactggagtcattcctccagctggaacatacaactactgggctgacccattcacactatttgtgctagaaatggcactaatgggattcgcggaacacagaagactccaagattggtacaacccagggtcaatgggaaaacaatactttttgggtttggaaaaggggttctccggttcaggtgatccagcataccccggaggtccgtttttcaacccattgggatttgggaaagatgagaagtcaatgaaggaattgaagctaaaagagatcaagaacggtagattggctatgttggctgttttgggttacttcattcagggtttggttactggagttggacctttcgagaaccttttggcccatttggccgatccggttaacaacaatgtgttgaccagccttaagttccactagagagtgtatgctcgttcttatatgtaatatcgatcatgtgcagatgtgtttctttgaaatactattactactttgtaacgatatgttaaggtataacgaaaaccttgttgttcctaaggcctagttacttgtgtgtagttagtacctgcccgggcggccgctcga

SEQ ID NO: 1706 - DNA, 1117 bp, Solanum lycopersicum
gccccacaaaatactttgtccccttatttgccaccttttgtatttaatttattcttgtggagctaagtgtttatattattcttcttctcaaaaaaacaaaaacaaacaaaaaagagaagaaaaattatggcaactcaagcattgatctcttcatcatcaattagcacttcagctgaagctgcaagacaaattattggatcaagaatttcacaatctgttactagaaaagcttcttttgttgtaagggctacttccactccaccagtcaagcaaggagcaaataggcaactctggtttgcatccaaacaaagcctttcatacttggatggaagtcttcccggtgactttggttttgatcccttgggactctcggaccctgaaggcacaggaggtttcatcgagccgaaatggctagcatatggcgaggtcatcaatggtcggtttgccatgttaggagctgcaggggcaatagcaccagagattcttggaaaagctggtctcatcccacaagaaacagcacttgcatggttccaaactggtgttatcccaccagcaggaacatacaactactgggctgacaattacacattgtttgttcttgaaatggcactcatgggctttgctgagcacaggagattccaagattgggccaaacctggttcaatggggaaacaatacttcttgggtcttgaaaagggtttgggtgggtcaggtgatccagcatacccaggtggcccattgtttaacccacttggatttggaaaagatgaaaagtctatgaaggaattgaagcttaaggagattaagaatggaagacttgctatgttggctgttttgggatactttattcaagcattggttactggtgttggaccttaccaaaaccttcttgatcatttggctgatccagtaaacaacaatgtcttgactagtctcaagtttcactaaactaagtagagcaaaagcaatccactctttcttctaaatctccccccctccccttctcttatgtgtaatgtaacattatgtgcagataatatttttcatgtcatctgtaatgctaaaacaaggacatgtcatttttaaaaggcctgatatatatttttagaggaaatca

SEQ ID NO: 1707 - DNA, 1030 bp, Flaveria ramosissima
gtactaacgcgagtagtacgtatggggtggcaccaacaacctagcaatatcttttctaagaaaataggccacacaagcattggcttcatcatcatcactcacctcctcagttgagtctgcaaggcagatccttggagctagaccacttcacacaccaacaagaaagatctcttttcttgtcaaagctgcttccacccctcctgttaagcaaggagcagacagacaactgtggtttgcatccaaacagtctctttcttaccttgatggaagtctcccaggtgactttggatttgacccacttggtctttcagacccagaagggaccggtgggttcatcgaacccaagtggctagcttacggagaggttatcaacggacggttcgccatgttgggagcagctggagccattgcacccgagattcttggcaagctcgggctcatcccagccgaaaccgccctcccatggttcaagacaggtgtcatccccccagccggaacatacgactactgggccgacccattcaccctatttgtattagaaatggcacttatgggctttgccgaacacagaagactccaagattggtacaacccgggttcaatgggaaaacaatactttttgggcctagagaaagggttctcggggtcgggtgaccccgcctacccgggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgacccagtcaacaacaatgtgttgaccagccttaagtttcactagagtcactatcttccttcctatatgtaatatcatgtgcagaatttcttgaaatattattattaatttgtgacgggtttaatgatatgttaaggataccaaaaccttgttgtaatatgtagttactaaacatgtttgtttgtgcat

SEQ ID NO: 1708 - DNA, 917 bp, Flaveria ramosissima
aacaacctgcaatatcttttctaagaaaataggctacacaagcattggcttcatcatcatcactcacctcctcagttgagtctgcaaggcagatccttggagctagaccacttcacacaccaacaagaaagatctcttttcttgtcaaagctgcttccacccctcctgttaagcaaggagctgacagacaactgtggtttgcatccaagcagtctctttcttaccttgatggaagtctcccaggtgactttggatttgacccacttggtctttcagacccagaagggaccggtgggttcatcgaacccaagtggctagcttacggagaggttatcaacggccggttcgccatgttgggtgcagccggagccattgcacccgagattcttggcaagctcgggctcatcccagccgaaaccgccctcccatggttcaagacaggtgtcatccccccagccggaacatacgactactgggccgacccattcaccctatttgtattagaaatggcacttatgggctttgccgaacacagaagactccaagattggtacaacccgggttcaatgggaaaacaatactttttgggcctagagaaagggttctccgggtcgggtgaccccgcctacccgggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgatccagtcaacaacaatgtgttgaccagccttaagtttcactagagtcactatcttccttcctatatgtaatatcatgtgcagaatcttgaaatattaatattaatttgt

SEQ ID NO: 1709 - DNA, 1039 bp, Solanum melongena
attcttctccataccatccaaaaaaaaagagaagaaaaactatggcaactcaagcattgatctcttcatcatcaattagcacttcagctgaggctgcaagacaaattcttggaggaagaaattcacaaattgttgctagaaaaggctcttttgttgtaagggctacttccactccgccagccaagcaaggagcaaataggcaactctggtttgcatccaagcaaagcctttcatacttggatggcagtcttcctggtgactacggttttgatcccttgggactctcagaccctgagggtacaggaggtttcattgagccaaaatggctagcatatggcgaggtcatcaacgggcggttcgccatgttaggagcagcaggagctatagcaccagagattcttggcaaagctgggctcatcccacaagaaacagcacttgcatggttccaaactggcgttatcccaccagcaggaacatacaactattgggctgacaattacacattgtttgtccttgagatggcactcatgggctttgctgagcacagaagattccaagattgggccaagcctggttcaatggggaaacaatacttcttgggccttgaaaaggggttgggtggatctggtgatccagcataccctggtggcccattgtttaacccacttggatttgggaaagatgagaagtccatgaaggaattgaaactcaaggaaattaagaatggaaggcttgctatgttggctattttgggatactttattcaagcattggttactggcgttggaccttaccaaaaccttcttgatcatttggctgatccagtaaacaacaatatcttgaccagtctcaagttccactaaactaagcagcaagaatcatccactctttcttccaaatctaccctccccttctcttatgtgtaatgtaacattatgtgcagattaatttttcatgtcatctgtaatgctaaaacaagggacatgtcattctaaaaggcctgatatatatttttagaggaaatcaatcatctagtatt

SEQ ID NO: 1710 - DNA, 1448 bp, Vitis vinifera
gcaaatgggacacggtcagattttggggtgtggaggattgagctaaatgacatatgtgtgtctccccttgatagaatccgagatcttttgaggcaagcagggaaggagtagtggctgtaaggcatccatgtggcaatggagcagtgtgagaggttccttatccagctactcatgccaggtgcgcactccttgttggacaatgggatcctaatctaatctccaacactcggaacaccctctcatcatccaccaccacaagtactagtggccactgacttctcttaagccctgtgttttgtgttctatccagggctatttggtcttattcttcttcttcttcttcatcgtccaaactcaaaactcaatcagaaacaacaagaaatggctgctcaggccttggtttcatcttctcttacttcctcagtggagactgccagacagatacttgggtcaaggcctctgcaatctccatcaaggaagtcttcttcctttgtggtcagggcagcttctactccaccagtcaagcaaggagctgacaggcccctctggtttgcatccaagcagagccttacttacttggatggcagtcttccaggtgactatgggttcgatccactgggactttcagaccctgaaggcacaggagggttcatcgagccaagatggttagcctacggggaggtcatcaacgggcggtatgccatgctgggtgctgttggtgcgattgcgcctgagatactggggaagctgggcctcatcccaccggagaccgccctgccttggttcaaaaccggggtattccccccagcggggacatacaactactgggcagacccttacacactgtttgtattcgagatggcactgatgggatttgcagagcacaggagattccaagactgggccaacccagggtcaatggggaagcagtacttcctcgggcttgaaaaatacttgggagggtctggcgacccagcctacccaggaggcccactgttcaaccctctcgggtttggtaaagatgagaaatccctcaaggatctgaagctcaaagaggttaagaatgggagattggctatgttggccatattgggctactttgcacaagggcctgtgacaggagtcgggcccctccaaaacctgctggaccatttggcagaccctgtcaacaacaatatcataaccagcctcaagttccacaactaggagactcatcctcttgttgatttgcttcacgattcactctctctatgtcctctcagctgtcacctctctctctccctcatatttgtaatattattatgtgaagacttggccttaaattttaatcaatcaatcagtaacaaaatcactgtttaaagactcaaaacatacattcatgctactgcatattaacactcacttaccctctgcgctttaatcatatcaaaaaactgttggtcaagggt

SEQ ID NO: 1711 - DNA, 1100 bp, Humulus lupulus
aaattgactgaattggccacaggagacagagagaaagaaaaataacaagaaaaatggcaactcaagctttggtgtcttcatcatctctaacatcttccgttgaggccacaagacaaatcttgggaagccgaccaacccaaccatccacaaggagatcagcttcttttgtcgtcagggcggctgctactcctcctgtcaagcaaggagcagacagacccttgtggtttgcttccaaacagagcctttcttacttggatggcagcttaccaggtgactatgggttcgatccattgggcctatcagacccagaaggcacaggtgggttcatcgagcccagatggctagcttacggcgaggtcatcaacgggcgtttcgccatgttgggagctgcaggagccattgcaccggagatcttcggaaagcttggtctcatcccagaagaaactgctctcccttggttcaagaccggtgtcatcccaccagctggaacatacaactattgggccgacccatacacactcttcgtattggagatggcactaatgggctttgctgagcacagaagattccaggattggtacaaccctgggtccatgagcaaacaatacttcttgggcctggagaagtaccttggtgggtccgacaacccagcttaccctggtgggcctttgtttaacccacttgggtttgggaaggatgagaaatccatgaaggatttgaagctcaaggagattaagaatggaaggttggctatgttggcaatcttgggctatttcattcaaggccttgttacaggtgttgggccttaccaaaacttgctggatcatctttctgacccagtcaacaacaatgtcttgactagcctcaaattccattaaagatgggggaggagttgtataatattgagtagtaccatataaccttttgttgctatggacaacgaaaacccttatggggatttgtttcctttcttcctctcattattacattatgtaagaatcttttattgttatcctttttttatctcttctgtaactttgtaagaaataacttgtttaagaaaaaaaaaacaatcagtatagacatgctaatgcgctctt

SEQ ID NO: 1712 - DNA, 1048 bp, Ipomoea nil
ttcttattattattgcttttacaaggtaatccaaactcactatctcacactatcaagaaaaatggcagcacaggctttgatctcctcttcatccattgcctcttcagctgaggctgcaaggcaggttcttggagcaaggcctgtccaatcttcttctaggaaggtttcttttgttgttagggctgcctctactccccctgttaagcaaggaacagataggcagctttggtttgcatccaagcagagcctcacctacttggatgggagccttcctggtgactatggatttgatccactgggactgtcagaccctgaagggcctggagggttcatagagccaagatggctagcatatggggaggtgatcaacgggcgttacgcgatgatgggggcagtaggagccatagccccagagattcttgggcaggctggtctgatcccacccgaaacagccctcccatggttcaagactggggtgatcccccctgcaggaacctacaactactgggcagatccttacactctattcgtgttcgagatggctctgatggggtttgcagagcacaggagattccaggactgggcaaaccctggatcaatgggaaagcagtacttcctggggctggagaaggggctaggagggtcaggtgacccagcataccctggtggccctatcttcaaccccttggggtttggaaaagatgagaaatcattgaaggatttgaagctgaaagaagtgaagaatggaaggctggctatgttggccattctgggatacttcatccaagctttggtcactggagttggtccctaccaaaacctgcttgatcatttggctgatcctgtaaacaacaacatcttgaccaaccttaaattccactaaacctctgatatatattaatatatgtatcacctaccatgtgcacatactgctatctgcatcccatctgtaatcagtaatctgcaagaaaaaggatatgcatgtaactttgagcgccttattcagtcttagttgaagctttctttccaaaaaaaaaaaaaaaaaaaa

SEQ ID NO: 1713 - DNA, 988 bp, Olea europaea
tacgcacgacgaaaatggcaactcaagcactgctctcttcatcatccatcagctcgtctgctgaggtcgccagacagattcttggaggaaggccagtccaatctgcgaggaaggtttccttcgtcgtgaaggctgcttctactcctcccgtcaagcaaggagcagacaggcctctctggtttgcttccaagcagagtctttcctacctggatggcagcctccctggtgactatggattcgatccattgggactctcggatcctgaaggtactggaggattcattgagcccaaatggctagcctatggagaaattttcaatgggcgttgcgcgatggtgggtgcaataggagcaattgcacccgaaattcttggaaaggctggcctaattccagcagaaacagccctcccatggttcaagaccggagttattcctccagctggaacatacaactactgggccgattcctataccctattcgttttcgaattggcacttgtgggattcgcagagcaccggagattccaggactgggccaatccagggtccatgggcaagcaatactttttgggtttggagaaatggttgggagggtcaggtgaccctgcatacccaggtggcccccttttcaacccgttggggttcggtaaagacgagaaatccatgaaggagttgaaggtgaaggaagtgaagaatggaagattggctatgttggcaatcctgggttactttgtacaagctttggtgactggggttggtccctaccaaaacctgctggaccatttggctgatcctgtgaacaacaatgtcttaaccagcctcaaattccactaaattgtcgtcgtatgttgtctctctctcagattgtaacatatgtgtgcagatagttcagcatctcccatgtatgtaatctacaaacacgagatatgttcatgacttggaaactttgttagtactttaatgatgcttcgtattgtacgtgctttaag

SEQ ID NO: 1714 - DNA, 1093 bp, Solanum tuberosum
ggatcaccttttgtatttaatttattcttgtggagctaagtgttcatattattcttcttctcaaaaaaacaaaaacaaaaaaagaggagaaaaattatggcaactcaagcattgatctcttcatcatcaattagcacttcagctgaggctgcaagacaaattcttggatcaagaatttcacaatctgttactagaaaagcttcttttgttgtaagggctgcttccactccaccagtcaagcaaggagcaaataggcaactctggtttgcatccaagcaaagcctttcatacttagatggaagtcttcccggtgactttggctttgatcccttgggactctcggaccctgaaggcacaggaggtttcatcgagccgaaatggctagcatatggcgaggtcatcaatggtcggttcgccatgttaggagcagtagggtcaatagcaccagagattcttggtaaagctggtctcatcccacaagaaacagcacttgcatggttccaaactggtgttatcccaccagcaggaacatacaactactgggctgacaactacacattgtttgtccttgaaatggcactcatgggctttgctgagcacaggagattccaagattgggccaaacccggttcaatggggaaacaatacttcttaggcctagaaaagggtttgggtgggtcaggtgatccagcatacccaggtggcccattgtttaacccacttggatttgggaaagatgataagtccatgaaggaattgaagcttaaggagattaagaatggaagacttgctatgttggctattttgggatactttattcaagcattggttactggtgttggaccttaccaaaaccttcttgatcatttggctgatccagtaaacaacaatgtcttgactagtctcaagttccactagagcaaagcaatccactctttcttccaaatctccccccctccccttctcttatgtgtaatgtaacattatgtgcagataatatttttcatctcatctgtaatgctaaaacaaggacatgtcattttaaaaggcctgatatatatttttagaggaaatcatctagtattttgttctc

SEQ ID NO: 1715 - DNA, 1148 bp, Nicotiana tabacum
  misc_feature (25)..(25): n is a, c, g, or t
gggccggggatcttggttgaacttnattaggtgctcattcttcaactgcaaatctaacattactacaatccaaaagaaaatatggcaacacaagcattgctctcttcatcttctattacttcctcagtggagaatgacagacagattcttgtgggaagaccttctcaatcttctaccaagaaagcttcctttgttgtaagggctgcttccactccacctgttaagcaaggagcaaataggcctctctggtttgcttccaagcaaagtctttcatacttggatggcagtcttcctggtgattatggatttgatcccttgggactatcagaccccgaaggaaccggaggtttcatcgagccaaaatggttagcatacggagaaatcatcaacgggcgattcgccatgctaggtgcagtaggagccatagcaccagagattcttggaaaagctggtctcatcccaccagaaacagcacttccttggttccaaactggtgtaatcccaccagctggaacatacaactattgggctgactcttacactttgtttgtgttggaaatggcactaatgggatttgctgaacacaggagatttcaagattgggccaagcctggttcaatgggaaaacaatacttcttgggcttggaaaaaggcttaggcggctcgggtgatccagcgtacccgggtggcccattctttaaccctcttggatttggaaaagatgaaaaatctatgaaggatttgaagcttaaggaggttaagaatggaagattggctatgttggcaattttgggctattttattcaaggtttggttactggtgttggaccttaccaaaaccttcttgatcatttggctgatcccgtaaacaacaacatcttgaccaacttcaagttccactaagtgaacttgtagttatttcttcccaacttactcttctcttatgtgtaacactatgtgcagatactattttgtatgtcatctgtaatgctaaaaaggggacatttggtctaaaaagcctgatatatttttagtgtattagcaatgagtctattttttctagttgttacattgttgttatcatttttctggctattgttgttggaatttgactgtttatatttatcctctcgagccgagggtctttc

SEQ ID NO: 1716 - DNA, 1124 bp, Tripterygium wilfordii
aagagcaccataattcttttcagttctcaatataaaattttcgtagaaagcaaggggaagcaaagaagaagaaatggcaactcaagcactggtatcatcctctctgacctcttcagtggaggctgccaggcaaatatttggagcaaaaccaattcagtctccaattgggtcatcaaggagagcttcctttgttgtcagggctgcttccactcccccagtcaagcaaggagcagacagacaactttggtttgcatccaaacaaagccttacttaccttgatggcagcctccctggtgactttggattcgacccactaggactctcagaccctgaaggcactggaggtttcatagagccaagatggttggcctatggtgagatcatcaatggaagatatgccatgttaggtgcagttggtgctattgctcctgagatttttgggaagcttggactcattcctccagaaactgccctcccttggttcaaaactggtgtgattcctcctgctgggacatacaactactgggcagacccatacacactgtttgtgtttgagatggcactaatgggttttgcagagcacagaagattccaagattggtataatcctggctctatgggtaagcagtatttcttgggattggagaagggtttgggagggtctggcaatccagcttaccctggaggaccattctttaaccctcttggatttggaaaagatgagaagtcattgaaggatttgaagctgaaggaggtgaagaatggaagactagccatgttggcaatcgtgggttatttcatacaagctcttgttacaggagttgggccattccaaaaccttctggatcatttggctgatcctgtcaacaacaatatcttgactaacctcaagttccattaagccttgcagttgttggttgtcagttgtcacaggtcaactacctccctttcatctcttgtttcatcccttgtggtctactgtaatttcctgtaagaaacgatgtgtgaaggacttaatacattgcatgtttaatgtaagcgactctcaaaacgatgtgtgaaggactaagtagtaaatacattgcatgtttaatatatgcgactcagtcatttataacatcaag

SEQ ID NO: 1717 - DNA, 1114 bp, Platanus occidentalis
cttagatgtttttacgaaagtttagaaagaaagagacacctatgaacacaattttagcaggttcggttgcggggagggttttctttcattcaatctcattttcttctcatccgaagaaagaaacgaatctcatattacaagagtttggagtttggagtttgggttttcagtacttacccaatatcacagaagaagaaagaagaagaagaggaaaaagcaaatggcaacgcaagccctagtatcctctcctctcacctcttcaatggaagccgcaagacagctactgggaggaaggcctctccaatctccaattgggtcctcaaggaaggcttcgtttgttgtaagagcagcttctacaccccctgtgaagcaaggagcagacagacagctctggtttgcatccaaacagagtctttcttacttagatggcagcctcccaggagattacggattcgacccgcttggcctctcagatcctgaaggtacaggggggttcattgaacccaattggctagcctacggtgagatcatcaatggacgttttgccatgttgggtgctgtaggtgctattgcacccgagattcttggcaaactgggcctcattccgccggaaacagccctcccgtggttcaagaccggcgtaattccgcctgccgggacctataattactgggcagacccctacacactgtttgtcttggaaatggcactgatgggatttgcagagcaccgaagattccaggactgggctaagcctggttcaatgagcaagcaatacttcctggggttggagaaatatttgggagggtcagataacccagcataccccgggggtcccttatttaaccctcttgggcttggaaaggacgagaagtccatgaaggatttgaagttgaaggaggtaaagaatgggagattggctatgttggccatcctgggttacttgtgcaagctctagtaacaggagtaggtccctaccaaaacctcttagaccatttggctgaccctgtcaacaacaacgtcttgactagcctcaagttccactaaggagttaaatgctagctggttgtcttgttggggcctaattctccctctctctctctctctctctctt

SEQ ID NO: 1718 - DNA, 916 bp, Flaveria ramosissima
ttcatcatcatcactcacccctcagttgagtctgcaaggcagatccttggagctagaccacttcacacaccaacaagaaagatctcttttcttgtcaaagctgcttccacccctcctgttaagcaaggagctgacagacaactgtggtttgcatccaaacagtctctttcttaccttgatggaagtctcccaggtgactttggatttgacccacttggtctttcagacccagaagggaccggtgggttcatcgaacccaagtggctagcttacggagaggttatcaacggacggttcgccatgttgggagcagctggagccattgcacccgagattcttggcaagctcgggctcatcccagccgaaaccgccctcccatggttcaagacaggtgtcatccccccagccggaacatacgactactgggccgacccattcaccctatttgtattagaaatggcacttatgggctttgccgaacacagaagactccaagattggtacaacccgggttcaatgggaaaacaatactttttgggcctagagaaagggttctccgggtcgggtgaccccgcctacccgggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgacccagtcaacaacaatgtgttgaccagccttaagtttcactagagtcactatcttccttcctatatgtaatatcatgtgcagaatttcttgaaatattattattaatttgtgacgggtttaatgatatgttaaggataccaaaaccttgttgtaatat

SEQ ID NO: 1719 - DNA, 960 bp, Scabiosa columbaria
gccaacttaaactgcaacaagagttcttataacttgtacaacaatggcagcacaagcacttttatcgtcttcgtcgtccattgtcgcttcggctgaagcttcgagactgttatttgcaagtggaaatagagccatacattcttctacaagtaggggttcctttgtcgttagggctgcttctactccacctgtcaagcaaggagcaaataggtccctctggtttgcatctaaacagagcctttcttacttggatggcagcctccctggtgactatggattcgacccacttggtctctcggacccagaaggtgcaggagggtttatagagccaaaatggttagcttatggagaggtaatcaacgggcggtttgctatgcttggagccgccggagccatcgcacccgagatttttgggaagctcggactcattccacaggagactgcactcccatggttccaaaccggtgtgatccctccggccggtacttacaattattgggccgacggttacactttgtttgtgttggaaatggcactgatgggatttgcagaacacaggagactacaagattggtacaacccagggtccatgggcaagcagtatttcttgggtcttgagaaaggtttttccgggtcaggtgacccagcttacccaggcgggcctttctttaatcctctaggatttgggaaagatgaaaagtccatgaaagacttgaagctcaaggagatcaagaatggaaggttggccatgttggctattttgggttacttcattcaaggcttggtaactggggttggacccttccagaaccttctagatcatttggctgacccagttaacaacaatctgttaaccagcctaaagttccactagtatcgatttctcgcaatcttttctcattacttgtaaccggttacacatcaagcggattttcaagattatgaattccacaatgtcag

SEQ ID NO: 1720 - DNA, 1046 bp, Flaveria ramosissima
tcatcactcacatcctcagttgagtctgcaaggcagatcggtgaggctagaccacttcacacaccaacaagaaagatctcttttcttgtcaaagctgcttccacccctcctgttaagcaaggagcagacagacaactgtggtttgcatctaaacaatctctttcttaccttgatggaagtctcccaggtgactttggatttgacccacttggtctttcagacccagaaggaaccggtgggttcatcgaacccaagtggctagcttacggagaggttatcaacggacggttcgccatgttgggagcagctggagccattgcacccgagattcttggcaagctcgggcttatcccagccgaaaccgccctcccatggttcaagaccggtgtcatccccccggccggcacatacgactattgggctgacccattcaccctatttgtattagaaatggcacttatgggctttgccgaacacagaagactccaagattggtacaacccgggttcaatgggaaaacaatactttttgggcctagagaaagggttctccgggtcgggtgaccccgcctacccaggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttaccagaaccttttggaccatttggctgatccagtcaacaacaatgtgttgaccagccttaagtttcactagagtcgctatcttccttcctatatgtcatatcatgtgcagaatttcttgaaatattattattaatttgtgacgggtttaatgatatgttaaggataccaaaaccttgttgtaatatgtagttactaaacatgtttgtttgtgcatgcatgtacttaagcaaaaggagttataaagaaaaaaaaaaaaaaaaaacaaaaagtactatcgtgtagactacctactcgtacttacgtagacgtactcgacgaacg

SEQ ID NO: 1721 - DNA, 948 bp, Papaver somniferum
actttggtttcatcttcccttacttcatcttcttcctcttcaatggaagctgctagacaagtattcagaggaagaccacttcaatatgcaactgttaacgttggctcttcaaggaagggttcatttgttgttagagctgctgccactccacctgttaagcatggagcaaacagacagctttggtttgcatccaaacagagtctttcttacttagacggcagcctcccaggtgatttcgggtttgacccacttggcctttcagatccagaaggaacaggaggatttattgaaccaaatggctagcatatggtgaaattatcaacggacgttttgccatgttaggagcagcaggagcaatcgcacccgaagtcttcggcaaactcggtcttatcccagctgaaaccgcactcccatggttccaaactggagtgattccacccgctggaacttacagttactgggcagaccccttcacactatttgtactagaaatggctcttatgggttttgctgagcacagaagattgcaagactggtacaaccctggatccatgggcaaacaatatttcttaggtttggaaaagggtttgggcggatcaggtaaccctgcttacccaggtggacctttctttaaccccctaggatttggaaaagatgagaagtcaatgaaggaattgaagttgaaggaagtgaagaatggaagattagccatgttggctattttaggttatttcattcaaggtttagtcacaggagttggacctttccagaacttgttggaccatttggctgatccagtcaacaacaatgtcttgaccagtctcaagttccactaaatttctatgcccaggttcttgtactctgggacttcattctcttctctattttcctttttatcctttttttcccccttttctctctatttgtgaaagtttatggaaactcttg

SEQ ID NO: 1722 - DNA, 1007 bp, Secale cereale
  misc_feature (306)..(306): n is a, c, g, or t
  misc_feature (920)..(920): n is a, c, g, or t
cacacaccacgcctacctcatctctcggagcagcaggaggaggagcttgcaggaacaatggcggcccagggtcttctctctgggaggcagctgctggggaggcctctgcagtcttccatctccaggtcgtcttcctcccggaagtccgccttcgtcgtcagggcatcgtccagcccccctgccaagcaaaatgacaacaggcagctgtggttcgcctccaagcagtccctcacctacctcgacggcacgctgcctggtgactttggcttcgaccccttggggctgtccgacccggagggcactggngggttcatcgagcccaggtggctggcctacggcgagatcttcaacggccggacggcgatgatgggggtggtgggcatgatcgccccggaggccctgggcaaggtgggtttggtgcccccggagacggcgatcccatggttccaggcaggcgcgatcccgccggcagcacctaccagtactgggccgacccctacacgctcttcgtgttcgagatggcgctgattgcttcgcggacaccggcgactccaggactggtacacccgggctccatggggaagcagtacttcctgggccttgagaagtacctcggcggctccggtgaccccgcctaccccggcgggcccatcttcaacccgctcgggttcggcaccaagagtgagaaggagatgaaggagctcaagctcaaggagatcaagaacggccgcctcgccatgctcgccttcctcggcatgtcgctgcaggccatcttcaccggcgtcgggcccttccagaacctcctcgaccacctcgccgaccccgtcaacaacaacatcctcaccagcctcaagttccactaggcgaaatccgagcatcgtcgtcctgtgcatggtacccgtccgtcgtcgtgggaaacntgagcgcgcgagcggtatatatgcgagggttgggtgtaaaatgtaaatttgtaacgcgtgctgcataaatgcttataatatatatat

SEQ ID NO: 1723 - DNA, 962 bp, Musa acuminata
ggggactcctctctggtttcatttccattccccccccctcagctacgaccgacagggagaggcaggcaagagcggcagcaaacaccgatggcaactcaggcttttctctcctcggtggacgctggaaggcagctcctcgggggaaggcccctccggtctgctccctcgagatctcttggttcttcgaggaaggcttcgttcgccgtcagagcagcttccacgcctcccgtcaagcaaggagcagacagacagctctggtttgcctccaagcagtccctcacctacttggacggaagcctccccggtgactacggctttgacccccttggcctgtcggaccccgaaggcaccggaggattcatcgagcccaaatggctggcctacggtgaggtcatcaacgggaggtatgccatgctgggcgcagtaggcgccatcgcgcccgagatcttcggaaagctcgggtggataccacctgagaccgcactcccctggttcaagactggcgtctttccaccggccggcacttacaactactgggcagacccctacacgctgttcgtgctggagatggcgctcatggggttcgcggagcaccggagattccaggactgggcaaatccaggctccatggggaagcagtacttcttaggtctcgagaagtggctgggggggtcgggaaaccctatctaccctggaggacctctcttcaaccctctcggcttcgggaaggacgagaagtcgatgaacgatctgaagctgaaagagtgaaaaacggggaggctgggcatgctggccatcctgggctactttgcgcaggcggcgttgaccggattggggcgttccaaacctgttggatcacttggccgaccctgtgcacaacacatcttggacagcttcaggtccactggagggtgcgcagctcatcctggcaggctttgttgcacaaattatcccttggaaac

SEQ ID NO: 1724 - DNA, 1035 bp, Brassica juncea
aatcatcgtctcttggtgacagaagagaagaacagagcgaaaaatggcagcacagtcacttgtgtcttcttcacttacctcctctgttcagactgctagacagatattcagcacaaaaccagctgtctacgtgaggaagacttccttcattgttaaagctacttcaaccccacctgtcaagcaaggcgcaaacagaccattgtggtttgcatcatcacagagcctatcttacttggacggcagcttacctggcgactatggattcgacccgcttggtctttcagacccagaaggtactggaggtttcatcgagccaaaatggttagcctacggagagatcatcaacggaaggttcgctatgttgggtgcagctggagctattgcccctgagattcttggcaaagctggtttgattccagcagacactgctcttccctggttccaaaccggtgtgattccacctgcagggacatacagctactgggcagacccttacacactctttgttctcgagatggctttgatgggatttgctgagcaccggaggttgcaggactggtacaacccaggatcaatgggaaaacagtacttcttgggcttagagaaaggttttgccggttcgggtgacccgtcttacccgggtggacctttctttaaccctcttgggtttgggaaagacgagaagtcgatgaaggagttgaaactcaaggaggtcaagaacggtagactggctatgctcgcaatcctaggctattttgtgcagggactagtgaccggtgtggggccttaccagaaccttcttgatcatttggcggatccagtcaacaacaatgtcttgaccagccttaagttccactgagatgatcatcacatcatcccatgtgttttatgttggtctctcattctcttgtatccttcaatcttgtcgctttctcttagtatcaccagcttcgtcgtattgtaacaccctttgtgatgaacatatccgtcttttgtaagaaatgacaatggctaaaaagaacaacttctaggatc

SEQ ID NO: 1725 - DNA, 1016 bp, Rosa hybrid cultivar
agaaagaaaatggcagcacaagccctagtgtcgtcgtcgtcgttaaccgcctcgaaggaggttgcgaggaacctgctaggaggaagatcagctcagtctccatttggggtgaggaaatcagcttcctttgttgtaaaggcagcctctactccccccgttaagcaaggagcagacagacagttgtggtttgcatcaaagcagagcctttcttacttggatggcagtcttccaggtgactatggattcgacccattgggcctctcagacccagaaggcacaggagggttcatcgatccaagatggttagcttatggtgaggtcatcaatggacgttatgccatgttgggtgcaatcggtgccattgcacccgagatcttggggaaacttggcctgattccagctgaaacagctctcccttggttccaaaccggtgtgattcccccagccggaacctacaactattgggccgacccttacaccctattcgtcttcgagcttgccttaatgggctttgccgagcacagacgtttccaggattggtacaaccccggatccatgagcaagcaatacttcttgggccttgagaagtacttgggaggatccgataacccagcctaccctggtgggccgttatttaacccattgggctttggaaaagatgagaagtcactgaacgagttgaagctcaaggaagtgaagaacgggaggttggctatgttggcaatcttgggctactttatccaagcccttgtgactggagttgggccgtaccaaaacctgttggaccatttggctgacccagtgaacaacaacatcttgaccagcctcaagttccattaatgaacagagttgtacaatattttagtgctgccccttttgttgtttggaaattgaaatctctcttctcaaaactcttctcctcattgtaagattatgtgagaaactttgatgttatattatgtgaatctgtaagaaatgacatgttaaaatagttaatttaagattttagttaagct

SEQ ID NO: 1726 - DNA, 888 bp, Helianthus annuus
aagaaaatggctacacaagcgttggcttcatcatcatcactcacctcctcagtggagtctgcaaggcaaatccttggagctaggccagttcacacatcttcaagaaaggtctcttttcttgtcaaagctgcatccacgcctcctgttaagcaaggagcaaacagacaactttggtttgcatccaagcaatccctttcttacctggatggaagtctcccaggtgactatggatttgacccacttggtctttcagacccagaaggtactggtggattcattgaacccaagtggctagcttatggagaggttatcaacggtcggttcgccatgttgggtgcagctggagccattgcacctgagatatttggcaagcttgggctcatcccagcggaaaccgccctcccgtggttcaagaccggtgtcatcccaccagcaggcacatacgactactgggcagaccctttcaccctgtttgtatttgaaatggcacttatgggttttgcagaacacagaagactacaagactggtacaaccctggttcaatgggaaaacaatactttttgggcttggagaaaggttttgccgggtcgggtgacccagcatacccaggtgggccgtttttcaacccattagggtttggaaaagatgagaagtcaatgaaggaattgaagcttaaagagatcaagaatggtagattggctatgttggccattttgggttacttcattcagggtttggtgactggtgttggacctttccagaaccttctggatcatttggctgatccagtcaacaacaatgtcttgaccagccttaaagttcactagagacttttaagatctcccttctatatgtaatatcaggtgcagtattttcgaaatgatatt

SEQ ID NO: 1727 - DNA, 1202 bp, Phaseolus coccineus
ctttggctttttagtggttgcaatacatatcattcatctctaaccttcaacaacaacttctcatcttcaacattactctcttctgctgcaccaattgcaaagcaacaaaaggagcactgaccaccatggctgcacaagctctgctaccatcttcatctcttgtcttctcatctgagtctgcaagacagagtcttggaccaagatcactccaatctcccattgggttctcccgaaaacaatccttcattgtcaaggcagcttctactccccctgtcaagcaaggagcagacagacccttatggtttgcatcaaagcaaagtctttcttacttggatggcagtcttcctggtgactatggatttgaccctcttgggctttcagaccctgaaggaacaggagggttcattgagcccaaatggctagcatatggtgaagtcatcaatggtcgttttgcaatgttgggtgcagtaggttccatagcacctgaaattcttggcaaggctggtctgatccctgaggaaacagcactgccatggttcagaaccggtgtggtcccacctgcaggaacctacaactactgggcagactcctacaccctctttgtgtttgagatggcactgatgggatttgcagagcacagaagattccaagattgggcaaaaccaggctcaatggggaaacagtacttcctaggactagagaaaggccttggaggttctggtgagccagcatacccaggaggacctctcttcaaccctcttggttttgggaaggatgagaaatcattgaaggatttgaagctgaaggaggtgaagaatggaaggttggctatgttggcaattttgggttactttattcaagctcttgtgacaggtgttgggccataccaaaacctcttagatcatcttgcagaccctgtcaacaacaatgtcttgaccagtctcaagttccactaagtgtatcatatgctgttacatattctttacttggttgttgttgttgtacgcagttaccaaaactcagtcacttttctgcatcctctctttgctctttggtactgtatcatcatcatcatcatcttcaccttgcttcatggccctctaagaaatgactgtaaaacaattacaaacatgggaaacttctgttatctcttcactagctagatcaaatctataatctatattattactatatttttcttt

SEQ ID NO: 1728 - DNA, 1191 bp, Phaseolus coccineus
ggctttttagtggttgcaatacatatcattcatctctaaccttcaacaacaacttctcatcttcaacattactctcttctgctgcaccaattgcaaagcaacaaaaggagcactgaccaccatggctgcacaagctctgctaccatcttcatctcttgtcttctcatctgagtctgcaagacagagtcttggaccaagatcactccaatctcccattgggttctcccgaaaacaatccttcattgtcaaggcagcttctactccccctgtcaagcaaggagcagacagacccttatggtttgcatcaaagcaaagtctttcttacttggatggcagtcttcctggtgactatggatttgaccctcttgggctttcagaccctgaaggaacaggagggttcattgagcccaaatggctagcatatggtgaagtcatcaatggtcgttttgcaatgttgggtgcagtaggttccatagcacctgaaattcttggcaaggctggtctgatccctgaggaaacagcactgccatggttcagaaccggtgtggtcccacctgcaggaacctacaactactgggcagactcctacaccctctttgtgtttgagatggcactgatgggatttgcagagcacagaagattccaagattgggcaaaaccaggctcaatggggaaacagtacttcctaggactagagaaaggccttggaggttctggtgagccagcatacccaggaggacctctcttcaaccctcttggttttgggaaggatgagaaatcattgaaggatttgaagctgaaggaggtgaagaatggaaggttggctatgttggcaattttgggttactttattcaagctcttgtgacaggtgttgggccataccaaaacctcttagatcatcttgcagaccctgtcaacaacaatgtcttgaccagtctcaagttccactaagtgtatcatatgctgttacatattctttacttggttgttgttgttgtacgcagttaccaaaactcagtcacttttctgcatcctctctttgctctttggtactgtatcatcatcatcatcatcatcttcaccttgcttcatggccctctaagaaatgactgtaaaacaattacaaacatgggaaacttctgttatctcttcactagctagatcaaatctataatctatattattactat

SEQ ID NO: 1729 - DNA, 1124 bp, Cirsium arvense
tatttgcttctggtgtaaacaccaccatgcccatgctaacgctcctgtaaagtcttttaacttctttttagcacaatgaccttcatctgacctgcccataatctgacaaccttttccaccaccttgcattcattcgaaagatgttacgcggggggagagtaacagtagcaagcattgaataagaagatggcaacacagagtttggtatcatcatctctcacctcctcaattgaggctggaagaagaccatttcaaacctcatcaagaaagccttcatttgttgtcaaagctgcttcttctactccccctgtcaagcaaggagcaaacagacaactctggtttgcatcgaagcaatctctctcctacctagatggcagtctcccaggcgacttcgggttcgacccacttggtctctcagatcccgaaggcaccggagggttcatcgagcccaaatggctagcctacggagaagtcatcaacggacagttcgccatgctcggtgcagccggagccattgcaccagagattttcggtaagctcggtctcatcccatccgaaaccgccctcccatggttccaaaccggtgtcatccccccagccggcacctacagctactgggccgacccttacaccctattcgtaatggaaatggcactcatgggttttgccgagcaccgacggttccaagattggtataaccccggctcgatgggaaagcaatactttttgggactagaaaaagggttctcgggatcagggaacccagcgtacccaggtgggcccttcttcaacccgttagggttcgggaaagatgaaaagtcaatgaaagagttgaagctaaaagaaatcaagaatggtagattggctatgttggctgtgttgggttactttattcagggtttggtcacaggggttggaccatatcaaaaccttttggaccatctggctgaccctgttaacaacaatgtgttgaccagccttaagttccactaaaaactcttttttttgtatgtaatattatgtgcacagtttatttggaatactataaattaattaatcatgtgttaaggttaccgaaaccttaaatcgttactattcaaaaaaagaaaaaagtaccgactgcg

SEQ ID NO: 1730 - DNA, 985 bp, Flaveria ramosissima
gggggtacccaacgaacctagtcactagacttttctagaaaactagggccactacaagtcgattggctttcatcatcatcactcacctcctcagttgagtctgcaaggcagatcggtggagctagaccactcacacaccaacaagaagatctctttcttgtcaaagctgcttccacccctcctgttaagcaaggagctgacagacaactgtggtttgcatccaaacagtctctttcttaccttgatggaagtctcccaggtgactttggatttgacccacttggtctttcagacccagaagggaccggtgggttcatcgaacccaagtggctagcttacggagaggttatcaacggacggttcgccatgttgggagcagctggagccattgcacccgagattcttggcaagctcgggctcatcccagccgaaaccgccctcccatggttcaagacaggtgtcatccccccagccggaacatacgactactgggccgacccattcaccctatttgtattagaaatggcacttatgggctttgccgaacacagaagactccaagattggtacaacccgggttcaatgggaaaacaatactttttgggcctagagaaagggttctccgggtcgggtgaccccgcctacccgggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgatccagtcaacaacaatgtgttgaccagccttaagtttcactagagtcactatcttccttcctatatgtaatatcatgtgcagaatttcttgaaatattattattaatttgtgacgggtttaatgatatgttaaggataccaaaaccttgttgtaatatgta

SEQ ID NO: 1731 - DNA, 1114 bp, Solanum tuberosum
cttggtggcctatacctttgtcccttattttgcttgccaccttgtgtctactactcttgggaagctgagtgcttattcttcttcaacacaagtcaattgttttaatcagaaaacaaaaaatggcaacacaggcattgatatcctcatcatctattgcatcctcaacagaggcagccagacaaattctaggaggaagacctttccaatctccaatcaagaaggcttcctttgttgtaagggctacagccagtccacctgttaagcaaggagcaaataggcctctctggtttgcatccaagcagagcctttcatacttggatggcagccttcctggtgactatggatttgatcccctgggactgtcagaccctgaaggtactggaggtttcatcgaaccaaaatggctagcatatggagaggtcatcaatggaagatttgctatgttgggggtagtaggagccattgcgcccgagattcttggaaaggctggtctcatcccagcagaaacagcccttccatggttccagacaggagtgattcctccagctggaacatacaactattgggcggacggttacacactatttgtactggagatggcactcatgggatttgctgaacacagaagattccaggactgggccaagccaggttctatgggtaaacaatactttttggggctagagaaaggcttggggggctctggagacccagcataccctggtggacctttctttaaccctctcgggttcggaaaagatgagaagtctatgaaggacttgaagctcaaggagattaagaatggaagactagctatgttgggtatcttgggttacttcattcaaggtttggtaactggagttggaccttaccaaaacctccttgaccatttggctgaccctgtaaacaacaatgtcttgaccagcctcaagttccactaaacaaggagcaaatcaccctgttttagcccctgatctgatatgtaaacattatgtgcagatattattttgcatatcattgtaatcagctaaaaaggacatgtcaactcaaaaatctgtttttcctgagttttagctgttagcttcctgctgcagtttctgcagcattctttagg

SEQ ID NO: 1732 - DNA, 1132 bp, Fragaria vesca
cctcgattatttacattacatgtacgagtttctggttcataagctctcagactttgatactgagaaaacttattcgagattcacagaagaagaaagagtagagagctctagagagaaagaatggcagcacaagccctggtgtcgtcgtcgtcgttaaccgcctcgaaagaggttgcgaggaacttgctaggaggaagatcagctcagtctccatttggggtgaggaaatcagcttcctttgttgtaaaggcagccactactccccctgttaagcaaggagcagacaggcagttgtggtttgcatcaaagcagagtctttcttacttggatggcagccttccaggtgactttggattcgacccattgggcctctcagacccagaaggcaccggagggtttatcgaaccaagatggttagcctatggtgagatcatcaatggacgttttgccatgttgggtgcagccggtgccattgcacctgagatttttgggaagctcggacttattccacctgaaacagctctcccttggttccaaaccggtgtgattcccccggccggaacctataactactgggctgacaattacaccctattcgttttggagatggccctaatgggctttgccgagcaccgacgtttccaggattggtacaaccccggatccatgagcaagcaatacttcttgggctttgagaagtacttgggaggatccggaaacccagcctaccctggtgggccgttatttaacccgttgggttttggaaaggatgagaagtcaatgaacgagttgaagctcaaggaagtgaaaaatgggagattggctatgttagccatattgggctactttatccaagcccttgtgactggagttgggccataccaaaacctgttggaccatttggctgacccagtgaacaacaacatcttgaccagcctaaagttccactaatgaacagagttgtacaacattttagtgctgcccctttgttgtttggaaatattgaaatctctcttctcgaaatgttcttctgtaagattatgtgagaaactttgatgttatattatgtgaatctgtaagaaatgacttattcaaatagttaatttaagattttagttaaacaacaccttta

SEQ ID NO: 1733 - DNA, 1009 bp, Flaveria ramosissima
atctttactaagaaaataggctacacaagcattggcttcatcatcatcactcacctcctcagttgagtctgcaaggcagatccttggagctagaccacttcacacaccaacaagaaagatctcttttcttgtcaaagctgcttccacccctcctgttaagcaaggagctgacagacaactgtggtttgcatccaagcagtctctttcttaccttgatggaagtctcccaggtgactttggatttgacccacttggtctttcagacccagaagggaccggtgggttcatcgaacccaagtggctagcttacggagaggttatcaacggccggttcgccatgttgggtgcagccggagccattgcacccgagattcttggcaagctcgggctcatcccagccgaaaccgccctcccattggttcaagacaggtgtcactcccccagccggaacatacgactactgggccgacccattcaccctatttgtattagaaaatggcacttatgggctttgccgaacacagaagactccaagattggtacaacccgggttcaatgggaaaacaatactttttgggcctagagaaagggttctcggggtcgggtgaccccgcctacccgggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgacccagtcaacaacaatgtgttgaccagccttaagtttcactagagtcactatcttccttcctatatgtaatatcatgtgcagaatttcttgaaatattattattaatttgtgacgggtttaatgatatgttaaggataccaaaaccttgttgtaatatgtagttactaaacatgtttgtttgtgcatgcatgtacttaagcaaaaggagtta

SEQ ID NO: 1734 - DNA, 993 bp, Flaveria ramosissima
ctgcaaatcttttcaagaaaatggcaacacaagcattggcttcatcatcatcactcacctcctcagttgagtctgcaaggcaaatccttggagctagaccacttcacacaccttcaagaaagatctcttttcttgtcaaagctgcttccacccctcctgttaagcaaggagcagacagacaactgtggtttgcatccaaacagtctctttcttacctggatggaagtctcccaggtgactttggatttgacccacttggtctttcggacccagaagggaccggagggttcatagagccgaagtggctagcttacggagaggtcatcaacggccggttcgccatgttgggtgcagccggagccattgcacccgagattcttggcaagcttgggcttatcccagccgaaaccgccctcccatggttcaagaccggtgtcatccccccggccggcacatatgactactgggccgacccattcaccctatttgtattagaaatggcacttatgggctttgcagaacacagaagactacaagattggtacaaccctggttcaatgggaaaacaatactttttgggcctagagaaaggcttttccgggtcgggagacccagcatacccgggcggcccgttcttcaacccgttagggttcggaaaagatgagaagtcaatgaaggaattgaagctaaaagagatcaagaatggtagattggctatgttggccattttgggctacttcattcagggattggtgactggtgttgggccttaccagaaccttttggaccatttggctgatccagtcaacaacaatgtgttgaccagccttaagtttcactagagtcactatcttccttcctatatgtaatatcatgtgcagaatttcttgaaatattattattaatttgtaacgggtttaatgatatgttaaggataccaaaaccttgttgtattatgtagttactaaacatgtttgtttgtgcatgcatgta

SEQ ID NO: 1735 - DNA, 975 bp, Flaveria ramosissima
aaatggcaacacaagcattggcttcatcatcatcactcacatcctcagttgagtctgcaaggcagatccttggagctagaccacttcacacaccaacaagaaagatctcttttcttgtcaaagctgcttccacccctcctgttaagcaaggagcagacagacaactgtggtttgcatccaaacaatctctttcttaccttgatggaagtctcccaggtgactttggatttgacccacttggtctttcagacccagaaggaaccggtgggttcatcgaacccaagtggctagcttacggagaggttatcaacggacggttcgccatgttgggagcagctggagccattgcacccgagattcttggcaagctcgggctcatcccagccgaaaccgccctcccatggttcaagaccggtgtcatccccccggccggcacatacgactattgggccgacccatttaccctatttgtattagaaatggcacttatgggctttgccgaacacagaagactacaagattggtacaacccgggttcaatgggaaaacaatactttttgggtctagagaaagggttctccgggtcgggtgaccccgcctacccaggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttaccagaaccttttggaccatttggctgatccagtcaacaacaatgtgttgaccagccttaagtttcactagagtcactatcttccttcctatatgtcatatcatgtgcagaatttcttgaaatattattattaatttgtgacgggtttaatgatatgttaaggataccaaaaccttgttgtaatatgtagttactaaacatgtttgtttgtgcatgcatgta

SEQ ID NO: 1736 - DNA, 975 bp, Flaveria ramosissima
aaatggcaacacaagcattggcttcatcatcatcactcacatcctcagttgagtctgcaaggcagatccttggagctagaccacttcacacaccaacaagaaagatctcttttcttgtcaaagctgcttccacccctcctgttaagcaaggagcagacagacaactgtggtttgcatctaaacaatctctttcttaccttgatggaagtctcccaggtgactttggatttgacccacttggtctttcagacccagaaggaaccggtgggttcatcgaacccaagtggctagcttacggagaggttatcaacggacggttcgccatgttgggagcagctggagccattgcacccgagattcttggcaagctcgggcttatcccagccgaaaccgccctcccatggttcaagaccggtgtcatccccccggccggcacatacgactattgggctgacccattcaccctatttgtattagaaatggcacttatgggctttgccgaacacagaagactccaagattggtacaacccgggttcaatgggaaaacaatactttttgggcctagagaaagggttctccgggtcgggtgaccccgcctacccaggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttaccagaaccttttggaccatttggctgatccagtcaacaacaatgtgttgaccagccttaagtttcactagagtcgctatcttccttcctatatgtcatatcatgtgcagaatttcttgaaatattattattaatttgtgacgggtttaatgatatgttaaggataccaaaaccttgttgtaatatgtagttactaaacatgtttgtttgtgcatgcatgta

SEQ ID NO: 1737 - DNA, 1001 bp, Flaveria ramosissima
caccaacaacctccaaaatcttttcaagaaaaatggctacacaagcattggcttcatcatcatcactcacctcctcagttgagtctgcaaggcagatccttggagctagaccacttcacacaccaacaagaaagatctcttttcttgtcaaagctgcttctacccctcctgttaagcaaggagcagacagacaactatggtttgcatccaaacagtctctttcttaccttgatggaagtctcccaggtgactttggatttgacccacttggtctttcagacccagaagggaccggtggtttcatcgagcccaagtggctagcttacggagaggtcatcaacggacggttcgctatgttgggtgcagctggagccattgcacccgagattcttggcaagctcgggctcatcccagccgaaaccgccctcccatggttcaagaccggtgtcatccccccggccggcacatacgactactgggccgaccccttcaccctatttgtattagaaatggcacttatgggctttgctgaacacagaagactacaagattggtacaaccctggttcaatgggaaaacaatactttttgggcctagagaaagggttctccgggtcgggcgaccccgcctacccgggcggcccattcttcaacccgttagggttcggaaaagatgagaagtcaatgaaggaattgaagctaaaagagatcaagaatggtagattggctatgttggccattttgggctacttcattcagggtttggtgactggtgttgggccttaccagaaccttttggaccatttggctgacccagtcaacaacaatgtgttgaccagccttaagtttcactagagtcactatcttccttcctatatgtaatatcatgtgcagaatttcttgaaatattattattaatttgtgacgggtttaatgatatgttaaggataccaaaaccttgttgtcatatgtagttactaaacatgtttgtttgtgcatgca

SEQ ID NO: 1738 - DNA, 1249 bp, Flaveria ramosissima
aatataaagttcttccatagcttatcagtaactgggcttaaatctcggtcctcagttgaatcctcgatatgcatcagctgttctgcagtacaatgtggtaagaagcgttctaaaagatgtgggtccgtcactcccacattaccaatatacctaacattatctatagctttttgaacacagagatcaaccaaggtagggattcttcttattggctttgtaccccattcttccattctttggttacttgatctcatttttggaccaacaacctccaaatcttttcaagaaaatggctacacaagcattggcttcatcatcatcactcacctcctcagttgagtctgcaaggcagatccttggagctagaccacttcacacaccaacaagaaagatctcttttcttgtcaaagctgcttctacccctcctgttaagcaaggagcagacagacaactatggtttgcatccaaacagtctctttcttaccttgatggaagtctcccaggtgactttggatttgacccacttggtctttcagacccagaagggaccggtggtttcatcgagcccaagtggctagcttacggagaggtcatcaacggacggttcgctatgttgggtgcagctggagccattgcacccgagattcttggcaagctcgggctcatcccagccgaaaccgccctcccatggttcaagaccggtgtcatccccccggccggcacatacgactactgggccgaccccttcaccctatttgtattagaaatggcacttatgggctttgctgaacacagaagactacaagattggtacaaccctggttcaatgggaaaacaatactttttgggcctagagaaagggttctccgggtcgggcgaccccgcctacccgggcggcccattcttcaacccgttagggttcggaaaagatgagaagtcaatgaaggaattgaagctaaaagagatcaagaatggtagattggctatgttggccattttgggctacttcattcagggtttggtgactggtgttgggccttaccagaaccttttggaccatttggctgacccagtcaacaacaatgtgttgaccagccttaagtttcactagagtcactatcttccttcctatatgtaatatcatgtgcagaatttcttgaaatattattattaatttgtgacgggtttaatgatatgttaaggataccaaaaccttgttgtcatatgtagttactaaacatgtttgttt

SEQ ID NO: 1739 - DNA, 1041 bp, Flaveria ramosissima
aaatggcaacacaagcattggcttcatcatcatcactcacctcctcagttgagtctgcaaggcagatccttggagctagaccacttcacacaccaacaagaaagatctcttttcttgtcaaagctgcttccacccctcctgttaagcaaggagctgacagacaactgtggtttgcatccaaacagtctctttcttaccttgatggaagtctcccaggtgactttggatttgacccacttggtctttcagacccagaagggaccggtgggttcatcgaacccaagtggctagcttacggagaggttatcaacggacggttcgccatgttgggagcagctggagccattgcacccgagattcttggcaagctcgggctcatcccagccgaaaccgccctcccatggttcaagacaggtgtcatccccccagccggaacatacgactactgggccgacccattcaccctatttgtattagaaatggcacttatgggctttgccgaacacagaagactccaagattggtacaacccgggttcaatgggaaaacaatactttttgggcctagagaaagggttctcggggtcgggcgaccccgcctacccaggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgacccagtcaacaacaatgtgttgaccagccttaagtttcactagagtcactatcttccttcctatatgtaatatcatgtgcagaatttcttgaaatattattattaatttgtgacgggtttaatgatatgttaaggataccaaaaccttgttgtaatatgtagttactaaacatgtttgtttgtgcatgcatgtacttaagcaaaaggagtaatgttaaatctcatgatctcaattctaatagtaacaaaataatagacct

SEQ ID NO: 1740 - DNA, 967 bp, Plantago ovata
caacaataactgagcacaacttacactagaaagttagaaatggcgacgcaagcattggtctcttcttcctccatctgctcttctgctgatgttgcaagacagacttttggaggcagggcagtccactcttctaggaaggtttgtttcgtcgtaaaggccgcctccactcctccggttaagtctggagcaaataggccactgtggtttgcatccaagcagagtctgtcttatttagatggcagcctcccaggtgactacggatttgatccattaggactatcagacccggaaggcaccggaggattcatcgagccaaaatggctagcgtacggagaagtgatcaatgggaggttcgctatgctgggagcagcaggagccattgcaccagaaattctagggaaagctggcctaatcccacaagagacagcactcgcatggttccaaactggagtcattccaccagccggtacatacaactactgggccgatggatacaccctatttgtccttgagatggccctgatgggcttcgcggaacacaggaggctccaggactggtacaacccaggttcaatgggaaagcagtacttcttgggacttgaaaagggcttctcaggatctggtgaccctgcctaccctggtggaccgttcttcaacccactaggattcgggaaagatgagaaatccatgaaggagttaaagctgaaggagattaagaatggaagattggctatgttggctatcttgggttactttattcagggactagttaccggtgttggtccataccagaacctgttggatcacttggctgatccagtcaacaacaatgtgttaacaagcctcaaattccactagacttgtaacaaattaaatcttgttatatcatatcttaaacatgtgcagagtattgttaaacacttgagctgtaatctaatcaggaacttcttaatacaattgctgtgat

SEQ ID NO: 1741 - DNA, 959 bp, Helianthus annuus
cagaaaatggcaacacaagcattggcttcatcatcactcagctcctcagtggaatctgcaaggcaaatacttggagctaggccacttcacacatcttcaagaaaggtctcttttcttgtgaaagctgcatccacccctcctgttaagcaaggagcaaacagacaactttggtttgcatccaagcaatctctttcttacctggatggaagtctcccaggtgactatggatttgacccacttggtctttcagacccagaaggcactggtggattcattgaacccaagtggctagcttatggagaggttatcaacggtcggttcgccatgttgggtgcagctggagccattgcacctgagatatttggcaagcttgggctcatcccagccgaaactgccctcccgtggttcaagaccggtgtcatcccaccagcgggcacatacgactactgggcagaccctttcaccctgtttgtatttgaaatggcacttatgggttttgcagaacacagaagactacaagactggtacaaccctggttcaatgggaaaacaatactttttgggcttggagaaaggttttgccgggtcgggtgacccagcatacccaggtgggccgtttttcaacccattagggtttggaaaagacgagaagtcaatgaaggaattgaagcttaaagagatcaagaatggtagattggctatgttggccattttgggttacttcattcagggtttggtgactggtgttggacctttcgagaaccttctggatcatttggctgatccagtcaacaacaatgtcttgactagccttaagttccactagagacttttaaatcttccttcttatatgtaatatcatgtgcagtattttctaaatgatattattaatttgtaacgaaattaatgtgatatgttaagagccaaaaccttgttgtaatatgtagttcctacatatgt

SEQ ID NO: 1742 - DNA, 1142 bp, Citrus sinensis
gcttattctccaaaagcagaagcagaaagccgaagcacttttaatttatcgtattgaagtagagaaacaagaggaaaaaagaaaattaaaaaatggcaacccaagctttggtttcatcatctcttacatcttcagtggagactgcgagacaaattcttggagcaagatcagctcaatccccaactgggtcatcaagaaaaggttcctttgttgttagggcagcttctactcctcctgttaagcaaggagcagacagaccgttgtggtttgcatccaaacaaagcctttcatacttggatggcagcctccccggagactatggattcgacccacttggtctctcagaccctgaaggcacaggagggttcattgagccaaaatggctggcctacggcgaggtcatcaacggtcgttatgccatgttgggagctgtgggagccattgcaccggagattcttggcaaggcaggcctcattccgcaagaaactgccctggcctggttccaaaccggtgtgatccccccagcgggaacatacaactactgggcagacccttacacacttttcgtcctggaaatggcactcatgggatttgccgagcaccggagattccaagactgggcaaatccaggatcaatgggcaggcaatacttcctcggattcgagaaatacttgggaggatccggcgatccggcttaccctggaggacctctattcaaccctctgggtcttgggaaagatgagaagtcaatgaaggatttcaagctcaaggaagtgaagaatggaagattggcaatgttggcaatcttgggttactttgttcaaggtcttgttacaggagttgggccttaccagaacctattggatcacttggctgatcctgtcaacaacaatgttttgactagcctcaagtttcactgagagagaaatttcttgttcattgcttggaattatatattccaagccttgtcatcccccactctgttctattctactttccccattgtaaaattatctatgtgaaaagtgaatgtaacttggcggaaatgacatgttaattgctaaactggatctcttagttattaatttatgtactgttagattagctaaatgctttgcttaatcttttaattttacaaatta

SEQ ID NO: 1743 - DNA, 1130 bp, Unknown
  Sequence found in Organisms: Citrus clementina, Citrus sinensis
ttggcccttatttttcggcctttgcttattctccaaaagcagaagcagaaagccgaagcacttttaatttatcgtattgaagtagagaaacaagaggaaaaaagaaaattaaaaaatggcaacccaagctttggtttcatcatctcttacatcttcagtggagactgcgagacaaattcttggagcaagatcagctcaatccccaactgggtcatcaagaaaaggttcctttgttgttagggcagcttctactcctcctgttaagcaaggagcagacagaccgttgtggtttgcatccaaacaaagcctttcatacttggatggcagcctccccggagactatggattcgacccacttggtctctcagaccctgaaggcacaggagggttcattgagccaaaatggctggcctacggcgaggtcatcaacggtcgttatgccatgttgggagctgtgggagccattgcaccggagattcttggcaaggcaggcctcattccgcaagaaactgccctggcctggttccaaaccggtgtgatccccccagcgggaacatacaactactgggcagacccttacacacttttcgtcctggaaatggcactcatgggatttgccgagcaccggagattccaagactgggcaaatccaggatcaatgggcaggcaatacttcctcggattcgagaaatacttgggaggatccggcgatccggcttaccctggaggacctctattcaaccctctgggtcttgggaaagatgagaagtcaatgaaggatttcaagctcaaggaagtgaagaatggaagattggcaatgttggcaatcttgggttactttgttcaaggtcttgttacaggagttgggccttaccagaacctattggatcacttggctgatcctgtcaacaacaatgttttgactagcctcaagtttcactgagagagaaatttcttgttcattgcttggaattatatattccaagccttgtcatcccccactctgttctattctactttccccattgtaaaattatctatgtgaaaagtgaatgtaacttggcggaaatgacatgttaattgctaaactggatctcttagttattaatttatgtactgttagattagct

SEQ ID NO: 1744 - DNA, 963 bp, Plantago ovata
gagcacaacttacactagaaagttagaaatggcgacgcaagcattggtctcttcttcctccatctgctcttctgctgatgttgcaagacagacttttggaggcagggcagtccactcttctaggaaggtttgtttcgtcgtaaaggccgcctccactcctccggttaagtctggagcaaataggccactgtggtttgcatccaagcagagtctgtcttatttagatggcagcctcccaggtgactacggatttgatccattaggactatcagacccggaaggcaccggaggattcatcgagccaaaatggctagcgtacggagaagtgatcaatgggaggttcgctatgctgggagcagcaggagccattgcaccagaaattctagggaaagctggcctaatcccacaagagacagcactcgcatggttccaaactggagtcattccaccagccggtacatacaactactgggccgatggatacaccctatttgtccttgagatggccctgatgggcttcgcggaacacaggaggctccaggactggtacaacccaggttcaatgggaaagcagtacttcttgggacttgaaaagggcttctcaggatctggtgaccctgcctaccctggtggaccgttcttcaacccactaggattcgggaaagatgagaaatccatgaaggagttaaagctgaaggagattaagaatggaagattggctatgttggctatcttgggttactttattcagggactagttaccggtgttggtccataccagaacctgttggatcacttggctgatccagtcaacaacaatgtgttaacaagcctcaaattccactagacttgtaacaaattaaatcttgttatatcatatcttaaacatgtgcagagtattgttaaacacttgagctgtaatctaatcaggaacttcttaatacaattgctgtgatcttattt

SEQ ID NO: 1745 - DNA, 1736 bp, Amborella trichopoda
ttttttattgggttgagaaggttaattccgaaaagtgatccgagggagtaaatgaacactatacacccgcaaagtataacatcatctggcttaaaggaatctctccgaaaatgaggctctcctttctcctccaactgaaaccacgacctcagattgtaccacgtggcatcgaccattaaacctcagcctcaagcgccctatccatcatgaaagcacgtgtccacatctcatttgcttattcgatactctcatctcaagagattccatttgagggccccactccaatgcattgcatttcatttcatttcatttcatatgctcctcctactggtttgttttcagatcaaaagccaagggttggggtttagattgtagagagagaaaggaagtaggaagagagagaaaggaagtaggaagagagagaaaggaagatggcgttggtttcttcgtccctctctctaacggctacagctacagctgctgctgcctcttcttcatcgagcacctcaaccgtcgatgcagggaggcaacagtttgtgatggggggaaggccaactcagtcctcgaggagctcatcagggtccctcaggaaatctccatttgttgtgagagctgcttctactccacctgtgaagcaaggagcagacaggcagctatggttcgcatctaagcagagcctttcttacttggatggcagcctccccggtgactatggcttcgaccccctcggcctctcggacccagagggcaccggcggcttcatcgagcccaaatggctggcctacggcgaggtcatcaacggccgctacgccatgctcggggccatcggcgccatcgccccggagatcctcggcaaggccggcctcatcccccccgagaccgccctcccatggttcaaaaccggcgtgatcccgcccgccgggacctacaactactgggccgaccccttcaccctcttcgtcttcgaaatggccctcatgggcttcgcggagcaccggaggttccaagactggtataaccctggctccatgggaaaacagtatttcttagggttggagaagtggcttgggggatcgggtgagccggcgtatcctggcggtccgattttcaatccattgggcttggcaaatgatgagaagagcaagaaggagatgaggttgaaggaggtgaagaatgggaggctggcaatgctggcgattgtggggtattttgtgcaagggttggtgactggggtggggccttaccagaacttgttagaccacttgtctgaccctctcaataacaactttctcactagcctcaagttccactagaccctacccttctcttctctgctctctatctctatctctatctctctctcttgacattcttgggatgaaagtttacttatatatataagtgggactgccttttgttgtctatggacactgatgtcaatgtgaattaagtgttctggtaaaaaatagtctctctctctatatgtgaattaagagcaatagtcacaaagtctctctttttccccccctctctctctctatgtgaattaagagctatggtcacaaagtgtctctttctctttctctctctctcattgtagtgtatttatgtaatgtatgaactaagaaaatgtgaattgcaaaaggtcagactccctccctctcttattgtaatgctggtgagatatgggccctcactttggaaaatgtatataatgaaactctttactttgggta

SEQ ID NO: 1746 - DNA, 989 bp, Eschscholzia californica
aaggagcaaacagcaaaagaagggaaaaaaaggaagaatggcaagccagactttgttatcatcttctctcacttcatcttcatcctcaatggatgttggtagacaacttttcagaggaacacccattaggtttttgagtgtaaaggttggttcatcaaggaaaggatcttttgttgttagagctgcttctactccacctgttaagcaaggagcaaacagacaactttggtttgcatccaaacagagcctttcttacttggacggcagcctcccaggtgacttcgggtttgacccgcttggactttcggatccagaaggaacaggaggtttcattgaacctaaatggcttgcctacggtgagatcatcaatggacgttttgccatgttgggtgcagccggtgcaatcgcaccagaggtctttggaaagcttggacttattcccgccgaaaccgctctcccatggttccaaaccggagtaatcccacctgccggaacatacaactactgggcagattcatacacactatttgtattggaaatggctttgatgggatttgctgagcacaggagattgcaggactggtacaaccccggatccatgggcaagcaatacttcttaggtttggagaagggtttcagtgggtcgggcgatccgtcttacccaggaggaccattctttaaccctctagggtttgggaaggatgagaaatcaatgaaagagttgaaattgaaggaagtgaagaatgggagattggctatgttagctgtcttgggttacttcatccaaggtttggtaacaggagttggaccttaccaaaacctcttggaccacttggctgacccagtcaacaacaacatcttgaccagccttaaattccattaggatgtataattatttgctattgtataattactatttgtaatggatattctctcagacatctttctgtcttacttgtatttttcatctctcatgtatgacaatttgt

SEQ ID NO: 1747 - DNA, 963 bp, Eschscholzia californica
aaagaaaggaagaatggcaagccagactttgttatcatcttctctcacttcatcttcatcctcaatggatgttggtagacaacttttcagaggaacacccattaggtttttgagtgtaaaggttggttcatcaaggaaaggatcttttgttgttagagctgcttctactccacctgttaagcaaggagcaaacagacaactttggtttgcatccaaacagagcctttcttacttggacggcagcctcccaggtgacttcgggtttgacccgcttggactttcggatccagaaggaacaggaggtttcattgaacctaaatggcttgcctacggtgagatcatcaatggacgttttgccatgttgggtgcagccggtgcaatcgcaccagaggtctttggaaagcttggacttattcccgccgaaaccgctctcccatggttccaaaccggagtaatcccacctgccggaacatacaactactgggcagattcatacacactatttgtattggaaatggctttgatgggatttgctgagcacaggagattgcaggactggtacaaccccggatccatgggcaagcaatacttcttaggtttggagaagggtttcagtgggtcgggcgatccgtcttacccaggaggaccattctttaaccctctagggtttgggaaggatgagaaatcaatgaaagagttgaaattgaaggaagtgaagaatgggagattggctatgttagctgtcttgggttacttcatccaaggtttggtaacaggagttggaccttaccaaaacctcttggaccacttggctgacccagtcaacaacaacatcttgaccagccttaaattccattaggatgtaactatttgctattgtataattactatttgtaatggatctcctctcagacatctttctgtcttacttgtatttttcatctctcatgtatgacaatttgt

SEQ ID NO: 1748 - DNA, 1333 bp, Brassica rapa
aaaacacaaacaaaatctcttatctaactcatgttgccacgtggacagatatagttggtgaagcagatactaatctaatctgaccaaaaccagttgggctatttcaaagccacaagtagttctaatggaccttgttccttctactctttaacactaggttccctgcagaccattattcaataatcatcgtctcttggtgacagaagaaaagagtttaagcaaaaaaaatggcagcacaagcgcttgtatcttcttcatttacctcctctgttcagaccgctagacagatattcggcgtaaaaccagctgtgtccgtatcacagaggaaggtttccttggttgttaaggctgcatcaactccacctgccaagcaaggagcaaacaggcaattgtggtttgcatcatcacagagtctctcttacttggatggcagcttacctggcgacttcggattcgatccgcttggtctttcagacccagagggtactggaggcttcatcgagccgagatggctagcctacggagagatcatcaacgggaggtttgctatgttgggtgcagctggagctattgcacctgagattctaggaaaggccggtctgattcctgcagacactgctcttccctggttccaaaccggtgtgattccacctgcagggacatacagctactgggcagacccttacacactctttgttctcgagatggctttgatgggatttgccgagcacaggaggttgcaggactggtacaacccaggatctatgggtaaacaatacttcttgggtctagagaaaggtttcgcgggttcaggtgacccggcttaccccggtggaccattcttcaaccctcttgggtttggaaaagacgagaagtcgatgaaggagttgaaactcaaggaggtcaagaacggtagactggcaatgctcgccatcctaggctactttgtgcagggattagtgaccggtgtggggccttaccagaaccttcttgatcatttggcggatcccgtcaacaacaatgtcttgaccagcctcaagttccactgagatgatcatatcgtattcatctcatggtgttttatgttggtttcccattctcttgtatcctacaatcttgtttgtttctcttggtaccatcagtttctttgtgttgtaacaccctgtgtaaacatattcgtcttttgtaagaaataatggccataaagaacaacttctaggattaatggttggtatttagaaataaccaagaaactcagttaacatatttaaaagaatgttatggaattatttacaagtaatgcttaaaaagaactcatctcaaagaatatcaa

SEQ ID NO: 1749 - DNA, 875 bp, Papaver somniferum
ttcatcttctcttacttcatcttcttcctcttcaatggaagctgctagacaagtattcagaggaagaccacttcaatatgcaactgttaacgttggctcttcaaggaagggttcatttgttgttagagctgctgccactccacctgttaagcaaggagcaaacagacagctttggtttgcatccaaacagagtctttcttacttagacggcagtctcccaggtgatttcgggtttgacccacttggactttcagatccagaaggaacaggaggatttattgaaccaaaatggctagcatatggtgaaattatcaacggacgttttgctatgttaggagcagcaggagcaatcgcaccggaagtcttcggcaaactcggacttatcccacctgaaaccgcactcccatggttccaaactggagtgattccacctgccggaacttacagttactgggcagaccccttcacactatttgtgctagaaatggctcttatgggttttgccgagcacaggagattgcaagactggtacaaccctggatccatgggcaaacaatatttcttaggtttggaaaagggtttgggtggatcaggtaaccctgcttacccgggtggacctttcttcaacccattaggatttggaaaagatgagaagtcaatgaatgaactgaaattgaaggaagtgaagaacggaagattagctatgttggccattttaggttatttcattcaaggtttagtcacaggagttgggcctttccagaacttgttggaccatttggctgatccagtcaacaacaatgtcttgaccagtctcaagttccactaaattctatgcccaggttcttgtactctgggacttcattctcttctct

SEQ ID NO: 1750 - DNA, 1091 bp, Brassica rapa
gttccttctactctttaacactaggttccctgcagaccattattcaataatcatcgtctcttggtgacagaagaaaagagtttaagcaaaaaaaatggcagcacaagcgcttgtatcttcttcatttacctcctctgttcagaccgctagacagatattcggcgtaaaaccagctgtgtccgtatcacagaggaaggtttccttggttgttaaggctgcatcaactccacctgccaagcaaggagcaaacaggcaattgtggtttgcatcatcacagagtctctcttacttggatggcagcttacctggcgacttcggattcgatccgcttggtctttcagacccagagggtactggaggcttcatcgagccgagatggctagcctacggagagatcatcaacgggaggtttgctatgttgggtgcagctggagctattgcacctgagattctaggaaaggccggtctgattcctgcagacactgctcttccctggttccaaaccggtgtgattccacctgcagggacatacagctactgggcagacccttacacactctttgttctcgagatggctttgatgggatttgccgagcacaggaggttgcaggactggtacaacccaggatctatgggtaaacaatacttcttgggtctagagaaaggtttcgcgggttcaggtgacccggcttaccccggtggaccattcttcaaccctcttgggtttggaaaagacgagaagtcgatgaaggagttgaaactcaaggaggtcaagaacggtagactggcaatgctcgccatcctaggctactttgtgcagggattagtgaccggtgtggggccttaccagaaccttcttgatcatttggcggatcccgtcaacaacaatgtcttgaccagcctcaagttccactgagatgatcatatcgtattcatctcatggtgttttatgttggtttcccattctcttgtatcctacaatcttgtttgtttctcttggtaccatcagtttctttgtgttgtaacaccctgtgtaaacatattcgtcttttgtaagaaataatggccataaagaacaacttctaggatta

SEQ ID NO: 1751 - DNA, 1051 bp, Brassica napus
ctgcagaccattattcaataatcatcgtctcttggtgacagaagaaaagagtttaagcaaaaaaatggcagcacaagcgcttgtatcttcttcatttacctcctctgttcagaccgctagacagatattcggcgtaaaaccagctgtgtccgtatcacagaggaaggtttccttggttgttaaggctgcatcaactccacctgccaagcaaggagcaaacaggcaattgtggtttgcatcatcacagagtctctcttacttggatggcagcttacctggcgacttcggattcgatccgcttggtctttcagacccagagggtactggaggcttcatcgagccgagatggctagcctacggagagatcatcaacgggaggtttgctatgttgggtgcagctggagctattgcacctgagattctaggaaaggccggtctgattcctgcagacactgctcttccctggttccaaaccggtgtgattccacctgcagggacatacagctactgggcagacccttacacactctttgttctcgagatggctttgatgggatttgccgagcacaggaggttgcaggactggtacaacccaggatctatgggtaaacaatacttcttgggtctagagaaaggtttcgcgggttcaggtgacccggcttaccccggtggaccattcttcaaccctcttgggtttggaaaagacgagaagtcgatgaaggagttgaaactcaaggaggtcaagaacggtagactggcaatgctcgccatcctaggctactttgtgcagggattagtgaccggtgtggggccttaccagaaccttcttgatcatttggcggatcccgtcaacaacaatgtcttgaccagcctcaagttccactgagatgatcatatcgtattcatctcatggtgttttatgttggtttcccattctcttgtatcctacaatcttgtttgtttctcttggtaccatcagtttctttgtgttgtaacaccctgtgtaaacatattcgtcttttgtaagaaataatggccataaagaacaact

SEQ ID NO: 1752 - DNA, 1115 bp, Raphanus sativus
  misc_feature (25)..(25): n is a, c, g, or t
gggttccttgtactcttaacattancttgcagaccattactgaaaaatcatctctcttggtgacagaagagaagagtctaagcaacagagcaaaaaatggcagcacaagcgcttgtgtcttcttcactaacctcctctgttcagaccgctagacagatattcggcacaaaaccagctgtgtcggtatcacaaaggaaggcttccttggttgttaaggctgcctcaactccacctgccaagcaaggagcaaacaggcaattgtggtttgcatcatcacagagtctctcttacttggatggcagcttacctggcgactttggatttgacccgcttggtctttcagacccagagggtactggagggttcatcgagccgagatggctagcctacggagagatcatcaacggccgtttcgctatgttgggtgcagctggagctattgcacctgagattctaggaaaggccggtctgattccagcagacactgctcttccctggttccagaccggtgtgattccacctgcagggacgtacagctactgggcagacccttacacactctttgttctcgagatggctttgatgggttttgctgagcacaggaggttgcaggactggtacaacccaggatctatgggtaaacaatacttcttgggtctagagaaaggtttcgccggttcaggtaacccggcttaccccggtggacctttcttcaaccctctagggtttggaaaagacgagaagtcgatgaaggagttgaaactcaaggaggtcaagaacggtagactggcaatgctcgccatccttggctattttatccagggactagtgaccggtgtgggaccttaccagaaccttcttgatcatttggcggatcccgtcaacaacaatgtcttgaccagcctcaagttccactgaggtgatcatatcatatcatatcatcccatggtgttgtctgttggtctcccattctcttgtatcctacagtcttgtttctttctctttggtaccatcagtttctttgtgttgtaacaccatgtgtaaacatattcgtcttttgtaagaaatgacaatatcagtggccataatgaaacaacttctaggattaatgaaaa

SEQ ID NO: 1753 - DNA, 1076 bp, Scabiosa columbaria
ctaagctaggcccctcactatcaatactttgtggcttgtacaatttgacattctcctttatattattctcatgttacttcaccaccattagacaacttaaactgcaacaagagttctcataacttgtacaacaatggcagcacaagcacttttatcgtcttcttcgtccattgtcgcttcggctgaagcttcgagacggttatttgcaagtggaagtagagccatacattcttcttcaagtaggggttcctttgttgttagggctgctgctactccacctgtcaagcaaggagcaaataggtccctctggtttgcatctaaacagagcctttcttacttggatggcagcctccctggtgactatggattcgacccacttggtctctcagacccagaaggcgcaggagggtttatagagccaaaatggttagcttatggagaggtaatcaacgggcggtttgctattcttggagctgccggagccattgcacccgagatttttgggaagctcggactcattccagcggagactgcactgccatggttccaaacaggtgtgatccctccggccggtacttacaattattgggccgacggttacactttgtttgtgttggaaatggcactgatgggatttgcagaacacaggagactacaagattggtacaacccagggtccatgggcaagcagtatttcttgggtcttgagaaaggtttttctgggtcaggtgacccggcttatccgggtgggcctttctttaatcctctaggatttgggaaagatgaaaagtcaatgaaagacttgaagctcaaggagatcaagaacggaaggttggccatgttggctattttgggttacttcattcaaggcttggtaactggggttggacccttccagaatcttctagatcatttggctgacccagttaacaacaatctgttaaccagcctaaagttccactagtttcgatttctcgcaatcttttctcattacttgtaaccggttacgcatcaagcggattttcaagattatgaattccacaatgttagatgtgtttgaagtgaaaattgttgac

SEQ ID NO: 1754 - DNA, 1176 bp, Ipomoea nil
acttggtggccttatttgccaccacctgttgtaacttgtaaggttgggttgtttctctccacagtatccagcagcaaaaatcacacagccaaagatggcagcacaggctttgatctcttcttcttccatcacctcttctgcagaggttgccaggcaggttcttggaggaaggcctctccaatcttccaggaaagtttcctttgttgtaagggcttcttcttctactccccctgtcaagcaaggagcagataggcctctctggtttgcatccaaacagagccttagctacttggatggcagccttcctggtgactatggctttgatccactggggctctcagacccggaagggacaggaggtttcattgagccgaaatggctagcatatggagagatcatcaacgggcgtttcgccatgttgggagcagcaggggctattgcaccagaggttcttggaaaggccggcctcattccggctgaaaccgccctcccatggttccagaccggagtaattcctccggcagggacatacaactactgggctgattcctacactctatttgttctggagatggctctcatgggattcgcggagcacaggagattccaggactgggcaaaaccaggttcaatggggaagcagtacttcctaggactagagaaaggcttaggaggctcaggcgatccggcataccccggtggacctatcttcaacccccttggatttggaaaggatgagaaatcaatgaaggatttgaagctgaaggaagtgaagaatggaagattggcaatgttggccatcctgggatacttcatccaagctctggtgactggtgttggcccataccaaaaccttcttgaccatttggctgatcctgtcaacaacaacatcttgaccaaccttaaattccactaaacttgtagcaaaccaccatttcttcttcacagatctgtcgacattattttgcatgtcatctgtattccacaaggacatgtaccaattgaaaccctgcaactattcagagttgtagtcagaaaatttcactgtattatcatctgtcagtcagttgggcaaatatgactagaagaagtccaaggaaaattttccatggaactaaaccacataaattaacagtgcggatgaaaattatattcaactttacatgtaaaaactgt

SEQ ID NO: 1755 - DNA, 982 bp, Flaveria ramosissima
atatctttctagaaatagccacacaagcattggcttcatcatcatcactcacctcctcagttgagtctgcaaggcagatccttggagctagaccacttcacacaccaacaagaaagatctcttttcttgtcaaagctgcttccacccctcctgttaagcaaggagcagacagacaactgtggtttgcatccaaacagtctctttcttaccttgatggaagtctcccaggtgactttggatttgacccacttggtctttcagacccagaagggaccggtgggttcatcgaacccaagtggctagcttacggagaggttatcaacggacggttcgccatgttgggtgcagccggagccattgcacccgagattcttggcaagctcgggctcatcccagccgaaaccgccctcccatggttcaagacaggtgtcatccccccagccggaacatacgactactgggccgacccattcaccctatttgtattagaaatggcacttatgggctttgccgaacacagaagactccaagattggtacaacccgggttcaatgggaaaacaatactttttgggcctagagaaagggttctccgggtcgggtgaccccgcctacccgggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgatccagtcaacaacaatgtgttgaccagccttaagtttcactagagtcactatcttccttcctatatgtaatatcatgtgcagaatttcttgaaatattattattaatttgtgacgggtttaatgatatgttaaggataccaaaaccttgttgtaatatgtagttactaaacatgtttgtttgtgcatgc

SEQ ID NO: 1756 - DNA, 999 bp, Flaveria ramosissima
accgaaacaacctagcaatatctttctaagaaaataggccacacaagcattggcttcatcatcatcactcacctcctcagttgagtctgcaaggcagatccttggagctagaccacttcacacaccaacaagaaagatctcttttcttgtcaaagctgcttccacccctcctgttaagcaaggagcagacagacaactgtggtttgcatccaaacagtctctttcttaccttgatggaagtctcccaggtgactttggatttgacccacttggtctttcagacccagaagggaccgtgggttcatcgaacccagtggctagcttacggagaggttatcaacggacggttcgccatgttgggagcagctggagccattgcacccgagattcttggcaagctcgggctcatcccagccgaaaccgccctcccatggttcaagacaggtgtcatccccccagccggaacatacgactactgggccgacccattcaccctatttgtattagaaatggcacttatgggctttgccgaacacagaagactccaagattggtacaacccgggttcaatgggaaaacaatactttttgggcctagagaaagggttctccgggtcgggtgaccccgcctacccgggcggcccgttcttcaacccgttagggttcggaaaagatgagaagtcaatgaaggaattgaagctaaaagagatcaagaatggtagattggctatgttggccattttgggctacttcattcagggtttggtgactggtgttgggccttatcagaaccttttggaccatttggctgacccagtcaacaacaatgtgttgaccagccttaagtttcactagagtcactatcttccttcctatatgtaatatcatgtgcagaatttcttgaaatatttattattaatttgtgtacgggttaatgatatgttaaggataccaaaccttgttgtaatatgtagttactaaacatgtttgtttgtgcatg

SEQ ID NO: 1757 - DNA, 1004 bp, Fraxinus spp
cgaaaatggcaactcaagcactgttgtcttcatcatccatcagcttgtccggtgaggtcgccagacagattcttggaagaaggccggtccaatcttcgaggaaggcttccttcgtcgtgaaggctgcttctactcctcccgtcaagcaaggagcagacaggcagctctggtttgcatccaagcagagtctttcctacttggatggcagcctccctggtgactatggattcgatccattgggactctctgatcctgaaggtactggaggattcattgagcccagatggctagcctacggagaaatcttcaatgggcgttgcgcaatgatgggtgcaataggagccattgcgcccgaaattcttggaaaggctggcttaattccagcagaaacagccctcccatggttcaagaccggagttattcctccagctggaacatataactactgggccgataactataccctatttgttttcgaaatggcacttgtgggattcgcagagcaccggagattccaggactgggccaatccagggtccatgggcaagcaatatttttgggtttggagaaggattgggagggtcggtgaccctgcatacccaggtggcccctttttcaacccgttggggttcggtaaagacgagaaatccatgttcgagttgaaggtgaaggaagtgaagaatggaagattggctatgttggcaatcttgggttactttatacaagctttggtgactggggttggtccctaccaaaacctgctggaccatttggcggatcctgtgaacaacaatgtcttaaccagcctcaaattccactaaattgtagtcgtatgatatctctttctctcagatttgtaatatcatgtgtgcagataattcagcatctcatatgtaatctacaaactccagatatgttcacgacttggaaacttttgttagtacttttaatgatgtttcgtattgtacgtgctttcggaatgttattgatgtcgtttgtctgcc

SEQ ID NO: 1758 - DNA, 1050 bp, Vinca minor
attgatctcctcatcatctattactgcttctgcagaagccacaagacagattctaggagcaaggtctcttcaatcctcctcaaggaaagtctcctttgttgtcagagctgcatcttcaccccctgttaagcaaggagacaggcaactgtggtttgcatccaaacagagcctttcttacttggatggcagtctccctggtgactatggatttgatccattggggctttcagaccctgaaggtaccggaggcttcatcgagcctaaatggctagcttatggagagatcatcaacgggcgatatgccatgttgggagcagtaggagccatagcacctgagattctagggaaagctggcctcattccagctgaaacagccctcccatggtttcaaacaggagtgattcctcctgctggaacatacagctactgggctgacaattacaccctattcgtcctggaaatggcactaatgggatttgctgagcacaggagattccaggactgggctaagccaggatgtatgagcaagcagtacttcctgggatttgagaaatacttgggaggctctggtaacccagcataccctggaggccccatcttcaaccctcttgggttcggaaaagatgagaaatcaatgaaggacttgaagttgaaggaggttaagaatggaaggttggctatgttggcaatattgggttactttgtacaaggattggtgactggagttggtccctaccaaaaccttctggatcatttgtctgatccagtgaacaacaacatattgaccagcctcaagttccactaaaatggcagcagctctcctctctctctaccctctttccccctaccagatttgtaactcatgtgcagatattttcagcatgtcatctgtaatatgtaacaaaagacatgttcaggcccttgaataccatgaacaattcagagcagcgaaaagtttgtagttaatgactgctattttcacttcccatatctgtccactatccacaacaatatacacacccaaagtactcacacagaaatggatcaact

SEQ ID NO: 1759 - DNA, 1017 bp, Helianthus annuus
actgtttcagaaaatggcaacacaagcgttggcttcctcatcatcactcacctcctcagtggagtctgcaaggcaaatccttggagctaggccacttcacacttcttcaagaaaggtctcttttcttgtcaaagctgcatccacccctcctgttaagcaaggagcaaacagacaactttggtttgcatccaagcaatctctttcttacttggatggaagtctcccaggtgactatggatttgacccacttggtctttcagacccagaaggtactggaggattcattgaacccaagtggctagcttatggagaggttatcaacggtcggttcgccatgttgggtgcagctggagccattgcacctgagatatttggcaagcttgggctcatcccagccgaaaccgccctcccgtggttcaagaccggtgtcatccccccagcaggcacatacgactactgggcagaccctttcaccctgtttgtatttgaaatggcacttatgggttttgcagaacacagaagactacaagactggtacaaccctggttcaatgggaaaacaatactttttgggcttggagaaaggttttgccgggtcgggtgacccagcatacccaggtgggccgtttttcaacccattagggtttggaaaagatgagaagtcaatgaaggaactgaagcttaaagagatcaagaatggtagattggctatgttggccattttgggttacttcattcagggtttggtgactggtgttggacctttcgagaaccttctggatcatttggctgatccagtcaacaacaacgtcttgaccagccttaagttccactagagacttttaaatgtaatatcatgtgcagtattttctaaatgatattattaatttgtaacgaaattaatgtgatatgttaaggagccaaaaccttgttgtaatatgtagttcctacatatgtgttgtttgtgcacgtgcatgtacttactgaaaacggactatgatattatatatgaaggatt

SEQ ID NO: 1760 - DNA, 1009 bp, Helianthus annuus
ttcagataatggcaacacaagcattggcttcatcatcatcactcacctcctcagtggagtctgcaaggcaaatccttggagctaggccacttcacacatcttcaagaaaggtctcttttcttgtcaaagctgcatccacccctcctgttaagcaaggagcaaacagacaactttggtttgcatccaagcaatctctttcttacctggatggaagtctcccaggtgactatggatttgacccacttggtctttcagacccagaaggtactggtggattcattgaacccaagtggctagcttatggagaggttatcaacggtcggttcgccatgttgggtgcagctggagccattgcacctgagatatttggcaagcttgggctcatcccagctgaaaccgccctcccgtggttcaaaaccggggtcatcccaccagcgggcacatacgactactgggcagaccctttcaccctgtttgtattcgaaatggcacttatgggttttgcagaacacagaagactacaagactggtacaaccctggttcaatgggaaaacaatactttttgggcttggagaaaggttttgccgggtcgggtgacccagcatacccaggtgggccgtttttcaacccattagggtttggaaaagatgagaagtcaatgaaggaattgaagcttaaagagatcaagaatggtagattagctatgttggccattttgggttacttcattcagggtttggtgactggtgttggacctttcgagaaccttctggatcatttggctgatccagtcaacaacaatgtcttgaccagccttaagttccactagagacttttaaatgtaatatcatgtgcagtattttctaaatgatattattaatttgtaacgaaattaatgtgatatgttaaggagccaaaaccttgttgtaatatgtagttcctacatatgtgttgtttgtgcccgtgcatgtatttactgaaaacggactatgatattatatatgaagg

SEQ ID NO: 1761 - DNA, 941 bp, Helianthus annuus
cagaaaatggcaacacaagcgttggcttcatcatcatcactcacgtcctcagtggactctgcaaggcaaatccttggagctaggccacttcacacatcttcaagaaaggtctcttttcttgtcaaagctgcatccacccctcctgttaagcaaggagcaaacagacaactttggtttgcatccaagcaatctctttcttacctggatggaagtctcccaggtgactatggatttgacccacttggcctttcagacccagaaggtactggtggattcattgaacccaagtggctagcttatggagaggttatcaacggtcggttcgccatgttgggtgcagctggagccattgcacctgagatatttggcaagcttgggctcatcccagccgaaaccgccctcccatggttcaaaaccggggtcatccccccagcgggcacatacgactactgggcagaccctttcaccctgtttgtatttgaaatggcacttatgggttttgcagaacacagaagactacaagactggtacaaccctggttcaatgggaaaacaatactttttaggcttggagaaaggttttgccgggtcgggtgacccagcatacccaggtgggccgtttttcaacccattagggtttgggaaagatgagaagtcaatgaaggaattgaagcttaaagagatcaagaatggtagattggctatgttggccattttgggttacttcattcagggtttggtgactggtgttggacctttcgagaaccttctggatcatttggctgatccagtcaacaacaatgtcttgactagccttaagttccactagagacttttaaatcttccttcttctatgtaatatcatgtgcagtattttctaaatgatattactaatttgtaacgaaatttatgtgatatgttaaggagccaaaagcttgttgt

SEQ ID NO: 1762 - DNA, 1232 bp, Curcuma longa
ctcgtgccgaattctaaaattatttcttttttactacataacatcacttcttatgcaacaaaaaattaaaagactgtcgttttacacgacagccttttaagctataactctatttatttttcttcgcttcaatttttgcttgcgcctattcggcacgaggagatcgagagcgtggaattaatggcgactcaggctcttctgtctgcgaggcagctgctagggggaaccccactccactccgccccctccaggtctccgaggaaggcgaccttcgtcgttagggcagctgccactcctcctgtgaagcaaggagcagatagacagctctggttcgcgtccaagcagtcactctcctacttggacggaagtcttcccggcgactatgggtttgatccgttggggctgtcggacccggagggcaccggcgggttcatcgagccgagatggctggcctacggagagatcttcaacgggcggaccgccatgatgggggtggtcggctgtctggcgccggagatcctgggtaagctggggctgatcccgccggagacggcgctcccatggttcaggaccggcgtgatcccgccggcggggacgtacacctactgggccgacaactacacgctgttcgtgttcgagatggcgctggtggggttcgcggagcaccggcggttccaggactgggccaacccgggctccatggggaagcaatacttcctggggctggagaaagggctgggcggctccggcgacccggcctaccccggcggacccttcttcaacccgctgggcctcggcaaggacgagaagtcgatgagggacctgaaggtgaaggaggtcaagaacggccggctggcgatgatggccatcgtcggcttcttcatccaggcgtgggtcaccggagaagggccgttccaaaacctgctggatcacttggccgatccctttaacaacaacatcttgaccaacctcaagttccactgagcacgcttctcgatcggaaagttgctaaattgggaaaggaatctttgtaatttccagttaaggaattaagggatctgtaattaatatccagtttaagggatctgtcggacatgcctttgctttgctgtgtacatgaagatggcagttagatagattgaccaaatctagtgccagtatctaaagtcaaccaaaaatgaattaaaaaacatatttgaacctcgtgccgaattcggcacgaggcttcgtgc

SEQ ID NO: 1763 - DNA, 1637 bp, Eucalyptus grandis
tttctacattgctgcagggtatgtacgagacattgttgactcgtattatatcttgctatatactttcgctataaaagagaatttgagaggtcataaaattactaaaaaacatcaaatgccacgtgggacaaactgaattgtccttggtccaggaactgccacctgggatttgggaacgaccccccacaaatcagcaattgatcttcttatctgagccgtggcatcacgtggatggtcctcgttggacggccagatcctaaccttatcaggaagccactggccacctctcgctcgcctgaattttccccgaccccactcggaagtagtggcctcgcttcgccctcttgtatatttcttgttggcctgtgcaggacttagccattctcccttgatagctcttcattctccatctctttgtttgagctccatagtttgggaaggaagcaaatggcggcacaagctcttgtatcctcgtcgctcacctcctccgttgagtcggcgaggcacctgctaggggcgaggcccgccgctccctcaaggaaggcctcgttcgtcgttagagccgcttcgactccacccgtcaagcaaggatcagacagacaattgtggtttgcatccaagcaaagccttacatacttggacggaagcctccctggtgacttcggcttcgacccgttgggtctttcagaccccgagggcaccggagggttcatcgagcccaggtggctagcctacggagagataatcaatgggcgattcgctatgttgggcgccgttggatcgattgcaccagagattctagggaaggctgggttgatcccaccggaaactgctctcccatggttcaggactggcgtaatcccaccagccgggacatacaactattgggccgacaactacacgctcttcgtgttggagatggccctcatgggcttcgccgagcacaggaggttccaagactgggccaagccgggctcaatgggcaaacagtacttcctagggctcgagaagggcttggccggctcgggagacccagcataccccggtggccccttcttcaaccctctagggtttggcaaagatgagaagtcaatgaaggacttgaagctgaaggaggtgaagaatgggaggttggcgatgttggccatcgtgggctacttcatccaagccctcgtgactggtgttgggccttaccaaaacctcttggatcacctggctgacccagtcaacaacaacattctaaccaacctcaagttccattagggttttaagtacttcccttctgtgtcaccaccgcccccccttgtgatatcgtagtttcatgtgaaaagaggtttgaatgagggatcaatgtggaaccttgacgtgtaaaaaactgaaaactgcacttctaaatagcagtgccttgacagttgctcttgcattcgagaggagaatgagatcagatcgagctaaacttggttttccctgaacctacagaatcacatatgtaggaagattgtttattgttcgagatggcacgggtcatgggttgttcatagtgactagaacatagtgcatgaatggcaatggttctgatgactcaaatgtttttattttaaccaagcaaatgataatgatttgcaaaaaaaaaaaaa

SEQ ID NO: 1764 - DNA, 1123 bp, Cajanus cajan
aacgcagagtacgggggcgggccaaactagtggccaaccgtgttccaccctttggcttattagtcactgccttagatatcattcattcctaaccactgagtacaacaaactctcttttgctgcagcagagccaaagcatggctgcacaagctctagtatcttcatcctctcttaccttctcagccgaggctgcaagacagagtcttggagcaagatcacctcaagggttctccagaaaagcctcctttattgttaaggcagcttcgactccccctgtcaagcaaggagcagacagacctttgtggtttgcatcaaagcaaagtctttcttacttggatggcagcctaccaggtgactacggatttgaccctctaggactttcagaccctgaaggaacaggagggttcatcgagccaaaatggctagcatatggtgaaatcatcaacggtcggtacgcaatgttgggtgcagttggtgccattgcacctgaaattcttggcaaagccggtctgatcccacaggaaacagcactcccatggttcaaaaccggtgtgatcccacctgcaggaacatacaactactgggcagactcctacacactctttgtgtttgagttggcgctaatggggtttgcagagcacagaaggttccaagactgggccaaacctggctctatggggaaacaatacttcttaggactagagaagggtcttggaggttctggtgagccagcttaccctggaggacccttctttaaccctcttggctttggcaaggatgagaagtccttgaaggatttgaagctgaaggaagtgaagaatggaaggttggctatgttggcaatattgggttactttgttcaggctctcgtgacaggggaaggaccataccaaaacctcctagatcacctggctgaccctgtgcacaacaacgtcttgaccagcctcaagttccactgaatgtattatatgttgttacatattctttactcccttcctcatctttcaatatcctcctctctgctctttgagactggactgtaccatcatgtcgaccttttgttccttgctgtggctctgtaagaattgacatgtaaaacaactagagacattcgacatcttct

SEQ ID NO: 1765 - DNA, 1335 bp, Cajanus cajan
cattcaatatccaccaggagttccacactgctcgtacatgcgggccaaactagtggccaaccgtgttccaccctttggcttattagtcactgccttagatatcattcattcctaaccactgagtacaacaaactctcttttgctgcagcagagccaaagcatggctgcacaagctctagtatcttcatcctctcttaccttctcagccgaggctgcaagacagagtcttggagcaagatcacctcaagggttctccagaaaagcctcctttattgttaaggcagcttcgactccccctgtcaagcaaggagcagacagacctttgtggtttgcatcaaagcaaagtctttcttacttggatggcagcctaccaggtgactacggatttgaccctctaggactttcagaccctgaaggaacaggagggttcatcgagccaaaatggctagcatatggtgaaatcatcaacggtcggtacgcaatgttgggtgcagttggtgccattgcacctgaaattcttggcaaagccggtctgatcccacaggaaacagcactcccatggttcaaaaccggtgtgatcccacctgcaggaacatacaactactgggcagactcctacacactctttgtgtttgagttggcgctaatggggtttgcagagcacagaaggttccaagactgggccaaacctggctctatggggaaacaatacttcttaggactagagaagggtcttggaggttctggtgagccagcttaccctggaggacccttctttaaccctcttggctttggcaaggatgagaagtccttgaaggatttgaagctgaaggaagtgaagaatggaaggttggctatgttggcaatattgggttactttgttcaggctctcgtgacaggggaaggaccataccaaaacctcctagatcacctggctgaccctgtgcacaacaacgtcttgaccagcctcaagttccactgaatgtattatatgttgttacatattctttactcccttcctcatctttcaatatcctcctctctgctctttgagactggactgtaccatcatgtcgaccttttgttccttgctgtggctctgtaagaattgacatgtaaaacaactagagacattcgacatcttcttctctttttgctccttaatcttttatttgagccttctctcacaagaaagaatctttacataattaatctagttaacatcggatctggcgacaatgtagttgaactggaatgaatccatccaaatacacaaatgtgcaacttttaaggcaatagcttaactaaacggatcaggattctcagttctcatcg

SEQ ID NO: 1766 - DNA, 1118 bp, Solanum phureja
cacttggtggcctatacctttgtcccttttattgcttgccaccttgtgtctactactcttgggaagttgagtgcttattcttcttcaacacaagtcaattgttttaatcagaaaacaaaaaatggcaacacaggcattgatatcctcatcatctattgcatcctcaacagaggctgccagacaaattctaggaggaagacctttccaatctccaatcaagaaggcttccttagttgtaagggctactgccactccacctgttaagcaaggagcaaataggcctctctggtttgcatccaagcagagcctttcatacttggatggcagccttcctggtgactatggatttgatcccctgggactgtcagaccctgaaggtactggaggtttcatcgaaccaaaatggctagcatatggagaggtcatcaatggaagatttgctatgttgggggtagtaggagccattgcgcccgagattcttgggaaggctggtctcatcccagcagagacagcccttccatggttccagacaggagtgattcctccagctggaacatacaactattgggcggatggttacacgctatttgtattggagatggcactcatgggatttgctgaacacagaagattccaggactgggcaaagccaggttctatgggtaaacaatactttttggggctagagaaaggcttgggaggatctggagacccagcataccctggtggacctttctttaaccctctcgggttcggaaaagatgagaagtctatgaaggagttgaagctcaaggagattaagaatggaagactagctatgttgggtatcttgggttacttcattcaaggtttggtaactggtgttggaccttaccaaaacctccttgaccatttggctgaccctgtaaacaacaatgtcttgaccagcctcaagttccactaaacaaggagcaaatcaccctgttttagctaccctgatctgatatgtaaacattatgtgcagatattattttgcatatcattgtaatcagctaaaaaggacatgtcaactcaaaaatctgtttttcctgagttttagctgttagcttcctgctgcagtttctgcagcattctttagg

SEQ ID NO: 1767 - DNA, 1052 bp, Helianthus annuus
ccaccagtaccttctgggtcagaaagaccaagtggggcacaaccatccttcttctaactgtttcaagaaaatggcaacacaagcgttggcttcctcatcatcactcacctcctcagtggagtctgcaaggcaaatccttggagctaggccacttcacacgtcttcaagaaaggtctcttttcttgtcaaagctgcatcgacccctcctgttaagcaaggagcaaacagacaactttggtttgcatccaagcaatctctttcttacctggatggaagtctcccaggtgactatggatttgacccacttggtctttctgacccagaaggtactggtggattcattgaacccaagtggctagcttatggagaggttatcaacggtcggttcgccatgttgggtgcagctggagccattgcacctgagatatttggcaagcttgggctcatcccagccgaaaccgccctcccgtggttcaagaccggtgtcatccccccagcgggcacatacgactactgggcagaccctttcaccctgtttgtatttgaaatggcacttatgggttttgcagaacacagaagactacaagactggtacaaccctggttcaatgggaaaacaatactttttgggcttggagaaaggttttgccgggtcgggtgacccagcatacccaggtgggccgtttttcaacccattagggtttggaaaagatgagaagtcaatgaaggaattgaagcttaaagagatcaagaatggtagattggctatgttggccattttgggttacttcattcagggtttggtgactggtgttggacctttcgagaaccttctggatcacttggctgatccagtcaacaacaatgtcttgaccagccttaagttccactagagacttttaaatgtaatatcatgtgcagtattttctaaatgatattattaatttgtaacgaaattaatgtgatatgttaaggagccaaaaccttgttgtaatatgtagttcctacatatgtgttgtttgtgcacgtgcatgtacttactgaaaacggact

SEQ ID NO: 1768 - DNA, 1100 bp, Helianthus annuus
tcttccgatctccaccctccaccctctcccttatgtctcccacctatcattcactaacggtggcacaaccatccttcttctaactgtttcaagaaaatggcaacacaagcgttggcttcctcatcatcactcacctcctcagtggagtctgcaaggcaaatccttggagctaggccacttcacacgtcttcaagaaaggtctcttttcttgtcaaagctgcatcgacccctcctgttaagcaaggagcaaacagacaactttggtttgcatccaagcaatctctttcttacctggatggaagtctcccaggtgactatggatttgacccacttggtctttctgacccagaaggtactggtggattcattgaacccaagtggctagcttatggagaggttatcaacggtcggttcgccatgttgggtgcagctggagccattgcacctgagatatttggcaagcttgggctcatcccagccgaaaccgccctcccgtggttcaagaccggtgtcatccccccagcaggcacatacgactactgggcagaccctttcaccctgtttgtatttgaaatggcacttatgggttttgcagaacacagaagactacaagactggtacaaccctggttcaatgggaaaacaatactttttgggcttggagaaaggttttgccgggtccggtgacccagcatacccaggtgggccgtttttcaacccattagggtttggaaaagatgagaagtcaatgaaggaattgaagcttaaagagatcaagaatggtagattggctatgttggccattttgggttacttcattcagggtttggtgactggtgttggacctttcgagaaccttctggatcacttggctgatccagtcaacaacaatgtcttgaccagccttaagttccactagagacttttaaatgtaatatcatgtgcagtattttctaaatgatattattaatttgtaacgaaattaatgtgatatgttaaggagccaaaaccttgttgtaatatgtagttcctacatatgtgttgtttgtgcacgtgcatgtacttactgaaaacggactatgatattatatatgaaggatt

SEQ ID NO: 1769 - DNA, 1070 bp, Tamarix hispida
  misc_feature (774)..(774): n is a, c, g, or t
ggggaagcctctgccttccacaattttatcgactgcctcgcctcgcctcctctttcatttggctttattattacctgaaattgaaacagagaagacaggggtaacgaggagaggttgttcttcaaaataggaatggctactcaggctctggtctcatcatcttcactgacgtcttcagtggagactgcaagacaaattgtgggaagcaggcctcttcaggggtcttcatcgaggaagagctctttcgttgttagagcatcctcgagtcctcctgttaagcaaggagacagacaattgtggtttgcatctaaacaaagcctttcgtacttggatggcagccttccaggtgacttcgggtttgatcccctcggtttatcagatcctgaaggaaccggagggttcatcgagccaaaatggctggcctacggtgagatcatcaacggacgttttgctatgttgggagcagccggtgctattgcacctgagatcctcggcaaggctggactcatccctgcagaaaccgccctcccttggttccagaccggtgtaatcccacctgcgggtacatacaactactgggcagacccatacacattgtttgtcctagagatggcactcatgggatttgcagagcacaggagattccaggactgggcaaagccagggtctatgggcaagcaatacttcttggggttggaaaagtacttgggtggatctggtgaccctgcatacccaggaggccctttctttaaccctctgggctttggaaaagangagaaatcaatgaaggatctcaagctgaaggaggtcaagaatggcagactggctatgttggcgatcttgggttactttgtgcaaggacttgtgactggagttggcccttaccagaacctccttgatcatttggccgaccctgttaacaataacatcttgaccagtctcaaattccactagatttgccatctacatttgcatgtcaatatcttgtctacctatgtaatcaaactctgtaatagatgacacctctaaggattgaaatggctactatgttaccttcaatcagcgcatct

SEQ ID NO: 1770 - DNA, 1110 bp, Solanum lycopersicum
atgtccaccacaacttctctgttttccattagccccacactacacttgctggcctatacctttgtcccttattttgcttgccaccttgtgtctactactcttggaagctgagtgtgtattcatcttcaacacaagtcaattgctctaatcagaaaacaaaagatggcaacacaggcattgatctcttcatcatctattgcatcctcaacagaggctgccagacaaattctaggaggaagacctttccaatctcaaatcaagaaggcttcctttgttgtaagggctactgccactccacctgttaagcaaggagcaaataggcctctctggtttgcctccaagcagagcctttcatacttagatggcagccttcctggtgattatggatttgatcccctgggactgtcagaccctgaaggtactggaggtttcattgaaccaaaatggctagcatatggagaggtcatcaatggaagatttgctatgttgggagtagtaggagccattgcgcccgagattcttggaaaggctggtctcatcccaccagagacggcccttccatggttccaaacaggagtgattcctccagctggaacatacaactattgggcagacggctacacactatttgtactggagatggcactcatgggatttgctgaacacagaagattccaggactgggccaagccaggttctatgggtaaacaatactttttgggactagagaaaggcttgggaggttctggagacccagcatacccaggtggacctttctttaaccctctcgggttcggaaaagatgagaagtctatgaaggacttaaagctaaaggagattaagaatggaagactagctatgttgggtatcttaggttacttcattcaaggtttggtaactggagttggaccttaccaaaacctccttgaccatttggctgaccctgcaaacaacaatgtcttgaccagcctcaagttccactaaacaaggagcaaatcaccctgttttagctaccctgatctgatatgtaaacattatgtgcagatattattttgcatatcattgtaatcagctaaaaaggacatgtcaacaaaaacctgtttttcctga

SEQ ID NO: 1771 - DNA, 909 bp, Brassica juncea
cttgtgtcttcttcacttacctcctctgttcagaccgctagacagatattcggcgcaaaaccagctgtgtccgtatcacagaggaaggtttccttggttgttaaggctgcctcaactccacctgtcaagcaaggagcaaacagaccattgtggtttgcatcttcacaatctctgtcttacttggatggcagcttacctggcgactatggattcgacccgcttggtctttcagacccagaaggtactggaggtttcatcgagccaagatggttagcctacggagagatcatcaacggaaggttcgctatgttaggtgcagctggagctattgcccctgagattcttggcaaagcaggtttgattccagcagacactgcccttccttggttccaaaccggtgtgattccacctgcagggacatacagctactgggcagacccttacacactctttgttctcgagatggctttgatgggatttgctgagcaccggaggttgcaggactggtacaacccaggatcaatgggaaaacagtacttcttgggcctagagaaaggttttgccggttcgggtgacccgtcttacccgggtggacctttctttaaccctcttgggtttgggaaagacgagaagtcgatgaaggagttgaaactcaaggaggtcaagaacggtagactggctatgctcgcaatcctaggctattttgtgcagggactagtgaccggtgtggggccttaccagaaccttcttgatcatttggcggatccagtcaacaacaatgtcttgaccagccttaagttccactgagatgatcatcacatcatcccatgtgttttatgttggtctctcattcccttgtatccttcaatcttgttgctttctcttggtatcaccagcttcgtcgtattg

SEQ ID NO: 1772 - DNA, 935 bp, Papaver somniferum
gagacttgaagaaaacaatggcaacccagactttggtttcatcttctcttacttcatcttcttcctcttctatggaagctgctagacaagtattcagaggaagaccacttcaatatgcaactgttaacgttggctcttcaaggaagggttcatttgttgttagagctgctgccactccacctgttaagcaaggagcaaacagacagctttggtttgcatccaaacagagtctttcttacttagacggcagtctcccaggtgatttcgggtttgacccacttggactttcagatccagaaggaacaggaggatttattgaaccaaaatggctagcatatggtgaaattatcaacggacgttttgccatgttaggagcggcaggagcaatcgcacccgaagtcttcggcaaactcggtcttatcccacctgaaaccgcactcccatggttccaaactggagtgattccacccgccggaacatacagttactgggcagaccccttcacactatttgtactagaaatggctcttatgggttttgctgagcacaggagattgcaagactggtacaaccctggatccatgggcaaacaatatttcttaggtttggaaaagggtttgggtggatcaggtaaccctgcttacccaggaggacctttctttaacccactaggatttggaaaagatgagaagtcaatgaatgaattgaagttgaaggaagtgaagaatggaagattagctatgttggctattttaggttatttcattcaaggtttagtcacaggagttggacctttccagaacttgttggaccatttagctgatccagtcaacaacaatgtcttgactagtctcaagttccactaaatttctctgcccaggttcttgtaccatgagacttcattattcccttctctacttttcttttatctccta

SEQ ID NO: 1773 - DNA, 1024 bp, Brassica juncea
atcgtctcttggtgacagaagagaagagtttaagcaaaaaaaatggcagcacaagcgcttgtatcttcttcacttacctcctctgttcagaccgctagacagatattcggcgcaaaaccagctgtgtccgtatcacagaggaaggtttccttggttgttaaggctgcatcaactccacctgccaagcaaggagcaaacaggcaattgtggtttgcatcatcacagagtctctcttacttggatggcagcttacctggcgacttcggattcgatccgcttggtctttcagacccagagggtactggaggcttcatcgagccgagatggctagcctacggagagatcatcaacgggaggttcgctatgttgggtgcagctggagctattgcacctgagattctaggaaaggccggtctgattcctgcagacactgctcttccctggttccaaaccggtgtgattccacctgcagggacatacagctactgggcagacccttacacactctttgttctcgagatggctttgatgggatttgccgagcacaggaggttgcaggactggtacaacccaggatctatgggtaaacaatacttcttgggtctagagaaaggtttcgccggttcaggtgacccggcttaccccggtggaccattcttcaaccctcttgggtttggaaaagacgagaagtcgatgaaggagttgaagctcaaggaggtcaagaacggtagactggcaatgctcgctatcctaggctattttgtgcagggactagtgaccggtgtggggccttaccagaaccttcttgatcatttggcggatcccgtcaacaacaatgtcttgaccagcctcaagtttcactgagatgatcatatcgtattcatcccatggtgttttatgttggtatcccattctcatgtatcctacaatcttgtttctttctctttggtaccaccagcttctttgtgttgtaacaccctgtgtaaacatattcgtcttttgtaagaaatgacaatgtcaatgg

SEQ ID NO: 1774 - DNA, 1066 bp, Brassica juncea
agcactgtcttgcagaccataactgaaccatcatcatcatctcttggtgacacaagcgaagagttcaaggactagagttaaaatggctgcacaagcccttgtgtcttcttcacttacctcctctgttcagaccgctagacaaatattcggcacaaaaccagctgtgtccgtgaggaagacttcctttgttgttaaggctgcctcaactccacctgtcaagcaaggagcaaacagaccattgtggtttgcatcttcacaatctctgtcttacttggatggcagcttacctggcgactatggattcgaccctcttggtctttcagacccagagggtactggaggattcatcgaaccgagatggttagcctacggagagatcatcaacggacggttcgctatgttgggtgcagctggagctattgcccctgagattcttggcaaagctggtttgattccagcagacactgcccttccttggttccaaaccggtgtgattccacctgcagggacgtacagctactgggcagacccttacacactctttgttctcgagatggctttgatgggatttgctgagcaccggaggttgcaggactggtacaacccaggatcaatgggcaaacagtacttcttgggcttagagaaaggttttgccggttcgggtgacccgtcttacccgggtggacctttctttaaccctcttgggtttggaaaagacgagaagtcaatgaaggagttgaaactcaaggaggtcaagaacggtagactggcgatgctcgccatcctaggctattttgtgcagggactagtgaccggtgtgggaccttaccagaacctacttgatcatttggcggatcccgtcaacaacaatgtcttgaccagcctcaagttccactgagatgatcatatcatatcatcccatggtgttttatgttggtatcccattctcatgtatcctacaatcttgtttgtttctcttggtaccaccagcttctttgtgttgtaacaccctgtgtaaacatattcgtcttttgtaagaaataatggccataaagaacaacttact

SEQ ID NO: 1775 - DNA, 1299 bp, Tropaeolum majus
acaaacatgtatattgatggtcaagagtgtgccacgtggcaatagaacttgtgttgttctacaaaatcaatatctcttatccaatcaatgatgccacgtgtacaaccattgttggacaccaagatcctaccctaatctcaaaactcaacacttatatttcccccaaaccatctcaagaccacacaagtagtagcatatattgacaccatccttatttttggttaagaccaaactgaattttgatagactcttttgaggtaaaagagaaatagaatggcaacacaagcacttgtatcatcttcacttagctcttctgtagagactgctagacagatactagcaggaaggccatttcaatccccaattggttcctcctctaagaagggatcatttgttgttagggcagcttctactccacctgttaagcaaggagcaaacaggcccttgtggtttgcatcgagccagagcctcacatacttggacggcagcctaccaggtgactacggatttgatcccttaggactctcagacccagaaggaacaggaggattcatcgagccaaaatggttagcctatggagaggtcatcaacggacgtttcgccatgttgggtgcgtttggtgctatcgcccctgaaattctaggcaaagctggtctcatccctcaagaaacagctctcgcatggttccagactggtgtgatcccaccagcaggaacatacagctactgggcagacaattacacgctattcgtgttggaaatggcgctaatgggttttgcagagcacagaaggctccaagattgggctaagccaggctcaatggggaagcagtacttcttaggttttgagaagtttcttggtggatcaggagaccctgcatacccaggaggacctttatttaacccactcgggttcgggaaagatgagaaatctctgaaagaattgaagcttaaagaaattaagaatgggagattggcaatgttggcgattttgggttactttgtgcaaggtttagtgacgggagttggaccgtaccaaaaccttcttgatcatttggctgatcccgtcaacaacaacatcttgacaagccttaagtttcattaagtaaaaggttctcttcttattggaactacatccccagcccatcctgctcttcttttagtcatagcttttgtttattggctgtccccttcatgtgaaaaatatgtttgtaatttgtaagaaatgacaagttaattaatggctaaaatggaatctatgctggtgtcgaactactatttctatgtaaaaaaaatccta

SEQ ID NO: 1776 - DNA, 1195 bp, Arabidopsis lyrata
gagcaaaaccagttgtgctatttgaaaaccacaagtattggacctttgtttcttctaccctaacatagctcctgcagaccataactaaacaatcatcattttctcttggtgacagaagagaagagttgaggaacagagaaaatggcagcacaagcacttgtgtcttcttcacttacctcctctgttcagacagctagacagatatttggctcaaaaccagttgcgtctgcctcacagaagaagagttcctttgttgttaaggctacagcaactccacctgtcaagcaaggagcaaacagaccattgtggtttgcatcatcgcagagtctctcttacttggatggcagcttacctggagactatggatttgacccacttggtctttcagacccagagggaactggagggttcattgagccaagatggctagcatacggagagatcatcaacggacggtttgccatgttgggtgcagctggagctattgctcctgagattctaggaaaggctggtctgattccaccagagactgctcttccttggttccaaaccggtgtgattccaccagcagggacatacacttactgggcagacaattacactctctttgttctcgagatggctctgatgggattcgctgagcaccggaggttacaagactggtacaacccaggatctatgggaaaacagtacttcttggggttagagaagggtttggccggttcaggtaacccggcttaccccggtggacctttcttcaaccctctagggtttgggaaagatgagaagtccttgaaggagttgaaactcaaggaggtcaagaacggtagactggctatgctcgccatcctcggttactttatccaaggactagtgaccggtgtgggaccttaccagaacctgctcgatcacttggctgatcccgtcaacaacaacgtcttgaccagcctcaagttccactgaggtgatcatcatcctatgtgttttatgtctcttgtatcgtacaaatctttctatctttcgctaccattggcttcttcgtattgtaacaccctgtgtaaacatattcgtgttttgtaagaaatgacaatgtcaatggccaaacgaaaaacttttaggattaacagttggtatttgcaagaatcaagcaaaccggtttagatatttaaacactgttatggaattctttacttgt

SEQ ID NO: 1777 - DNA, 1020 bp, Brassica juncea
atcgtctcttggtgacagaagagaagagtttaagcaaaaaaaatggcagcacaagcgcttgtatcttcttcacttacctcctctgttcagaccgctagacagatattcggcgcaaaaccagctgtgtccgtatcacagaggaaggtttccttggttgttaaggctgcatcaactccacctgccaagcaaggagcaaacaggcaattgtggtttgcatcatcacagagtctctcttacttggatggcagcttacctggcgacttcggattcgatccgcttggtctttcagacccagagggtactggaggcttcatcgagccgagatggctagcctacggagagatcatcaacgggaggttcgctatgttgggtgcagctggagctattgcacctgagattctaggaaaggccggtctgattcctgcagacactgctcttccctggttccaaaccggtgtgattccacctgcagggacatacagctactgggcagacccttacacactctttgttctcgagatggctttgatgggatttgccgagcacaggaggttgcaggactggtacaacccaggatctatgggtaaacaatacttcttgggtctagagaaaggtttcgccggttcaggtgacccggcttaccccggtggaccattcttcaaccctcttgggtttggaaaagacgagaagtcgatgaaggagttgaagctcaaggaggtcaagaacggtagactggcaatgctcgctatcctaggctattttgtgcagggactagtgaccggtgtggggccttaccagaaccttcttgatcatttggcggatcccgtcaacaacaatgtcttgaccagcctcaagtttcactgagatgatcatatcgtattcatctcatggtgttttatgttggtttcccattctcttgtatcgtacaatcttgtttgtttctcttggtaccatcagtttctttgtgtgaacaccctgtgtaaacatattcgtcttttgtaagaaataatggccataaag

SEQ ID NO: 1778 - DNA, 1131 bp, Brassica napus
acgctaggttccctgcagaccattattcaataatcatcgtcccttggtgactgaagagaagagtttaagcaaagaatggcagcacaagcgcttgtgtcttcttcacttacttcctctgttcagactgctagacagatattcggcgcaaaaccagctgtgtccgtatcacagaggaaggtttccttggttgttaaggctgcctcaactccacctgccaagcaaggagcaaacaggcaattgtggtttgcatcatcacagagtctctcttacttggatggcagcttacctggcgactttggattcgatccgcttggtctttcagacccagagggtactggaggcttcatcgagccgagatggctagcctacggagagatcatcaacgggaggttcgctatgttgggtgcagctggagctattgcacctgagattctaggaaaggccggtctgattcctgcagacactgctcttccctggttccaaaccggtgtgattccacctgcagggacatacagctactgggcagacccttacacactctttgttctcgagatggctttgatgggatttgccgagcacaggaggttgcaggactggtacaacccaggatctatgggtaaacaatacttcttgggtctagagaaaggtttcgcgggttcaggtgacccggcttaccccggtggaccattcttcaaccctcttgggtttggaaaagacgagaagtcgatgaaggagttgaaactcaaggaggtcaagaacggtagactggcaatgctcgccatcctaggctattttgtgcagggactagtgaccggtgtggggccttaccagaaccttcttgatcatttggcggatcccgtcaacaacaatgtcttgaccagcctcaagttccactgagatgatcatatatcgtattcatcacatggtgttttatgttggtttcccattctcttgtatcctacaatcttgtttgtttctcttggtaccatcagtttctctgtgttgtaacaccctgtgtaaacatattcgtcttttgtaagaaataatggccataaagaaccctcgtgccgaagacctgcagcccggggatctcctagtctgaagcggccgccaccgcgggagctccagtat

SEQ ID NO: 1779 - DNA, 981 bp, Brassica napus
aaatggcagcacaagcgcttgtatcttcttcacttacctcctctgttcagaccgctagacagatattcggcgcaaaaccagctgtgtccgtatcacagaggaaggtttccttggttgttaaggctgcatcaactccacctgccaagcaaggagcaaacaggcaattgtggtttgcatcatcacagagtctctcttacttggatggcagcttacctggcgacttcggattcgatccgcttggtctttcagacccagagggtactggaggcttcatcgagccgagatggctagcctacggagagatcatcaacgggaggtttgctatgttgggtgcagctggagctattgcacctgagattctaggaaaggccggtctgattcctgcagacactgctcttccctggttccaaaccggtgtgattccacctgcagggacatacagctactgggcagacccttacacactctttgttctcgagatggctttgatgggatttgccgagcacaggaggttgcaggactggtacaacccaggatctatgggtaaacaatacttcttgggtctagagaaaggtttcgcgggttcaggtgacccggcttaccccggtggaccattcttcaaccctcttgggtttggaaaagacgagaagtcgatgaaggagttgaaactcaaggaggtcaagaacggtagactggcaatgctcgccatcctaggctattttgtgcagggattagtgaccggtgtggggccttaccagaaccttcttgatcatttggcggatcccgtcaacaacaatgtcttgaccagcctcaagttccactgagatgatcatatcgtattcatctcatggtgttttatgttggtttcccattctcttgtatcctacaatcttgtttgtttctcttggtaccatcagtttctttgtgttgtaacaccctgtgtaaacatattcgtcttttgtaagaaataatggccataaa

SEQ ID NO: 1780 - DNA, 1126 bp, Brassica napus
acagacgtgatgccgcgtacgtaagcttgaccctctagagaagcaccacgcgtccggttccttctactcttaacactaggttccctgcagaccattattcaataatcatcgtctcttggtgacagaagagaagagtttaagcaaaaaaaaatggcagcacaagcgcttgtatcttcttcacttacctcctctgttcagaccgctagacagatattcggcgcaaaaccagctgtgtccgtatcacagaggaaggtttccttggttgttaaggctgcatcaactccacctgccaagcaaggagcaaacaggcaattgtggtttgcatcatcacagagtctctcttacttggatggcagcttacctggcgacttcggattcgatccgcttggtctttcagacccagagggtactggaggcttcatcgagccgagatggctagcctacggagagatcatcaacgggaggttcgctatgttgggtgcagctggagctattgcacctgagattctaggaaaggccggtctgattcctgcagacactgctcttccctggttccaaaccggtgtgattccacctgcagggacatacagctactgggcagacccttacacactctttgttctcgagatggctttgatgggatttgccgagcacaggaggttgcaggactggtacaacccaggatctatgggtaaacaatacttcttgggtctagagaaaggtttcgcgggttcaggtgacccggcttaccccggtggaccattcttcaaccctcttgggtttggaaaagacgagaagtcgatgaaggagttgaaactcaaggaggtcaagaacggtagactggcaatgctcgccatcctaggctattttgtgcagggactagtgaccggtgtggggccttaccagaaccttcttgatcatttggcggatcccgtcaacaacaatgtcttgaccagcctcaagttccactgagatgatcatatcgtattcatctcatggtgttttatgttggtttcccattctcttgtatcgtacaatcttgtttgtttctcttggtaccatcagtttctttgtgtgaacaccctgtgtaagcatattcgtcttttgtaagaaataatggccataa

SEQ ID NO: 1781 - DNA, 1140 bp, Brassica napus
tcccaatcaaccttgttctcgctgtagttgctgaggttgattgggatgttcttgccaaagtagctcaaggttccttctactcttaacgctaggttccctgcagaccattattcaataatcatcgtcccttggtgactgaagagaagagtttaagcaaagaatggcagcacaagcgcttgtgtcttcttcacttacttcctctgttcagactgctagacagatattcggcgcaaaaccagctgtgtccgtatcacagaggaaggtttccttggttgttaaggctgcctcaactccacctgccaagcaaggagcaaacaggcaattgtggtttgcatcatcacagagtctctcttacttggatggcagcttacctggcgactttggattcgatccgcttggtctttcagacccagagggtactggaggcttcatcgagccgagatggctagcctacggagagatcatcaacgggaggttcgctatgttgggtgcagctggagctattgcacctgagattctaggaaaggccggtctgattcctgcagacactgctcttccctggttccaaaccggtgtgattccacctgcagggacatacagctactgggcagacccttacacactctttgttctcgagatggctttgatgggatttgccgagcacaggaggttgcaggactggtacaacccaggatctatgggtaaacaatacttcttgggtctagagaaaggtttcgcgggttcaggtgacccggcttaccccggtggaccattcttcaaccctcttgggtttggaaaagacgagaagtcgatgaaggagttgaaactcaaggaggtcaagaacggtagactggcaatgctcgccatcctaggctattttgtgcagggattagtgaccggtgtggggccttaccagaaccttcttgatcatttggcggatcccgtcaacaacaatgtcttgaccagcctcaagttccactgagatgatcatatcgtattcatctcatggtgttttatgttggtttcccattctcttgtatcctacaatcttgtttgtttctcttggtaccatcagtttctttgtgttgtaacaccctgtgtaaacatattcgtcttttgtaagaaataatggccataaag

SEQ ID NO: 1782 - DNA, 1152 bp, Fagopyrum esculentum
agagcagcagctgaaccaaatcaagcaccacacatctacctcaaataatctagcccttatattcgttcatggcgttggtctcttcagctgcccggcaaatcctcggcggaaggcctctccagccttctgtcggcccttcctcctctttcaggaaaccctccttcgtcgtccgcgctacctctactcctcccgttaagcaaggtggtgacaggcagttgtggtttgcttccaagcagagtctttcttacttggatggcagtctcccaggtgattttgggttcgacccattgggtctatcagacccagaaggaaccggagggttcatcgagccaagatggctagcctacggagagattatcaacgggcgtttcgccatgttgggtgcagcaggcgccattgcgcccgagattgtaggaaaagccggtctaatcccaccagaaaccgcccttccatggttccagaccggagtcatccccccagccggaacctacagctactgggccgacccatacacactattcgttctcgagctagccctaatggggttcgccgagcacaggaggttccaggactggtacaacccgggttccatgtcgaagcaatactttttagggttggagaagtttttgggtgggtcggataacccggcttacccgggtgggcctttgtttaacccgcttgggttcggtaaggatgagaagtctttgaaggaattgaagcttaaggaagtgaagaatggaaggttggctatgttggctatattgggttactttgttcaagcgcttgtaactggagagggaccttaccagaacttgcttgatcatttggctgacccagtcaacaacaatatcttgactagcctcaagttccattgatttatatattccatctatcatcaagctcttatgtaacaaattaaatttagtgagagggatcttgcagtcaaatcagattctgtaaaaattgacttgttaagatttaaacatatggttacttgtgtcgacttgttaagatttaaacatatggttacttgtgtcgatccatcacaactcatcttcattcactatttatatatatatgcatatatatgcttcatgtatgctcgtagctagttgcaaacattttatttagaagctctaccttcggcatctc

SEQ ID NO: 1783 - DNA, 1359 bp, Tropaeolum majus
tcacctctagattttattgggagtagagaaacaaacaaacatgtatattgatggtcaagagtgtgccacgtggcaatagaacttgtgttgttctacaaaatcaatatctcttatccaatcaatgatgccacgtgtacaaccattgttggacaccaagatcctaccctaatctcaaaactcaacacttatatttcccccaaaccatctcaagaccacacaagtagtagcatatattgacaccatccttaatttttggttaagaccaaactaaattttgatagactcttttgaggtaaaagagaaatagaatggcaacacaagcacttgtatcatcttcacttagctcttctgtagagactgctagacagatactagcaggaaggccatttcaatccccaattggttcctcctctaagaagggatcatttgttgttagggcagcttctactccacctgttaagcaaggagcaaacaggcccttgtggtttgcatcgagccagagcctcacatacttggacggcagcctaccaggtgactacggatttgatcccttaggactctcagacccagaaggaacaggaggattcatcgagccaaaatggttagcctatggagaggtcatcaacggacgtttcgccatgttgggtgcgtttggtgctatcgcccctgaaattctaggcaaagctggtctcatccctcaagaaacagctctcgcatggttccagactggtgtgatcccaccagcaggaacatacagctactgggcagacaattacacgctattcgtgttggaaatggcgctaatgggttttgcagagcacagaaggctccaagattgggctaagccaggctcaatggggaagcagtacttcttaggttttgagaagtttcttggtggatcaggagaccctgcatacccaggaggacctttatttaacccactcgggttcgggaaagatgagaaatctctgaaagaattgaagcttaaagaaattaagaatgggagattggcaatgttggcgattttgggttactttgtgcaaggtttagtgacgggagttggaccgtaccaaaaccttcttgatcatttggctgatcccgtcaacaacaacatcttgacaagccttaagtttcattaagtaaaaggttctcttcttattggaactacatccccagcccatcctgctcttcttttagtcatagcttttgtttattggctgtccccttcatgtgaaaaatatgtttgtaatttgtaagaaatgacaagttaattaatggctaaaatggaatctatgctggtgtcgaactactatttctatgtaaaaaaatcctactgtcataattaagaagagtgaaaat

SEQ ID NO: 1784 - DNA, 1166 bp, Populus trichocarpa
gttgtggtttaccttaatttggcccttattccctccctagtttttgtttattctaggcgagagctgcagtctatcagagtcatacttgtgtggtagtaggggcacgcacacacaaaaacacagaaagaaaaagaagaagaagaagaagaaggacaagggaaagggggagaaatggcagcacaagcactcgtgtcatcatctcttacctcttcagtggagactgctaggaaagtgctaggagcaagaccaacccagtcaccattcgtgtcctcaaggaaaagctcttttgttgttagagcagcttctactccccctgttaagcaaggaaacaggcagctgtggttcgcatcgaaacaaagcctgtcttacttggatggcagccttccaggtgacttcggattcgacccactcggactttcagaccctgaaggcacaggaggtttcattgagccaaaatggttagcctacggtgagatcattaacggacgatatgccatgttgggggcggttggtgccattgcaccagaaattcttggaaaggctggcctcatacctccggagaccgccctcccttggttcaggactggtgtcatcccaccggccgggacatacagctactgggcagatccatacacgctgtttgttttcgagatggcactcatgggattcgcagagcacaggaggttacaggactgggcaaaaccaggttccatgggcaagcagtatttcctgggattcgagaagtatttgggtgggtccggagaaccagcctaccctggcggacccttgtttaacccccttggatttgggaaagacgagaagtcgttgaaagacttgaagttgaaggaggtgaagaatggcaggttggctatgttggccatcttgggttactttgtgcaaggtctcgtgaccggagtcggaccataccaaaacctcctggatcacctggccgatcctgtccacaacaatatcttgaccagccttaaatttcattagggctcattcttgcctgtttggggataggaatagacccccctctgaacccctttccagtcctctcctactcattgtaaccattggtgtgaaaagctcttttgtaattctctgtaagaaaatctccctctcttgtttctcttgtgataatgaagcagcttaattaatggcca

SEQ ID NO: 1785 - DNA, 996 bp, Brassica napus
ccatcatcatcatctcttggtgacacaagcgaagagttcaaggactagagttaaaatggctgcacaagcccttgtgtcttcttcacttacctcctctgttcagaccgctagacaaatattcggcacaaaaccagctgtgtccgtgaggaagacttcctttgttgttaaggctgcctcaactccacctgtcaagcaaggagcaaacagaccattgtggtttgcatcttcacaatctctgtcttacttggatggcagcttacctggcgactatggattcgaccctcttggtctttcagacccagagggtactggaggattcatcgaaccgagatggttagcctacggagagatcatcaacggacggttcgctatgttgggtgcagctggagctattgcccctgagattcttggcaaagctggtttgattccagcagacactgcccttccttggttccaaaccggtgtgattccacctgcagggacgtacagctactgggcagacccttacacactctttgttctcgagatggctttgatgggatttgctgagcaccggaggttgcaggactggtacaaccctggatcaatgggaaaacaatacttcttgggcttagagaaaggttttgccggttcgggtgacccgtcttaccccggtggaccttctttaaccctcttgggtttgggaaagacgagaagtcaatgaaggagttgaaactcaaggaggtcaagaacggtagactggctatgctcgcaatcctaggctattttgtgcagggactagtgaccggtgtggggccataccagaaccttcttgatcatttggcggatccagtcaacaacaatgtcttgaccagcctcaagttccactgagatgatcttcatatcatcccatgtgttttatgttggactctcattctcttgtatcctacagtcttcgtattgtaccaccctttgtaaacatattatatctttgtaagatatgaaaatgtcaatggc

SEQ ID NO: 1786 - DNA, 2681 bp, Zea mays
attcattaaaaatattattttatataatatgattatgggtccctggaacacgatacatatataatgggtccctcaatgtaacttaaacataaattaaaccgatgactattgcgcagtttcatcgaaagtgctcagaaatccacccaagaagccagcaccattacagttcccacataggatttcacgcttgcctctgcacaaccagcataaagatccagctttaaatcggccttcaaaatagtcaacagaatttaccccatttccttcacatttggtgcatgtgattgccccatttccttcgcagtcctggcaaagaatgctcttcaccttctgatgctttttagcagactgatcattttctgtggccttggtcttgatgcacaggttcttgcagtggcgggagacggggcgaaaggagataagcaaaggagctgatgctttgaggagagctggaggggagggagcagtggtagtgagactcgccgtggccgccatcaaggagttgcgagccggcgaggacgaagtggttgggaggcagtggaagaagagataaaacttttttttttttttttttttttttttgcagctggaagtagagtatatcacattatgacatcaaagatcactggtcacaccaccacacgtccacaaatatatatgcgcaaccatttccccctcaaaagccaaatccagctttgagttcgacaatccataaacaacgccacgttcagctgcttttcttggcgaagagcccgccgaggccgccgaggttgaaccccccgccgctgccgctgtcgtcgccgccggcagccttcttgccggcggtcgtcttggcgcgggaggcggcggccggcgcggcgccgaccttgttgaggagcgggtccgtctccaccagctggtccttcttgaagatgaagccgaagatggtctcgccgaggcccttctcctccttggccggcgccgggccgcccctgctggcagcgggcggcacgaccagcacggaccggcgcgccggccgcgtcctccccgatgtcgccgccacggccgccgctacggtgctgccgaacgccagagacgccatgctaaaagctagcttctttcttttcgagcgagcgagcgatcgggaattcagcaaggaaaccgaacgatggcgctctgccttgtccgagctcctctttctttttctccgttttttctaggggggaaacaaaaagcgactcggaaaaatgtaatcttgttcgtgaatccattgcgtctattgccccaaatgtagcttgcatccaggaatccaaactccacgatatcacaacttttaaagcacactctttcctccccacacgccttgctgtcaaattcatgcacatccctgctgctgggacgcgaggtggggtaattactgcctggaaccccgacgtcctccatctcacctcctatgctgttcatcatcacgctctaactgtgcatctccgtctgctcgcttcgaactctgacatccacatcacaaacgtctacgccccatccgaccacagagacaccccagccttccttgacatcctgctggaaattggtgccagcatctctgggccttggctcattgttggggattttaacctcatccgcgatgccaaagataagaacactggcactgtgaaccagctcctctgcaatcagtttaatgacgtgatccacaaccttagtcttgctgaacttcctctgttagactgtctctacacctggtcaaataaacgtcgctcacctatccttgccagactcgaccgtgccttcacaaatgcaaccttcaacaatgtcttcccctcagccctactaacctcatctgtcagaatcacttctgatcacaaacccatcatcgcaaccatgtccaccacagtcccaaagtccaactccttcagattcgaaaatgcctggctcaagaaaccaggcttcctcccttccatcctcccggcctggcgttgcctctccggttctacggtcgctgccggacgccttgctagctgcctcaagagcaccagatctgcggtaaaggtttgggccaggcgtaacagggcgccccctcagattctgccaaattgcaaattcataatcctaatgtttgacttccttgaggaagagagatggttgtcagatgctgaaatgcaggttcgggagctctgtcggaacaggctacaacaacacatcaaggaaatggctgcatagtggaagcagcgtgggaagcaacgggctatccgtgagggagacgccaacacggcattccaccatgcccacgctacacagaggctaaggatgaatcatatcagcaaaataactgtacaggagcaggaactgtatagccatgagacaaaaattgcagccctcacaaactacttcgccaacattatgggagagtctggcagctccacttggtcttttgatgtccatgagctctatgctggtcatccatgcgcctcagattctctaactgctcccttcactgagctggaagcagcaacgaccgttcgctcgatgaacaagatgagtgcccctgggccagatggctttggcccctgtttctactatagtgcatggaacacagttaagttacaagtgatggatctgctgggtgcctttcatcatgggaatgtggatcttgaaagaattaacagagcatacatggtgctcttgca

SEQ ID NO: 1787 - DNA, 809 bp, Sorghum bicolor
cccatttacggaccaaaaagcccagtgaccagcgccgcctgcgtcgcccgctataaagcgctagggttttacgactcgcctcctccacgccgccactcctcccaactcgacaaacgccgcgcctccgcctcgaaccctagccgagcggagcaagcaaggaaatgggcaagggtacgggcagcttcggcaagcgccgcaacaagacgcacacgctgtgcatccgctgcggccgccgcagcttccacctccagaagagcacctgctcctcctgcggctaccccgccgcccgcatccgcaagtataactggagtgtgaaggccatcaggcgcaagacaactggtaccggaaggatgaggtacatgcgtcacgtgcctcgccgcttcaagagcaacttcagagaagggactgaggctgccccgaagaagagtgccgctgctgccaactaagtctggatgttgccatcaagaacctcagaagctagaagttgggactttttgattgatgaattgtacttctgaactatgtagccgtaatactatgaaaatactggtttatcgtgctttgaattaaagtcagacacccaggtggtatgatgtatctttttggttagcgtgatttatttagtaccgtttgatgctcatgcaattgtcatcgcttgaaaacagttgtgcacgttgtaccgccgtattagcggtgaaatgagctgcagcatcttctgagttaccacgctaataactgggctattgagttgattggtggcatcagttcacacgtaaatttgttataaaagccttatcccaatctttggt

SEQ ID NO: 1788 - DNA, 1164 bp, Sorghum bicolor
gcccatttacggaccaaaaagcccagtgaccagcgccgcctgcgtcgcccgctataaagcgctagggttttacgactcgcctcctccacgccgccactcctcccaactcgacaaacgccgcgcctccgcctcgaaccctagccgagcggagcaagcaaggaaatgggcaagggtacgggcagcttcggcaagcgccgcaacaagacgcacacgctgtgcatccgctgcggccgccgcagcttccacctccagaagagcacctgctcctcctgcggctaccccgccgcccgcatccgcaagtataactggagtgtgaaggccatcaggcgcaagacaactggtaccggaaggatgaggtacatgcgtcacgtgcctcgccgcttcaagagcaacttcagagaagggactgaggctgccccgaagaagagtgccgctgctgccaactaagtctggatgttgccatcaagaacctcagaagctagaagttgggactttttgattgatgaattgtacttctgaactatgtagccgtaatactatgaaaatactggtttatcgtgctttgaattaaagtcagacacccaggtggtatgatgtatctttttggttagcgtgatttatttagtaccgtttgatgctcatgcaattgtcatcgcttgaaaacagttgtgcacgttgtaccgccgtattagcggtgaaatgagctgcagcatcttctgagttaccacgctaataactgggctattgagttgattggtggcatcagttcacacgtaaatttgttataaaagccttatcccaatctttggtaaatgattgtatgtaaaacttttttcacgatcgcttccatgacaagaattggctttgtctctagcactgccgtgaacattggtacatgacagtaaatgtttaaaacacattgacagtcaagaaacagcagtacaggattactgtctagcttctgaagttcttgatggcaagctcagtcccaacttattgtttccagttgcacttacactgacatcaggttgcttaacctcagttgcaactcaaactgtaagtgctacgatcaacttcagttgcaactcaatgaccttgagttgcatcaggaaacaatgtcagtgtaagtgcaactagaaacataatgcattatgttgatcattg

SEQ ID NO: 1789 - DNA, 544 bp, Triticum aestivum
gccgtcactcctctcaacccgaccacgccgcgcctccgcttcgaaccctagccgagcggggtaaggagggaaatggggaagggtacgggcagcttcggcaagcgccggaacaaaacgcacacgctgtgcatccgctgcggccgccgcagcttccacctccagaagagtacctgctcctcctgcggctaccccgcggcccgcatccgcaagtataattggagtgtgaaggccatcaggcgcaagaccactggtacgggaaggatgaggtacatgcgacacgtgcctcgccgtttcaagagcaacttcagagaagggactgaggctgccccaaagaagagtgctgctgctgccaactaagtgtggatgttgccatcaagaactcaagaactagacgttggttcttttgattgaattgtacttctgaactatttgcccgtaatactattacagtactgggttaccgtgtcttgaattgaagcagacgccatcttccttgggagcgtgattacatattacccagtttaagcccgtgaaaaaaaaaaaa

SEQ ID NO: 1790 - DNA, 530 bp, Triticum aestivum
caacccgaccacgccgcgcctccgcttcgaaccctagccgagcggggtaaggagggaaatggggaagggtacgggcagcttcggcaagcgccggaacaaaacgcacacgctgtgcatccgctgcggccgccgcagcttccacctccagaagagtacctgctcctcctgcggctaccccgcggcccgcatccgcaagtataattggagtgtgaaggccatcaggcgcaagaccactggtacgggaaggatgaggtacatgcgacacgtgcctcgccgtttcaagagcaacttcagagaagggactgaggctgccccaaagaagagtgctgctgctgccaactaagtgtggatgttgccatcaagaactcaaaaactagacgtgggtccttttgattgaattgtacttctgaactatttgcccgtaatactattacagtactgggttaccgtgtcttgaattgaagcagacgccatcttccttgggagcgtgattacatattacccagtttaagcccgtgaaaaaaaaaaaa

SEQ ID NO: 1791 - DNA, 643 bp, Sorghum bicolor
cccacgccgccactacccccaacccgaccacgccgcgcctccgcctcgaaccctagccgctcggagcaaggaaggaatggggaagggtacgggcagcttcggcaagcgccggaacaagacgcacacgctctgcatccgctgcggccgccgtagcttccacctccagaagagcacctgctcctcctgcggctaccccgccgctcgcatccgcaagtataactggagtattaaggccatcaggcgcaagacaactggtactggaaggatgaggtacatgcgacacgtgcctcgccgtttcaagagcaacttcagagaagggactgaggctgccccaaagaagagtgctgctgctgccaactaagtctggattttgccatcaagaacctgaaaagcattgtacttctgaactatttagccctaatgctatggaagtatggtttatagtgctttgaattaaagtcagacgcccctggtggtttgtatctttttttggtgatgagtatggtttatttgttatcccagttcgatgctcattcaattgtctttgtctacgtttaccgagttgataaatacagtgggcgatgatttctctggtggcatctattatcctggcaatccgaaagcacacgcaaatttgctaaaa

SEQ ID NO: 1792 - DNA, 1339 bp, Sorghum bicolor
tacggaccaaaaagcccagtgaccagtgccgcgtgcgtccgccgctataaagcgctagggttttcccacgccgccactacccccaacccgaccacgccgcgcctccgcctcgaaccctagccgctcggagcaaggaaggaatggggaagggtacgggcagcttcggcaagcgccggaacaagacgcacacgctctgcatccgctgcggccgccgtagcttccacctccagaagagcacctgctcctcctgcggctaccccgccgctcgcatccgcaagtataactggagtattaaggccatcaggcgcaagacaactggtactggaaggatgaggtacatgcgacacgtgcctcgccgtttcaagagcaacttcagagaagggactgaggctgccccaaagaagagtgctgctgctgccaactaagtctggattttgccatcaagaacctgaaaagcattgtacttctgaactatttagccctaatgctatggaagtatggtttatagtgctttgaattaaagtcagacgcccctggtggtttgtatctttttttggtgatgagtatggtttatttgttatcccagttcgatgctcattcaattgtctttgtctacgtttaccgagttgataaatacagtgggcgatgatttctctggtggcatctattatcctggcaatccgaaagcacacgcaaatttgctaaaagcattatccaaatctttttaaatgatttgtgtgaggaaatgatgaaaggccatgataagcactggcagtaagggtcctttaaagtaataagttgttaagaatattgtgtctgcaacaggccgcacctcgtcaggtggtcgctcttcttcgaggaggttagcggtgacccctctggccctctgtgcctccataacggccgcattgtgtgcagatattcgagtactagcgtgactcgggccagtacacgtggattctgcaagagaactccacgcggcactcctttgaactcacttgaaaatgcttgtatggtgcttaggccttgtttagttggcaaaatgaaaagcttgcatggtgctcttcggtcatgcgacatgtcctgaaagcaaataaaatgggcgtcgaaaaccttggtgctcttcttcaagcggttgttgacatggatactgatggcatttctgctagtggtacggtgcgcacaatgtatgctaactgctaagaaagagtatgctgagtcaatattgaacatgatgaatctgtcatgttttgcgcagaccatgagtgcttgtgagggtggacgacttcccactagttctgatgaaccgcaggcagctttggatgatgggagtaataag

SEQ ID NO: 1793 - DNA, 476 bp, Cenchrus ciliaris
  misc_feature (472)..(472): n is a, c, g, or t
ctccacccaaaccagaccgcgcctccgcctccaaccctagcggagcaaatggggaagggtaccggcagcttcggcaagcgccggaacaagacgcacaccctgtgcatccggtgcggccgcaggagcttccacctccagaagagcacctgctcctcgtgcggctaccccgccgcccgcatccgcaagtataactggagtgtgaaggccatcaggcgcaagaccactggaaccgggaggatgagatacctgcgacatgtgccacgccgtttcaagagcaacttcagagaagggactgaggctacccccaagaagagtgccgccgctgccaactaagtctggatgttgccattgaagaagctcggaagctagagttgggaactttttggttgcattgtactgtctgaactgcatttagccgtaaaactatcgcactggtttgctgtacctttaagtgaaaattcagacgaacttntgaa

SEQ ID NO: 1794 - DNA, 708 bp, Setaria italica
gcggccgctataaagcgctagggttttacgcctctccgcccccctccccacgccgccactgcccccccaaccagcccgcgcgcctccgcctcgaaccctagcggagcaacgaaggaatggggaagggtaccggcagcttcggcaagcgccggaacaagacgcacacgctctgcatccggtgcggccgccgcagcttccacctccagaagagcacctgctcctcctgcgggtaccccgccgcccgcatccgcaagtataactggagcgtgaaggccatcaggcgcaagaccactggaacaggaaggatgaggtacctgcgacacgtgcctcgccgtttcaagagcaacttcagagaagggactgaggctacccccaagaagagtgctgctgctgccaactaagtctggatgttgccattgaagaacctcggaagctagaagttgggaacttttttggttgaattgtactgcctgaactctatttagccgtaatactatgaaagcactggtttgccgtacttttaaattaaagtcagacgaacatccgaattcgttgctccggggttagtagcagtgcatggttttctgagcaattagcactggttttgccgtacctttaaattaaagtcagacgaacatccgaattcgttgctccggggttagtagcagtgcatggttttctgagcaatttaagtttgcttgatttcag

SEQ ID NO: 1795 - DNA, 584 bp, Zea mays
gggcaaagactccctcttggcccattgacggcccaaagcccagtgaccagcgcgcgtccgtcggccgatataaagcgctagggttttacctatcgtttgccccacgccgtcactcctctcaacccgaccacgccgcgcctccgcctggaaccctttagccgagcggagcaaggaaagaaatggggaagggtacgggcagcttcggcaagcgccggaacaagacgcacacgctctgcatccgctgcggccgccgcagcttccacctccagaagagcacctgctcctcctgcggctaccccgccgcccgcatccgcaagtataactggagtgtgaaggccatcaggcgtaagacaactggtaccggaaggatgaggtacatgcgacacgtgcctcgccgtttcaagagcaacttcagagaagggactgaggctgccccaaagaagggtgttgctgctgccaactaagtgtggatgttgccatcaagaacctcagaagctagacgttggatctttttgattgaattgtacttctgaactatttgcccgtaatactattacagtactggtttaccgtgttttgaattg

SEQ ID NO: 1796 - DNA, 650 bp, Pennisetum glaucum
cacggtttataacttaatagtatagcagcataccaggtccatgaaacaaacaccagttcctcatctcacgcgggggactcccgcagcaaaccaagaccgcgcctccgcctcctaccctagctgagcaaatggggaagggtacgggcagcttcggcaagcgccggaacaagacgcacacgctctgcatccggtgtggccgcaggagcttccacctccagaagagcacctgctcctcatgcggctaccccgcggcacgcatccgcaagtataactggagtgtgaaggccatcaggcgcaagaccactggaactgggaggatgaggtacttgcgacacgttcctcgccgtttcaagagcaacttcagagaagggactgaggctacccccaagaagagtgccgccgccgccaactaagtctggatgttgccattgaagaatctcggaagctagaagttgggaacttattggttgcattgtactgtctgaactgcatttagctgtaatactatcgcactggtttgctgtactttaaagttaaaattcagacgagcatctgaatttgttgctccatggtttaaatttttggatggcagcttcctttggcagttttgcaggcaagtccgtcatttggaatgaattgctttggcgttc

SEQ ID NO: 1797 - DNA, 602 bp, Pennisetum glaucum
cctccgcctccaacccgagcaaggaaggaatggggaagggtacgggcagcttcggcaagcgccggaacaagacgcacaccctctgcatccggtgcggccgcaggagcttccacctccagaagagcacctgctcctcatgcggctaccccgcggcacgcatccgcaagtataactggagtgtgaaggccatcaggcgcaagaccactggaaccgggaggatgaggtacctgcgacacgttcctcgccgtttcaagagcaacttcagagaagggactgaggctacccccaagaagagtgccgccgccgccaactaagtctggatgttgccattgtagaatcttggaagctagaagttgggaactttttggttgcattgtactgtctgaactgcatttagccgtaatactatcgcactggtttgctgtcctaatttttgaattcgttggtccatggtttgaattattgttttggtgcgtttctgagcaattttaaatatttggatgacagctgcctgtgcttccttcggcagttttgcaggcagtctgtcatttcgaatgcattgctctgtcattcaatcagatcttttatagcttcttcagagc

SEQ ID NO: 1798 - DNA, 571 bp, Saccharum officinarum
cgacaacgccgcgcctccgcctcgaaccctagccgagcagagcaaggaaggaatggggaagggtacgggcagcttcggcaagcgccggaacaagacgcacacgctctgcatccgctgcggccgccgcagcttccacctccagaagagtacctgctcctcctgcggctaccccgccgcccgcatccgcaagtataactggagtattaaggccatcaggcgcaagacaactggtacaggaaggatgaggtacatgcgacacgtgcctcgccgtttcaagagcaacttcagagaagggaccgaggctgccccaaagaagagtgctgccgccagcaactaagtctgatgttgccatcaagaacctgaaaagctagaagttggaactttttgattgaattgtacttctgaactatttagccctaatgctatggaagtactggtttatagtgctttgaattaaagtcagacgccctggtggtttgatgtatcttttttggtgagtattgtttatttgttaccccagtttgatggttatgtaattatcttcgcttgaaaaaaaaatcagaaaataata

SEQ ID NO: 1799 - DNA, 531 bp, Pennisetum glaucum
gcaaaccaagaccgcgcctccgcctcctaccctagctgagcaaatggggaagggtacgggcagcttcggcaagcgccggcacaagacgcacacgctctgcatccggtgtggccgcaggagcttccacctccagaagagcacctgctcctcatgcggctaccccgcggcacgcatccgcaagtataactggagtgtgaaggccatcaggcgcaagaccactggaaccgggaggatgaggtacctgcgacacgttcctcgccgtttcaagagcaacttcagagaagggactgaggctacccccaagaagagtgccgccgccgccaactaagtctggatgttgccattgaagaatctcggaagctagaagttgggaacttattggttgcattgtactgtctgaactgcatttagctgtaatactatcgcactggtttgctgtactttaaagttaaaattcagacgagcatctgaatttgttgctccatggtttaaatttttggatggcagcttcctttggcagttttgcaggcg

SEQ ID NO: 1800 - DNA, 580 bp, Festuca arundinacea
ggcacgaggtccacttcctcggcggcgcggcgcagcggcgacaagacaaggcgaaatgaccaagggtacgggcagcttcggcaagcgccggaacaagacgcacacgctgtgcatccgctgcggccggcgcagcttccacctgcagaagagcacctgctcctcctgcggctaccccgccgctcgcatccgcaagtacaactggagtgtgaaggctatcaggcgcaagaccactggaactggaaggatgaggtacatgcgccacgtgcctcgcaggttcaagagcaacttcagagaaggtaccgaggctgcccccaggaagacagctgccgccaactaggtctggattttgccatcaggaatcccgtgaagttagaattttaaggctttttacttggattgtaccgtctgagctattgttgctatagcgagtctggatctcatatgttttgttgcatgggtttgaaatttgacctctaaatttggagcaagaccaaatttgtgtgagtttacgtggtacctgttgcttgctctttaatctcactggaacctatcaaagtttagacgtgttacttatttttca

SEQ ID NO: 1801 - DNA, 515 bp, Lolium multiflorum
gcggcgcggcggcgacaagacaaggcgaaatgaccaagggtacgggcagcttcggcaagcgccggaacaagacgcacacgctgtgcatccgctgcggccgacgcagcttccacctgcagaagagcacctgctcctcctgcggctaccccgccgctcgcatccgcaagtacaactggagtgtgaaggctatcaggcgcaagaccacgggaactggaaggatgaggtacatgcgccatgtgcctcgcaggttcaagagcaacttcagagaaggtaccgaagctgcccccaggaagacagctgctgccaactaggtctgattttgccatcaggaatctcgtgaagttagaatttgaagacgtttactttgatgattgtaccgtcgaagctattgttgctatagcattcagtatggatctgatatgttttgttgcatgatgttgaaatttgacctctaaatcttgagcaagagcaaatttgtgcgagtttatgtggtacctgcccgggcggccgctcga

SEQ ID NO: 1802 - DNA, 500 bp, Avena sativa
cgccactccaatccattcgtcgcctccaaccctaagcgatgacgaagggcacgggcagcttcggcaagcgccggaacaagacgcacacgctctgcatccgctgcggccgccgcagcttccacctccagaagagcacctgctcttcctgcggctaccccgccgctcgcatccgcaagtacaactggagtgtgaaggccatcaggcgcaagaccacgggtaccggaaggatgaggtacatgcgccacgtgcctcgccgtttcaagagcaacttcagagaagggactgaggccgctcccaggaagagagccgccgccaactagggctcggttttgccaccaggatgaaccccatgacgctagaattttatgaacttttatttactatgattgcaccatctgaactaccgttggcacagcactttgtatagatctggtatgtattgttgcatgggtttaggaatttgacatctataaagtgtgagcaagtcctaaatttgttct

SEQ ID NO: 1803 - DNA, 501 bp, Avena sativa
ccgccgccactccaatccattcgtcgcctccaaccctaagcgatgacgaagggcacgggcagcttcggcaagcgccggaacaagacgcacacgctctgcatccgctgcggccgccgcagcttccacctccagaagagcacctgctcctcctgcggctaccccgccgcacgcatccgcaagtacaactggagtgtgaaggccatcaggcgcaagaccacgggtaccggaaggatgaggtacatgcgccacgtgcctcgccgtttcaagagcaacttcagagaagggaccgaggctgcccccaggaagagagctgctgccaactagggcttggttttgccaccaggaaccccatgacgttagaattttatgaacttttcatttactatgattgcaccatctgaactaccgttggcacagcactttgtatagatctggtatgtattgttgcatgggtttgggaatttgacatctataaagtgtgagcaagtccaaatttgttct

SEQ ID NO: 1804 - DNA, 436 bp, Avena sativa
ctccaatccattcgtcgcctccaaccctaagcgatgacgaagggaacgggcagcttcggcaagcgccggaacaagacgcacacgctttgcatccgctgcggccgccgcagcttccacctccagaagagcacctgctcctcctgcggctaccccgccgcccgcatccgcaagtacaactggagtgtgaaggccatcaggcgcaagaccaccggaaccggaaggatgaggtacatgcgccacgtgcctcgccgtttcaagagcaacttcagagaagggactgaggccgcccccaggaagagagctgccgccaactagggctcggttttgccaccaggatgaaccccatgacgctagaattttatgaacttcttatttactatgattgcaccgtctgaactatcgttagcacagcactttgtatagatctggtatgtat

SEQ ID NO: 1805 - DNA, 912 bp, Oryza sativa
aattgcgttggttatgaatggcccatggaagcccactattgctgctcccgtgctccctataaatagctagggttttacgccacttcccccatctccgccgccgccgccccactctccaaccctagccgagaggagcagaccaagcaatggggaagggtacgggcagcttcggcaagcgccggaacaagacgcacacgctctgcgtccgctgcggccgccgcagcttccacctccagaagagcacctgctcctcctgcggctaccccgccgcccgcatccgcaagtacaactggagcgtgaaggccattaggcgcaagaccacaggaactggaaggatgaggtacatgcgacatgtgcctaggaggttcaagagcaacttcagagaaggtactgaggctaccccaaggaagagagctgccgcagccaactagatcctgttttgctgtcaaagcagctatgaaactagaatttaagaacttttgcctggattgagccatctttcctatagtatgatgtacttatcttgttttatttgttatgatgctttaaaacttgacctctgaaatttcagtcagttgaacctctcgtatttttgtttcatacaatgttcatgattctcttagcgtccatggtaacggtggtgttttattttgttccgtggtgtctccgcttgtttcgtgctgccattcaaccagttttgggaaatgcttctgtttggtcgaaatgagctgccaccggggttcacaattgcgatcagtttgaaagcatttatttatttatttttggtaaaaaccgacgtttactgggtttcatctcgaaacgggatgtaaaacctggctccatcctcaatttgcaccttgaactggcccaatgggactagttttataatggaattacccaataaaggtggtt

SEQ ID NO: 1806 - DNA, 818 bp, Oryza sativa
ccatctccgccgccgccgccccactctccaaccctagccgagaggagcagaccaagcaatggggaagggtacgggcagcttcggcaagcgccggaacaagacgcacacgctctgcgtccgctgcggccgccgcagcttccacctccagaagagcacctgctcctcctgcggctaccccgccgcccgcatccgcaagtacaactggagcgtgaaggccattaggcgcaagaccacaggaactggaaggatgaggtacatgcgacatgtgcctaggaggttcaagagcaacttcagagaaggtactgaggctaccccaaggaagagagctgccgcagccaactagatcctgttttgctgtcaaagcagctatgaaactagaatttaagaacttttgcctggattgagccatctttcctatagtatgatgtacttatcttgttttatttgttatgatgctttaaaacttgacctctgaaatttcagtcagttgaacctctcgtatttttgtttcatacaatgttcatgattctcttagcgtccatggtaacggtggtgttttattttgttccgtggtgtctccgcttgtttcgtgctgccattcaaccagttttgggaaatgcttctgtttggtcgaaatgagctgccaccggggttcacaattgcgatcagtttgaaagtcatttatttatttatttttgttaaaaaccgacgtttactggttttcatctcgaaacggtatgtaaaacctggctccatcctcaatttgcacttgaactggcccaattgtactagttttataatgtaattacctaataaag

SEQ ID NO: 1807 - DNA, 716 bp, Panicum virgatum
ggccgccactcctcccaacccagctcggccaaccccgcgcctccgcctcaaaccctagccgaccggagcaacgaccaaggaatggggaagggtacgggcagcttcggcaagcgccggaacaagacgcacacgctctgcatccgctgcggccgccggagcttccacctacagaagagcacctgctcctcctgcggttaccccgccgcccgcatccgcaagtataactggagtgtgaaggccatccgccgcaagaccactggaactgggaggatgaggtacctccgacatgtgcctcgccgtttcaagagcaacttcagagaaggtactgaggctacccccaagaaggctgctgctgcttccaactaagtctggatgttgtcatcgagaaccgcagaagctagaaattggaacctttttggctgagttgtacagtctgaactatttagacgtgatactatggaagtattgttttgtcgtactttaaattcaatccagacgaacatctgaatttgttgctccatgctttcatgtatcgttttggtgagcagtgcgtgcgttatagaaatttcaatgttttgtggctctagttcacagctaaccctgcaaacagttgtgcctgtgcaggctgtgctcgttggctgtaactgtgagagcagtgtagctggtttgttaacttggaatagtcttgacgagtaatcatgctgatggtactggtc

SEQ ID NO: 1808 - DNA, 854 bp, Hordeum vulgare
agggtttcccccactccgcctccaccgccgccgctcccattcgctcgtctcctccaaccctaagcgatgacgaagggtaccggcagcttcggcaagcgccggaacaagacccacacgctctgcatccgctgcggccgccgcagcttccacctccagaagagcacctgctcctcgtgcggctaccccgccgcccgcatccgcaagtacaattggagtgtgaaggccatcaggcgcaagaccaccggcactggaaggatgaggtacatgcgccacgtgcctcgcaggttcaagagcaacttcagagaaggtaccgaggctgcccccagaaacagagcagcggccaactaggtctggattttgccccatctggaatcccgtgaagctagaatttaaaaacttttgcttggactgtaccccctgcctaaactattgttgctatagaattgagtatggatctgatatgttctgttgcattggtttggaaattgacctctgaatctaagaccaagtttgtctgaatgttacaagttcttgatccgttcttcctccttttttctcttgtatgttggatgtaagggcatctgccctccaatctagtgaattttttagtgctacgtagctgtgtggcatatctggtttctaatgaggctggctgcctgtgttttgataaaccgaacacagttctgaacaacaatattttcgtatggctgaaaaacgtacaaaattggcagcgagagtcgtctttagagtgctgttttagctgcttaaatgaactgctgttttagcaccggaaatgaactgctgttttaccatagtactacttctgtaccataatatatgatgttttagcagct

SEQ ID NO: 1809 - DNA, 597 bp, Secale cereale
tcagcaccacggcacccggcggctccgcccccttataaagcgcggtagggtttccccccactccgcctccaccgccgccgcccccattcgctcgcctcctccaaccctaagcgatgacgaagggtacgggcagcttcggcaagcgccggaacaagacccacacgctgtgcatccgctgcggccgccgcagcttccacctccagaagagcacctgctcctcgtgcggctaccccgccgcccgcatccgcaagtacaactggagtgtgaaggccatcaggcgcaagaccaccggcaccggaaggatgaggtacatgcgccatgtgcctcgcaggttcaagagcaacttcagagaaggtaccgaggctgcccccaggaacagggccgcggcgaactaggtctggattttgccccatcaggaatcccgcgaagtagaatttaaagacttttgcttggattgtaccccttgcgtaaactattgttgctatagcatcagagtatggatctgatatgttttgttgcatgggtttggaaattgacctctgaatctaagaccaaatttgtctgaatgtttcaagtcaaaaaaaaaactagagacta

SEQ ID NO: 1810 - DNA, 736 bp, Triticum aestivum
cgggggcctccaccgccgccgccactcccattcgctcgcctcctccaaccctaagcgatgacgaagggtaccggcagtttcggcaagcgccggaacaagacccacacgctctgcatccgctgcggccgccgcagcttccacctccagaagagcacctgctcctcgtgcggctaccccgccgcccgcatccgcaagtacaactggagtgtgaaagccatcaggcgcaagaccaccggcactggaaggatgaggtacatgcgccacgtgcctcgcaggttcaagagcaacttcagagaaggtaccgaggctgcccccaggaacagggccgcggccaactaggtctggattttgccccatcaagaatctcgtgaagctagaatttaaagacttttgcttggattgtaccccgcctaaactattgttgctatagaattgagtatggatctgatatgttttgttgcatgggtttggaaattgacctctgaatctaagaccaagtttgtctgaatgttacaattgtttgtgggttaagggcatctgctttccaatctagtgaattctgtagggctatgttgctgtgcgacacatacattagtagtacacaggagagaatgtcgaacacttcattttgaaacaaataatggctgaaaagcatcaaaatttggcaactgggagtcggtcattgagcatatcaattgcacaactattctgttaccataatgtttgagcatcattt

SEQ ID NO: 1811 - DNA, 630 bp, Hordeum vulgare
gtggatcccccgggctgtttgaattcggcacgaggattcgctcgtctcctccaaccctaagcgatgacgaagggtaccggcagcttcggcaagcgccggaacaagacccacacgctctgcatccgctgcggccgccgcagcttccacctccagaagagcacctgctcctcgtgcggctaccccgccgcccgcatccgcaagtacaattggagtgtgaaggccatcaggcgcaagaccaccggcactggaaggatgaggtacatgcgccacgtgcctcgcaggttcaagagcaacttcagagaaggtaccgaggctgcccccagaaacagagcagcggccaactaggtctggattttgccccatctggaatcccgtgaagctagaatttaaaaacttttgcttggactgtaccccctgcctaaactattgttgctatagaattgagtatggatctgatatgttctgttgcattggtttggaaattgacctctgaatctaagaccaagtttgtctgaatgttacaagttcttgatccgttcttcctccttttttctcttgtatgttggatgtaagggcatctgccctccaatctagtgaattttttagtgctacgttgctgtgttcacttac

SEQ ID NO: 1812 - DNA, 604 bp, Brachypodium distachyon
taccccctcgactgccgccgccgccactcctcccattcgccgcctcctcttccaaccctaagagatgacgaagggtacgggcagcttcggcaagcgccggaacaagacccacacgctgtgcatccgctgcggccgccgcagcttccacctccagaagagcacctgctcctcctgcggctaccccgccgcccgcatccgcaagtacaactggagtgtgaaggccatcaggcgcaagaccaccgggactggaaggatgaggtacatgcgcaacgtgcctcgcaggttcaagagcaacttcagagaaggtactgcggctgccccgaagaagagcaccgcagccaactaggtctgtgatttgccatcaagaagaatcaatcggatgaagctaggaattaaaaactttttgcttggattgtgtaccgtccgaactatatgtttctaatagctgttgagtatggatctgatatgttttgttgcatggattcgagatgacctcttccctagtgcaacgatgtctgtcgtgtttattgtttttggaatctttgtttggtcttatatttcccagattggttcctattagtaatttcagcatcatcagtagtca

SEQ ID NO: 1813 - DNA, 750 bp, Brachypodium distachyon
ccttataaaaccagggtagggtttcgctccactaccccctcgactgccgccgccgccactcctcccattcgccgcctcctcttccaaccctaagagatgacgaagggtacgggcagcttcggcaagcgccggaacaagacccacacgctgtgcatccgctgcggccgccgcagcttccacctccagaagagcacctgctcctcctgcggctaccccgccgcccgcatccgcaagtacaactggagtgtgaaggccatcaggcgcaagaccaccgggactggaaggatgaggtacatgcgcaacgtgcctcgcaggttcaagagcaacttcagagaaggtactgcggctgccccgaagaagagcaccgcagccaactaggtctgtgatttgccatcaagaagaatcaatcggatgaagctaggaattaaaaactttttgcttggattgtgtaccgtccgaactatatgtttctaatagctgttgagtatggatctgatatgttttgttgcatggattcgagatgacctcttccctagtgcaacgatgtctgtcgtgtttattgtttttggaatctttgtttggtcttatatttcccagattggttcctattagtaatttcagcatcatcagtagtcatcatctgtctccccaacagtatgatctcactattttaatcatctgatggaaaatactatgcgtaaaaaagtttgataggttgggcgcagtatgaacccacaatcagatgccagg

SEQ ID NO: 1814 - DNA, 814 bp, Brachypodium distachyon
gggccttgggcagttccgctcgagaccactctataaagcctcctccgggctcgctaggtttttggtgcgttctctcttctcctcttccacggcggcggcggcggcggcggcgacaaggcgaaggcgaaatgggtaagggtacggggagtttcggcaagcgccggaacaagacgcacacgctgtgcatccgttgcggccgccgcagcttccacctgcagaagagcacctgctcttcctgcggctatcccgccgcccgcatccgcaagtacaactggagcgtgaaggccatcaggaggaagaccacgggtaccggtaggatgaggtacatgcgccatgtgcccaggaggttcaagagcaacttcagggagggaactgaggctgcaccaaggaacaagggagcttctgccggcaactaggcgtggtgctcttcacttgttatgctaatcagagccctggtggccgaacttagtgtttttgctgctttctactggaattatgtgtttctatgccgagtggcttatgatgcctggttttatgttattctcacaattttcctggacgtcaatccttcagttttgaatgttgaatcctgcgtgatatctggatgttcggtcgcaggtatctgtgggtcaccacgctattcatggttactttgcagtgttgacgttgagcgtatctctgctcaaagtggcgtgctaattgtgcacattgctttttgcgttctgctttagcatgtttgagagcagtgagcacagttcgttgcctcatgctatgatcaatatgagatcagcctactttggtaacttgctgactt

SEQ ID NO: 1815 - DNA, 994 bp, Brachypodium distachyon
gggccttgggcagttccgctcgagaccactctataaagcctcctccgggctcgctaggtttttggtgcgttctctcttctcctcttccacggcggcggcggcggcggcggcgacaaggcgaaggcgaaatgggtaagggtacggggagtttcggcaagcgccggaacaagacgcacacgctgtgcatccgttgcggccgccgcagcttccacctgcagaagagcacctgctcttcctgcggctatcccgccgcccgcatccgcaagtacaactggagcgtgaaggccatcaggaggaagaccacgggtaccggtaggatgaggtacatgcgccatgtgcccaggaggttcaagagcaacttcagggagggaactgaggctgcaccaaggaacaagggagcttctgccggcaactaggcgtggtgctcttcacttgttatgctaatcagagccctggtggccgaacttagtgtttttgctgctttctactggaattatgtgtttctatgccgagtggcttatgatgcctggttttatgttattctcacaattttcctggacgtcaatccttcagttttgaatgttgaatcctgcgtgatatctggatgttcggtcgcaggtatctgtgggtcaccacgctattcatggttactttgcagtgttgacgttgagcgtatctctgctcaaagtggcgtgctaattgtgcacattgctttttgcgttctgctttagcatgtttgagagcagtgagcacagttcgttgcctcatgctatgatcaatatgagatcagcctactttggtaacttgctgacttatgtctgctgatctggtatggtgatcggtcaaattaaattgaacaggattcaaactcgaaccagtgaaaatttgttgatcgaccaaatgtcagaaactagtgaatgtgcatgctgaaacgtgatatccgaaacggacctgcttggttgactcaacctgtaaacattttgtaatgaggacg

SEQ ID NO: 1816 - DNA, 582 bp, Cynodon dactylon
gccggggacctcgccgccgccactccccaaccatcaaaccctagtcggtctgagaggagcaaagccaaggaggaatggggaagggtacgggcagcttcggcaagcgccggaacaagacgcacacgctctgcattcgctgcggccgccgcagcttccacctccagaagagcacctgctcctcctgcggctaccccgccgctcgcatccgcaagtataactggagtgtgaaggccatcaggcgcaagaccaccggaactggaaggatgaggtacctgcgtcatgtgcctaagcgctttaagagcaacttcagagaagggactgaggctaccccaaagaagaaagctgcagcgaactaagtctggatttttcaccaagaacatccagaagctagaactttaaacattttgcttggattctacttgctaaccgttctgatactatggtgtactgttatcatgctatctatctcgttactttgaattctagtcagatcgacatcagagtttattgcgtattgtgctgtgatcttctgttttactagtgatcattgtctgtgttggtctccttgatcattgcgtattc

SEQ ID NO: 1817 - DNA, 649 bp, Oryza sativa
tgctctaaaagctgcggaattcctcgagcactgttggcggacgcctccaccgccgccgccgcagccgccccattctccaaccctagccgagaggagcagatcaagcaatgggtaagggtacgggcagcttcggcaagcgccggaacaagacgcacacgctctgcgtccgctgcggccgccgcagcttccacctccagaagagcacctgctcctcctgcggttaccccgccgcccgcatccgcaagtacaactggagcgtgaaggccattaggcgcaagaccacaggaaccggaaggatgaggtacatgcgacatgtgcctaggaggttcaagagcaacttcagagaaggtactgaggctaccccaaggaagagagctgccgtggccaactagatccgttttgctatgaaagcagctatgaaactagaatttaagaacttttgcctggattgtgccatctctcctataatatgatgtactgatctgattttatttgttacggtgcttgaaaacttgacatctgaaatatcagtcagttgaacctctcgtatttttgtttcataccatgttcgttgatgtctgcaagtgtccatgttagcggtgtattttattttgttccatggtgtctccgcttgttttctgctgccatt

SEQ ID NO: 1818 - DNA, 534 bp, Oryza sativa
gcacgcctccaccgccgccgccgcagccgccccattctccaaccctagccgagaggagcagatcaagcaatgggtaagggtacgggcagcttcggcaagcgccggaacaagacgcacacgctctgcgtccgctgcggccgccgcagcttccacctccagaagagcacctgctcctcctgcggttaccccgccgcccgcatccgcaagtacaactggagcgtgaaggccattaggcgcaagaccacaggaaccggaaggatgaggtacatgcgacatgtgcctaggaggttcaagagcaacttcagagaaggtactgaggctaccccaaggaagagagctgccgtggccaactagatccgttttgctatgaaagcagctatgaaactagaatttaagaacttttgcctggattgtgccatctctcctataatatgatgtactgatctgattttatttgttacggtgcttgaaaacttgacatctgaaatatcagtcagttgaacctctcgtatttttgtttcataccatgttcgt

SEQ ID NO: 1819 - DNA, 524 bp, Panicum virgatum
acgccgccactcctcccaaccctagctgagcggaggagcaacagcgcaggaatggggaagggtacgggcagcttcggcaagcgccggaacaagacgcacacgctctgcatccgctgcggccgccggagcttccacctccagaagagcacctgctcctcctgcggctaccccgccgcccgcatccgcaagtataactggagtgtgaaggccatccggcgcaagaccactggaaccgggaggatgaggtacctccgacacgtgccttgccgtttcaagagcaacttcagagaaggtaccgaggctacccccaagaaggctgctgctgcttccaactaggtcttgatgttgccatcaagaaccgcagaagctagaaattggaaccttttttggctgagttgtacagtccgaactatttagacttactatggaagtattggtttgtcgttctttaaattcaagtcagacgaacatctgaatttgttgctccatggtttaatatatctttcttggtgagcagtgcatgc

SEQ ID NO: 1820 - DNA, 705 bp, Triticum aestivum
cattcgctcgcctcctccaaccctaagcgatgacgaagggtaccggcagtttcggcaagcgccggaacaagacccacacgctctgcatccgctgcggccgccgcagcttccacctccagaagagcacctgctcctcctgcggctaccccgccgcccgcatccgcaagtacaactggagtgtgaaggccatcaggcgcaagaccaccggcactggaaggatgaggtacatgcgccacgtgcctcgcaggttcaagagcaacttcagagaaggtaccgaggctgcgcccaggaacagggccgcggccaactagttctggattttgccccatcaggaataccctgaagctagaatttaaagactttttgcttgggttgtaccccgcctaaactattgttgctatagaattgagtatggatctgatatgttttgttgcatgggtttggaaattgacctctgaatctaagtccaaatttgtctgaatgttacaattgtttgtgggtttaaagggcatctgctttccaatctagtgaattttggagggctacgttgctgtgcgacacatttggcttctaatgaggctgactgcttgcgttttgataaaccatactttagtggtatgcagttgcagtgtaacacgggacacaatcccgagcacttcattttgaaacaaataaagtacagtaaaacatggctcaaaaaaaaaa

SEQ ID NO: 1821 - DNA, 885 bp, Oryza sativa
cctatatgttagttgggcttgacctccttactaaacctaacctcgagcagttgcgctctctccttcttcctcatctccctcggcggcggcggcggcggcaagcgaaggagaaggcgaaaatgggcaagggcacggggagcttcgggaagcgccggaacaagacgcacacgctctgcgtgcgctgcggccgccgcagcttccacctgcagaagagcacctgctcctcctgcggctaccccgcggcccgcatccgcaagtacaactggagtgtgaaggccatcaggaggaagaccactggaactgggaggatgaggtaccttcgccacgtgcccaagaggttcaagagtaacttcagagaggggactgaggctgcaccaaggaagaagggggctgctgctagcaactagactgcacttgttgcgctaagctgggagaccagtgtctttttgttgcttaatttatcgtaactctatgttcctaaatgaggcaaacgatgtctggttttctgttattttgcatcctggatgttaatccttgagttttgaatgttagatcgttttatccgttatcatcgctctcatacgcatttatcgttgctgttgtctatgtgcaactcgctgcatcggtttgcaattttggtgatgcgtgaaatactagaatcagtattcagaagtggggattgtgcatggtccatcaggctagttggcgcacaggcacagagcttagctgtttgctcgccttcatgacatttttccctagtccaacatgtatcgcacattcttgtgttctattgctcatgtgctcatgtttcttgtgtatcacgtgcaaggctaaatttgcgctacagtaatatgtttaccatacacagatagcacttagtactgc

SEQ ID NO: 1822 - DNA, 822 bp, Oryza sativa
ttactaaacctaacctcgagcagttgcgctctctccttcttcctcatctccctcggcggcggcggcggcggcaagcgaaggagaaggcgaaaatgggcaagggcacggggagcttcgggaagcgccggaacaagacgcacacgctctgcgtgcgctgcggccgccgcagcttccacctgcagaagagcacctgctcctcctgcggctaccccgcggcccgcatccgcaagtacaactggagtgtgaaggccatcaggaggaagaccactggaactgggaggatgaggtaccttcgccacgtgcccaagaggttcaagagtaacttcagagaggggactgaggctgcaccaaggaagaagggggctgctgctagcaactagactgcacttgttgcgctaagctgggagaccagtgtctttttgttgcttaatttatcgtaactctatgttcctaaatgaggcaaacgatgtctggttttctgttattttgcatcctggatgttaatccttgagttttgaatgttagatcgttttatccgttatcatcgctctcatacgcatttatcgttgctgttgtctatgtgcaactcgctgcatcggtttgcaattttggtgatgcgtgaaatactagaatcagtattcagaagtggggattgtgcatggtccatcaggctagttggctactccctgtctctgcacaggcacagagcttagctgtttgctcgccttcatgacatttttccctagtccaacatgtatcgcacattcttgtgttctattgctcatgtgctcatgtttcttgtgtatcacgtgcaaggctaaa

SEQ ID NO: 1823 - DNA, 458 bp, Secale cereale
tgacgaagggtacgggcagcttcggcaagcgccggaacaagacccacacgctctgcatccgctgcggccgccgcagcttccacctccagaagagcacctgctcctcgtgcggctaccccgccgcccgcatccgcaagtacaactggagtgtgaaggccatcaggcgcaagaccaccggcaccggaaggatgaggtacatgcgccatgtgcctcgcaggttcaagagcaacttcagagaaggtaccgaggctgcccccaggaacagggctgcggcgaactaggtctggattttgccccatcaggaatcccgtgaagtagaatttaaagtcttttgcttggattgtaccccttgcgtaaactattgttgctatagaattgagtatggatctgatatgttttgttgcatgggtttggaaattgacctctgaatctaagaccaaatttgtctgaaaaaaaaa

SEQ ID NO: 1824 - DNA, 410 bp, Eragrostis curvula
  misc_feature (410)..(410): n is a, c, g, or t
ggttcgacgccgctccccactcgtcgcctcatcgaggagagaggagcaaggaagccgggaaggaatggggaagggtacgggcagcttcggcaagcgccggaacaagacgcacacgctctgcatccgctgcggccgccgcagcttccacctccagaagagcacctgctcctcctgcggttaccctgctgcccgcatccgcaagtataactggagtgtgaaggccatcaggcgcaagaccactggaaccggaaggatgaggtacatgcgacacgtgcctaagccctttacgagcaacttcagagaagggactgaggctcacccaaagaagagagctgctgccaactaagtatggattctacatcacgaacctccaaacctacaacacgagagccatcgaaaactccataccn

SEQ ID NO: 1825 - DNA, 567 bp, Avena sativa
ttctccacttcctcggcggcggcgcaggctacgagagcgaaggcaaaatgacgaagggtacgggcagcttcggcaagcgccggaacaagacgcacacgctgtgcatccgctgcggacgccgcagcttccacctgcagaagagcacctgctcctcctgcggctaccccgccgcccgcatccgcaagtacaactggagtgtgaaggccatcaggcgcaaaaccaccggaactggaaggatgaggtacatgcgccacgtggctcgcaggttcaagagcaacttcagagaagggactgaggccgcccccaggaagagagctgccaccaactaggtctggattttgccatcaggaatcccatgaagctagaatttaaagacttcttacttggattgtaccgtctaaactattgttgctatatcatgagtatggatctgatatgttttgtgttgcatgtgtttgaaatttgacctctattcagagcaagtccaaatttgtctcaatttttgaggcacttatccgtgtaacaaaaaaaaaaaaactaaagcgacacgcaacaggggagagcgag

SEQ ID NO: 1826 - DNA, 507 bp, Avena sativa
acttccttggcggcggcgtaggcgacgagagcgaaggcaaaatgacgaagggtacgggcagcttcggcaagcgccggaacaagacgcacacgctgtgcatccgctgcggacgccgcagcttccacctgcagaagagcacctgctcctcctgcggctaccccgccgcccgcatccgcaagtacaactggagtgtgaaggccatcaggcgcaaaaccaccggaactggaaggatgaggtacatgcgccacgtggctcgcaggttcaagagcaacttcagagaagggaccgaggctgcccccaggaagagagctgccaccaactaggtctggattttgccatcaggaatcccatgaagctagaatttaaagactttttacttggattgtaccgtctaaactcttgttgctatatcatgagtatggatctgatatgttttgtgttgcatgggtttgaaatttgacctctattcggagcaagaccaaatttgtctcaatttacgaggcactt

SEQ ID NO: 1827 - DNA, 620 bp, Musa acuminata
gcctaatcgacaatttagggtttccatttgcgctcgctcgtatttttccgctcggagctcgccgaccctcggaaggggcgaccgaagagaacacagccgcacaatggggaagggtacaggaagcttcggtaagcggaggaacaagacccacaccctgtgcgttaggtgcgggcggaggagctttcatctccagaagagccgctgcggctcctgtggctaccctgctgctcggatccgcaagtacaactggagtgtgaaggcaataaggagaaagacaacgggtacaggaaggatgagatatcttcgacatgtgcctcgaaggttcaggagtaattttagagaagggactgaagcaactccaaggaagaagtctgcatccgctgcagtttgaagggcagagagcatgtcttttcagttggcatcattgaaacgtgtttttgaccggttatattgtttctcgcatgtctgaattcgtgtcagaaatctactgttgaagtgaaagattctgtcctttcgataacatgctttgattggaaaacgctgttgtgcgaatccactgcagtaagcttcaataacattattgttctgatactgtactccttcccgttgctagagagagg

SEQ ID NO: 1828 - DNA, 440 bp, Zingiber officinale
  misc_feature (426)..(427): n is a, c, g, or t
gagaagggccatgggcaagggaacgggaagtttcggaaagaggaggaacaagacccacactctgtgcgtgagatgcgggcgcaggagcttccacctccagaagagccggtgcggctcctgcggctaccccgctgcgcggattcggaagtataactggagtgtgaaggcaataagaagaaagacgacaggtacaggaagaatgaggtatcttcgtcatgtaccaagaaggttcaagaacaatttcagagaagggacagaagcagctcctaggaagaaggcagcggctgctgcagtttaaaaatgagtttagttgttacttgttaatcttcccagaactttattgtttaagactcgagtttagttgtcacatttggctcgctttgattgaaagaagacattgtccttgtatttttaaattgatgcatnnccttttagttttg

SEQ ID NO: 1829 - DNA, 436 bp, Oryza sativa
ggggaagggtacgggcagcttcggcaagcgccggaacaagacgcacacgctctgcgtccgctgcggccgccgcagcttccacctccagaagagcacctgctcctcctgcggctaccccgccgcccgcatccgcaagtgtaagctggagcgtgaaggccattaggcgcaagaccacaggaactggaaggatgaggtacatgcgacatgtgcctaggaggttcaagagcaacttcagagaaggtgctgaggctaccccaaggaagagagctgccgcagccgactagatcctgttttgctgtcaaagcagctatgaaactagaatttaagaacttttgcctggattgagccatctttcctatagtatgatgtacttatcttgttttatttgttatgatgctttaaaacttgaactctgaaatttccgtcaggtgaaact

SEQ ID NO: 1830 - DNA, 423 bp, Secale cereale
gctctcttcttcctcctctcctctttcctcggcggcggcgcaggcggcgcggaggcgacagtcgaaggcgaaatgacgaagggaaccgggagcttcggcaagcgccggaacaagacccacacgctgtgcatccgctgcggccgccgcagcttccacctgcagaagagcacctgctcctcgtgcggctaccccgcgcccgcatccgcaagtacaactggagtgtgaaggccatcaggaggaagaccaccggcaccgggaggatgaggtacatgcgccacgtgcccaggaggttcaagagcaacttcagggagggaactgaggccgcaccaaggagcaagggtgcctcttccagcggcaactaggcgcggcagtcttaacttgtaagtgaagcggagcctgatcatcaaacttagttcttttttt

SEQ ID NO: 1831 - DNA, 679 bp, Hordeum vulgare
tttggtgctctcctccttcctctcatctttcctcggcggcggcgcaggcggcgcggcggcgacaggcgaaggcgaaatgacgaagggaacgggcagcttcggcaagcgccggaacaagacgcacacgctgtgcatccgctgcggccgccgcagcttccacctgcagaagagcacctgctcctcgtgcggctaccccgccgcccgcatccgcaagtataactggagtgtgaaggccatcaggaggaagaccaccggcaccgggaggatgaggtacatgcgccacgtgccaaggaggttcaagagcaacttcagagagggaaccgaggccgcaccaaggagcaagggagcctcttccagcggtaactaggcgtgacagtcttgacttgttacgcgaggctgagccctgatcatcaaaattagcttttttgttgctttctactggaactctatgtttctatgtcgagaggcagacggtatgatgcctggttatgttatttgcgcaattgtcgtggacgttaatccttcagttttgaatgttgaattgtgtcggatgtcctgtgttcagcagcgtgctatttcttacatggctttttgttgtttccatatgaagatcttttcctaagctgtgatgcatggaatagttttactctgcactttgtagtttccatagagccttcca

SEQ ID NO: 1832 - DNA, 591 bp, Secale cereale
cttcttcctcctctcctctttcctcggcggcggcgcaggcggcgcggaggcgacagtcgaaggcgaaatgacgaagggaaccgggagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccgggaggatgaggtacatgcgccacgtgcccaggaggttcaagagcaacttcagggagggaactgaggccgcaccaaggagcaagggtgcctcttccagcggcaactaggcgcggcagtcttaacttgttaagtgaagcggagccttgatcatcaaacttagcttttttttttgctgctttctactggaactttatgtttctatgttgaggggcagacgatatgatgcctgattatgttatttgcacaattgtcgtggacgttaatccttaagttttgaatgttgaattgtgtcgatgtcctgtgttaaatgctgcatctcttgttcaatgtgcttttgtga

SEQ ID NO: 1833 - DNA, 808 bp, Secale cereale
gtactaaagactaccacgattaataggccggtcgcgaacgagttacgacctaagaaggaggaacgaaataaaatacagacagattaaatcaaacacacgcatgcatcgagcaaaccggtaccgcgtcgtgccttgaatcggtcctagcgtagagccatacatagcgaattggtgctctcttcttcctcctctcctctttcctcggcggcggcgcaggcggcgcggaggcgacaggcgaaggcgaaatgacgaagggaaccgggagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccgggaggatgaggtacatgcgccacgtgcccaggaggttcaagagcaacttcagagagggaactgaggccgcaccaaggagcaagggagcctcttccagtggcaactaggcgaacttgttaagtgaagcggagccctgatcatcaaacttagctttttttgctgctttctactggaattctatgtttctgtgttgaggggcagacgatatgatgcctggttatgttatttgcacaattgtcgtggacgttaatccttcagttttgaatgttgaattgtgtcgatgtcctgtggtagatgctgcatctcttgttcaatgtgcttttgttacgaggctttttgttgtattcatatgatatctttgctcaagttgttatgcatg

SEQ ID NO: 1834 - DNA, 678 bp, Secale cereale
gggtgctctcttcttcctcctctcctctttcctcggcggcggcgcaggcggcgcggaggcgacaggcgaaggcgaaatgacgaagggaaccgggagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccgggaggatgaggtacatgcgccacgtgcccaggaggttcaagagcaacttcagggagggaactgaggccgcaccaaggagcaagggtgcctcttccagcggcaactaggcgcggcagtcttaacttgttaagtgaagcggagccttgatcatcaaacttagctttttttttttgctgctttctactggaattctatgtttctatgtcgagaggcagacgatatgatgcctggttatgttatttgcacaattgtcgtggacgttaatccttcagttttgaatgttgaattgtgtcgatgtcctgtggtagatgctgcatctcttgttcaatgtgcttttgtgatgaggctttttgctgtttaaatatgttatctttgctcaagttgttatgcatggaacagatcatggcaaataaaaggt

SEQ ID NO: 1835 - DNA, 563 bp, Secale cereale
gctctcttcttcctcctctcctctttcctcggcggcggcgcaggcggcgcggaggcgacagtcgaaggcgaaatgacgaagggaaccgggagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccgggaggatgaggtacatgcgccacgtgcccaggaggttcaagagcaacttcagggagggaactgaggccgcaccaaggagcaagggtgcctcttccagcggcaactaggcgcggcagtcttaacttgttaagtgaagcggagccttgatcatcaaacttagcttttttttttgctgtctttctactggtaactttatgtttctatgttgaggggcagacgatatgatgcctgattatgttatttgtcactaattgtcgtggtacgttaattccttaagttttgtatgttgtaattgtgtcgatgtcct

SEQ ID NO: 1836 - DNA, 632 bp, Secale cereale
gctctcttctttcctcctctcctctttcctcggcggcggcgcaggcggcgcggaggcgacagtcgaaggcaaaatgacgaagggaaccgggagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccgggaggatgaggtacatgcgccacgtgcccaggaggttcaagagcaacttcagggagggaactgaggctgcaccaaggagcaagggagcctcttccagcggcaactaggcgcggcagtcttaacttgttaagcgaagcggagccctgatcatcaaacttagctttttttgctgctttctactggaattctatgtttctatgtcagagaggcagacgatatgatgcctggttatgttatttgcacaattgtcgtggacgttaatccttcagttttgaatgttgaattgtgtcgatgtcctgtgttaagatgctctgcatctcttgttcaatgcgctatttgtgatgaggctttttgtatttcctgtagacttgaccg

SEQ ID NO: 1837 - DNA, 654 bp, Secale cereale
gctctcttcttcctcctctcctctttcctcggcggcggcgcaggcggcgcggaggcgacagtccaaggcgaaatgacgaagggaaccgggagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccgggaggatgaggtacatgcgccacgtgcccaggaggttcaagagcaacttcagagagggaactgaggccgcaccaaggagcaagggagcctcttccagtggcaactaggcgaacttgttaagtgaagcggagccctgatcatcaaacttagctttttttgctgctttctactggaattctatgtttctgtgttgaggggcagacgatatgatgcctggttatgttatttgcacaattgtcgtggacgttaatccttcagttttgaatgttgaattgtgtcgatgtcctgtggtagatgctgcatctcttgttcaatgtgcttttgttacgaggctttttgtttgtattcatatgatatctttgtctcaagttgttatgcatggaatagatcataggaac

SEQ ID NO: 1838 - DNA, 638 bp, Secale cereale
atgggggtgctctcttcttcctcctctcctctttcctcggcggcggcgcaggcggcgcggaggcgacagtcgaaggcgaaatgacgaagggaaccgggagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccgggaggatgaggtacatgcgccacgtgcccaggaggttcaagagcaacttcagggagggaactgaggccgcaccaaggagcaagggagcctcttccagcggcaactaggcgcggcagtcttaacttgttaagcgaagcggagccttgatcatcaaacttagtctttttttttgctgctttctactggaactttatgtttctatgttgaggggcagacgatatgatgcctggttatgttatttgcacaattgtcgtggacctaaatccttctagtttgaatgttgaattgtgtcgatgtcctgtggtagatgctgcatctcttgttcaatgtgctttttgtgatgaggctttctgttgttttaatatgatatcttt

SEQ ID NO: 1839 - DNA, 591 bp, Hordeum vulgare
gcggcacgaggctcatctttcctcggcggcggcgcaggcggcgcggcggcgacaggcgaaggcgaaatgacgaagggaacgggcagcttcggcaagcgccggaacaagacgcacacgctgtgcatccgctgcggccgccgcagcttccacctgcagaagagcacctgctcctcgtgcggctaccccgccgcccgcatccgcaagtataactggagtgtgaaggccatcaggaggaagaccaccggcaccgggaggatgaggtacatgcgccacgtgccaaggaggttcaagagcaacttcagagagggaaccgaggccgcaccaaggagcaagggagcctcttccagcggtaactaggcgtgacagtcttgacttgttacgcgaggctgagccctgatcatcaaaattagcttttttgttgctttctactggaactctatgtttctatgtcgagaggcagacggtatgatgcctggttatgttatttgcgcaattgtcgtggacgttaatccttcagttttgaatgttgaattgtgtcggatgtcctgtgttcagcagcgtgctatttcttacattgctttttgtcgtttc

SEQ ID NO: 1840 - DNA, 619 bp, Setaria italica
ctcctcctcggcggcggcggcggcggtaagcgaaggaggcgaagacgaaatgggcaagggtacggggagcttcggcaagcgccggaacaagacgcacacgctgtgcgtgcgctgcggccgccgctccttccacctgcagaagagcacctgctcctcctgcggctaccccgcggcccgcatccgcaagtacaactggagcgtgaaggccattaggaggaagactactggcacagggaggatgaggtaccttcgccacgtgccacggaggttcaagagcaacttcagagagggaactgaggccgtatcaaggaagaagggagctgctgctggcaccaactaagcgtgtactccagttatgttaggcgaggctttgggtcatgaaactggtgtttttgttgctttactttgtgttcctaaattgagaggcaaacgatgcttgtctatgttattccatatcctggatattaatcttcagttttgaaatgtcgaatcgtgccagattgttaattgtcaccctatctacagaattagtctccagctgcctttgtgacgctgttaccttcgctgtatgttttctgtgaatctccgatgatgagtgctgctcgatgatctttggttg

SEQ ID NO: 1841 - DNA, 546 bp, Lolium multiflorum
gggtgcgttcatcttctccacttcctcggcggcggcggcgcaggcgcagcggcgacaagacgaaggcgaaatgacgaagggtacgggcagcttcggtaagcgccggaacaagacccacacgctgtgcatccggtgcggccgccgcagcttccacctgcagaagagcacctgctcctcgtgcggctaccccgcggcccgcatccgcaagtacaactggagtgtgaaggccatcaggaggaagaccaccggcaccgggaggatgaggtacatgcgccatgtgcccaggaggttcaagagcaacttcagagagggaactgaggccgcaccaaggaacaagggagcttcctccagcggcaactaggagaggcagtgtccacttgttaggctaatctgggccctgatcaacaaagttagctgttttgctgcttttcttttgtactggagaattctatggttatgtgtccagaggcagacgatgtcacctggtttcatattatttgcactattctcgtggacgttaatccttcagttttgaatgttgaattt

SEQ ID NO: 1842 - DNA, 528 bp, Avena sativa
gggcgttcttcttctccacttcctcggcggcggcgcaggcgcagcggcgacaagacaaggcgaaatgacgaagggtacgggcagcttcggcaagcgccggaacaagacgcacacgctctgcatccgctgcggccgccgcagcttccacctgcagaagagcacctgctcctcctgcggctaccccgcggcccgcatccgcaagtacaactggagtgtgaaggccatcaggaggaagaccaccggcactgggaggatgaggtacatgcgccacgtgcccaggaggttcaagagcaacttcagagagggaactgaggccgcaccaaggaccaagggagcttcttccagcggcaactaggcgtggcagtcttgttaggctataagcagagccctgatcatcgaacttagcttctttttgctgcttttctactggagaattctatgtttctgtgtcgagaggcagacgatgcctggtattatgttatttgcacaattgttctggacgttaatccatcagttttgaatgttgaa

SEQ ID NO: 1843 - DNA, 476 bp, Secale cereale
  misc_feature (390)..(390): n is a, c, g, or t
gcgacagtccaaggcgaaatgacgaagggaaccgggagcttcggcaagcgccggaacaagacccacacgctgtgcatccgctgcggccgtcgcagcttccacctgcagaagagcacctgctcctcgtgcggctaccccgccgcccgcatccgcaagtacaactggagtgtgaaggccattaggaggaagaccaccggcaccgggaggatgaggtacatgcgccacgtgcccaggcggttcaagagcaacttcagagagggaactgaggccgcaccaaggagcaagggtgcctcttccagcggcaactaggcgcggcagtcttgacttgttaagtgaagcggaccttgatcatcaaacttagcttttttttgctgctttctactggaattntatgtttctatgtcgagaggcagacgatatgatgcctggttatgttatttgcacaattgtcgtggacgttaatccttaagttttga

SEQ ID NO: 1844 - DNA, 559 bp, Triticum aestivum
gctctcttcttcctcctctcctctttcctcggcggcggcgcaggcggcgcagcggcgacaggagaaggcgaaatgacgaagggaacgggcagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccgggaggatgaggtacatgcgccatgtgcccaggaggttcaagagcaacttcagagagggaactgaggccgcaccaaggagcaagggagcctcttccagcggcaactaggcgtgacagtctccatttgttgccctaagcgaagccctgatcatcaaacttagctttttttgttgatttctactggaactctatgtttctatgtcgagaggcagacgatatggtgcctggttatgttatttgcacaattgtcgtggacattaatccttcagttttgaatgttgaatcgtgtcgatgtcctgtgtta

SEQ ID NO: 1845 - DNA, 826 bp, Triticum aestivum
tcttcttcctcctctcctctttcctcggcggcggcgcaggcggcgcagcggcgacaggagaaggcgaaatgacgaagggaacgggcagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccgggaggatgaggtacatgcgccacgtgcccaggaggttcaagagcaacttcagagagggaactgaggccgcaccaaggagcaagggagcctcttccagcggcaactaggcgtgacagtctccatttgttgccctaagcgaagccctgatcatcaaacttagcttttttgttgttttctactggaactcttatgtttctatgttgagaggcagacgatatgatgcctggttatgttatttgcacaattgtcgtggacgttaatccttcagttttgaatgttgaatcgtgtcgatgtcctgtgttagatgctgcatctcttgttcaatgtgctatttgtgatgagtcttttttttgttgtttcaatatgagatatttgctcaagttgttatgcatgtaatagatcatgacatggtcactcacatagtgtttgtctgttaatatttatgctgtgcaggtccagcaagaacataaaaatgcaacttccaatgtgaatagctcaatggttcatttctctcttagcattttgagttccaacattgtcttgtacacagaacagagagattgtatggaaggtc

SEQ ID NO: 1846 - DNA, 490 bp, Liriodendron tulipifera
agggtttcttcaactgctgaaatgggaaaaggtaccggaagcttcggaaagaggaggaacaagacacacaccctctgcgtgaggtgtggtcgtcgtagcttccatctgcagaagagcagatgcgcggcttgcggctaccctgcggccaggattcgcaagtataactggagcgtgaaggccataaggaggaagacgaccggaaccggaaggatgaggtacctccgtcatgtggctcgcagattcaagagcaatttcagagaaggtactgaagctgctccgaggaagaaggcggccgctgcttcattctaagcttataaaggtgtttcaggcgtgattttggtatactctgctttagtttagctgtagcgggttctagaaatgagttcttcggattttgttttctggagatctgattttgagtagcgacgtctttgttgttatgacttttcaattgttgggatcatttaattctgctgagagtctttgaatt

SEQ ID NO: 1847 - DNA, 632 bp, Epimedium sagittatum
tggtactgacggcgggcgacaatgggaaaaggaacaggaagtttcggtaagaggaggaacaagacccacactctgtgtgtgaggtgcggccgccgaagttttcatctccagaagagcagatgctctgcttgcgcgtacccagcggctcgcatcaggaagtataactggagcgtgaaagctattagaaggaagacgaccggtaccggaaggatgaggtatatgcgtaatgttcctcggaggttcaagagcaacttcagagaaggtacccaagctgcccccaagaagatcggtgctgcatcttcttagatgattttgtagaaggaggcccagagctagagctagagcgtctgtcttcttttgagtaatcttatgttttggcttttgatccttattacttttgagaccaagttattattcaacttttaagaccaagttagtgtttggtatttcttgtttctgcagttattaattaatcatccttcatacattatttggaatttttttgctgatttttgctttgttgaatgttgccactgatagattcatacattatttggaatttttgctttacgcaaaaattccaaataatgtatatcgatagacaggatacagactggaaagaaatacataat

SEQ ID NO: 1848 - DNA, 590 bp, Catharanthus roseus
aagaattcggcacgaggcttgctagggttttgtgttctcctcttcacaaatgggaaaaggtacaggaagtttcggtaagaggcgaaacaagactcatacactctgtgttagatgcggtcgccgtagcttccatcttcaaaagagtcgctgtggttcctgcggttacccagcagctcgcctccgcaaatataattggagtgtcaaggctatcagaagaaaaaccaccggaactggtcgtatgaggtatctccgtcatgttccagtaagattcaagactaatttcagggagggcacagaggcagcaccaaggaagaagggagctgcagcagcttcatcttagggtgcctttggattagaaatgaaatacaaaaagattgacagtttttggtttgtttgagagttgaggcttcttttttggagctacttagtgattttgtccgaaactgttaaattagccactttctgcccatacacaagtatagaaatgcttacagttttatattttcagtcttttttttttttgctttcagtcattgtgctttatctcgttgacatcctctctatcatcaattcatcatctcaaaaaaaaa

SEQ ID NO: 1849 - DNA, 651 bp, Elaeis guineensis
  misc_feature (626)..(626): n is a, c, g, or t
  misc_feature (636)..(636): n is a, c, g, or t
atctcgtgccgaattcggcacgaggtgagtgcgcgctcgtgtttcttgcccgccgctaagccgacctcagaaggggcgaccggggagaacaccgttccggaatggggaagggcacggggagctttgggaagaggaggaacaagacccacacgctctgcgtcaggtgcggccgcaggagtttccacctccagaagagccgttgcgcctcctgcggataccccgccgctcgaatccgcaagtataattggagcgtgaaggccataaggagaaagacaacaggcacgggaaggatgaggtatcttcgtcatctgcctcgaaggttcaagagcaatttcagagaaggaactcaagcaactccaaggaagaagactgcagcagcggcagctctttaagcttgcttccatttggatcacaggcaccaagaagcattttaagcagttccattttttacctttgtttttttgaatctggtcaatttaggttgcagcaaatttctactattgaaaattgaaggatataatttttcacatgcttaattttgtcaagaccatttggttatccgaaggaaccatccacttcttgccacttgctaacttttgagtcaattaaatggagcttgaggggcnaaatgctccnacaaacatttcatat

SEQ ID NO: 1850 - DNA, 1518 bp, Amborella trichopoda
tcataactgagacggcaacaaataaaacccgatcccccacgctctgaaaatcttcttagcggcggaggagaagagagagaaagagggttgcaggagcaggagaagagaaatggggaagggaacggggagctttggcaagaggaggaataagacccacacactgtgtgtgaggtgtgggcgcaggagcttccatctccagaagagcaggtgttccgcctgtgcttacccagctgcccgtattcgcaaatataactggagtgtgaaggcgataaggaggaagacgacagggactggaaggatgaggtacctccgtcatatgcctcggcgcttcaagagcaacttcagagaaggaactgaagcagctcctaggaagaagatcgctgctgcttcattttgagcaacaccccaatcatggtctttgtgtcaaccgagtgttttcaaattttgttgcattttgttctcaacatatgctactttgattctggtttttcttcgaagactatcgtgctcctcaggaatttacttgttaattttccctgcggagtgcttgatatccatagggagtagttttcatggacaatttgaacttatcattatggttgaaaatgtggaatttcaataggtgcctattaatcattgagtatcttttgccaatatttgtgcatattagttatatttgctttcatatatgcagttattgtttggcacttaattcatcatgtggtgcactatagcagaatatatgtacatatatattttgaggtttaaaacttgttgatatcttgtgatgataatatcaacatctacagttctcaaacatccactgtggtatcaatcaaattcatgaagtgtatttggcaattaggactggacttctcttttggagctaaacatgcttatttttgctgtaatataatgagatctcgtactttagtttccatatgcacatgctagtatttacttatcgtaactatagatttttgttacttgtatattactagtaacaactctaggctgcccattgtttgtcactactggtagtaaggcttatttgtgaattgctaacacgtagtgtgtctctgaaatatgtgataaaacactgaagttttatgattttaagaattctatgaacatcctcatatggaggctaatggtggttataggtgagagcaaacaatcaccattccctagtttgagtttgggtagctaagagataacaatgagaatttcctttatttaaagggattatctttctaacaattataatcttagctgtgtggaggaagatatatattttaatgtggatcatgaggtgctatttttaagtttgatgtgaattgtgtggatgaagctctagcagtcagtgccaatgaaatggtcagtattcattcaatttgatcattcataacttgttctactagtgttatggtattacttatgaaaatttgggaaattgagaatctggcattatgataaatgccttcatgtagttcactattttttggcctataaaaaagc

SEQ ID NO: 1851 - DNA, 555 bp, Musa acuminata
ttttttttccgctcggagctcgccgaccctcggaaggggcgaccgaagtgaacacagccgcacaatggggaagggtacaggaagcttcggtaaacgaaggaacaagacccacaccctgtgcgtgaggtgcgggcggaggagctttcatctccagaagagccgctgcggctcctgtggctaccctgctgctcggatccgcaagtacaactggagtgtgaaggcaataaggagaaggacagcgggtacaggaaggatgagatatcttcgtcatgtgcctcgaaggttcaggagtaatttcagagaagggactgaagcaactccaaggaagaagtctgcatctgctgcagtttgaagggcagagagcatgtcttttcagttgcatcattgaaacgtgtttttggccggttatattgtttctctcgcacgtctgtttcgtgtcagaactctactgttgaagtgaaagactctgtcctttcgaacacatgctttgattggaaaacggtgtggtacgaatccactgcagtaagcttcagtaacattattgttctaataccg

SEQ ID NO: 1852 - DNA, 506 bp, Cicer arietinum
ggattagggtttgggcatccttcttctgaaatgggtaagggaacaggtagtttcggtaagagaaggaacaagacccacacactctgtattaggtgtggccgtcgcagtttccatctccagaaaagtcgctgctcagcatgtgcttacccagctgcacgtgtcaggaaatataactggagtgttaaggctattaggagaaagactactggaactggtaggatgaggtatttgcgtcatgtgcctcgcagattcaaaagtggattcagagaagggaccgaagctgcacccaggaagaagggagcagctgcctctgcataagaatttggaagatcattatcagctggtctaattaattttaggagctaagtttttgtgttggaacatggatcttctaaacattattctatcttttgttttgatttcctcttttaatatatagttgcattgtgtttcaacatgaggtttgtaagacaattttgttgtttaatgagaatttgagttggaga

SEQ ID NO: 1853 - DNA, 817 bp, Zingiber officinale
  misc_feature (811)..(813): n is a, c, g, or t
tcgctccgtcaaagagtgggacgatcgtgtaggaggtcgacgcatctgcgcgatggggaagggaacgggaagctttggaaagcggaggaacaagacccacactctttgcgtcaggtgcggccggaggagcttccacctccagaagagccggtgcggttcatgcggctaccctgctgcacgaatccgcaagtataattggagtgtgaaggcaattagaagaaagactacaggcactggaaggatgagatatcttcgccatgtgccgcgccggttcaagaacaactttagagaaggtactgaagcagcaccaaggaagaagactgttgctgcagctgtctaagtgagtggagaatatttgctgggtgattaactgatcagtttaaattgtttctttttagcttgtcgcgtcatgtgaggtcttccagaactttattcttgatcatcttgaagtgtgccctcctcgtgccgaattcggcacgaggattacatcacgtttaatcaaggatttctggttctacaaagacaacatattgaagattcataccctcgaagctactaaatataataacattgacggaattcatcatattttggaacaaaacacaccaaaatatttttaaaaaaaaaataaatgtgattgtatgcaaactaaatataactacataacaacattctcccgaggctggtcccacatggggagggcacctgagctcttcaattgtcctgccataatctagtgcactctgaaggctaaactttcagaaagccattagcgttcatctttgcctcgtgccgaattcggcacgaggcnnngtgc

SEQ ID NO: 1854 - DNA, 597 bp, Liriodendron tulipifera
ctcgcatccttctcgattgagctagggtttctccagctgcaaaaatgggaaaaggaacgggaagcttcggaaagaggaggaacaagacccacacgctctgcgtgcgctgcggccgccgtagcttccatctgcagaagagcagatgcgccgcttgtggatatcctgctgcccggatccgcaaatataactggagcgtgaaggcgatccggcgcaagactaccggaaccggaaggatgaggtatctccgtcacttgcctcgcagattcaagagcaatttcagagaaggtacccaagcagctccaaggaagaacgctgctgctgctgcgttttaacgcattaaaacaggtgttttgggtgtaatcttggcactctgtttttcgtttaattttcttgaattctagaaactcagttttggatctttgtttgatgagctttactcaattgccatagactacttccatttttttttgagaattgagtattgttaatgacaatcgtaatgcttgtttttttaattaatcgaatcgagaattcttattttatggctgagagctaagtttaagatttaaattgattcatgtatcatctgttttttct

SEQ ID NO: 1855 - DNA, 604 bp, Platanus occidentalis
aaaggaacaggaagcttcggtaagaggaggaacaagactcacacgctctgtgtgagatgtggacgccgcagcttccatcttcagaaaagcagatgcgccgcctgtggctaccctgccgcccggatcaggaaatataactggagtgtgaaggctattaggaggaaaaccactggaactggtcggatgaggtacctccgccacctacctcgcaggttcaagagtaacttcagagaaggtactgaggcagcaccgaggaagaagggagctgctgccgcctaaataggtgtaagaggaggattttggagctaattttggtagtcagttttagtttcaattattctagtttctagaaactaggttttagtaatctatcggttctggaaactagttttcgagctttgtttgattaatgttgttagcagcagatatctctatcttgggtttggatgaattgcgttttcttggtactcttttttgtttaatcattaagagcctcggattctcatttgttataaaatagatcttgcagttggtactttacccctatatgtcatatgtttctgttgattgaaatctactggaatagccaacggtagctaagaaa

SEQ ID NO: 1856 - DNA, 581 bp, Vinca minor
aatctcgagacaagagggaaactagggtttctgcaactctgccggagctatggggaaaggaacaggaagctttggtaaaaggaggaacaagacacataccttatgtattaggtgtggtcgccggagcttccatcttcagaagagccgctgctctgcttgtgcttatccggctgcccgcaagaggacatataactggagtgtgaaggcaattaggagaaagacaactggaactggacgcatgaggtacttgcgtcatgtgccccgcagattcaagactaacttcagagaaggtactgaagctgctccaaggaagaaggcagctgctgcatctacttgagtgtgttgtttcttgagggtactctgtagttttttgctaagttatttagtattacttagtattcgaacagcggaaagttttgctgaacatcatttcaagggctttgtacccattttatttacattttttgaatttgtactatttcatttggatctttaatgcgaatgaacgagtggctattggtagttgttatcctataaatgtgggattgttttctgttctgaagctgccgaggctttatgat

SEQ ID NO: 1857 - DNA, 636 bp, Zostera marina
ggggactcgcaaatcattatcgttcctctccgccgccgtgtaattaccaggaccgaacaaccctcgttttttttgcgataatccatgggtaagggaactgggagtttcggaaagaggcggaacaagacacatacgctttgcattaggtgcgggaggaggagttttcatctccagaagagcacttgctcttcatgtggttaccctgctgcccgtatccgcaaatacaactggagtcaaaaagcccttaggcgaaagaccactggtacaggaaggatgaggtatcttagtaatgttcctcgaaggttcaagactaatttcagagaaggaactcaagcagctccaaggaagcctattgctgccgcataagcagctccggacaaactgtttttttgcctatcttaattttaatatgtgtttctgttacatcattggatgaatcttggttcgtattttcggttttaaattatcatgttgtttttcagattatttctcaactttaagtattatcagtatattcagtactagtaaattttcaatcaatcatttatttttctttaagatgaaagttttttttcaattttttttaacgttgatgcaaaacattgtaacgtgtatcaaaatatttgatttgtatta

SEQ ID NO: 1858 - DNA, 1060 bp, Elaeis guineensis
atctcgtgccgaattcggcacgaggtgagtgcgcgctcgtgtttcttgcccgccgccaagccgacctcagaaggggcgaccggggagaacaccgttccggaatggggaagggcacggggagctttgggaagaggaggaacaagacccacacgctctgcgtcaggtgcggccgcaggagtttccacctccagaagagccgttgcgcctcctgcggataccccgccgctcgaatccgcaagtataattggagcgtgaaggccataaggagaaagacaacaggcacgggaaggatgaggtatcttcgtcatctgcctcgaaggttcaagagcaatttcagagaaggaactcaagcaactccaaggaagaagactgcagcagtggcagctctttaagcttgcttccatttggatcacaggcaccaagaagcattttaagcagttccattttttacctttgtttttttgaatctggtcaatttaggttgcagcaaatttctactattgaaaattgaaggatataatttttcacatgcttaattttgtcaaagaccatttggttatccgaaggaaccatccacttcttgccacttgctaacttttgagtcaattaaatggagcttgaggggctgtcttctgcttggtcggatttttatccactattcttctatcattgagtttctagtttgctgcttgatgtttcttttgttcatatctgttggttgccagggaggctctggctgacaagcgcaatggtgctggttcgagtatgggcccatccatgtgtgctaaaaacaagattaaaggtgcttgcgaattctatcatcctcccctgctaataggctctggcaaaatgctggtaatcagtttaattagcggtcggcacaatgaaggataaatagcgggagatgagatgatgcaattttgtgcagtgaacgccatagaagtgtccaaatgtacctgtgattatgcttatacaatttcctattagatagactgagatatgggtatcatgcttatacaatttccagttaagagtgagatataaatatcttgtacacatt

SEQ ID NO: 1859 - DNA, 513 bp, Catharanthus roseus
aagaattcggcacgaggcttgctagggttttgtgttctcctcttcacaaatgggaaaaggtacaggaagtttcggtaagaggcgaaacaagactcatacactctgtgttagatgcggtcgccgtagcttccatcttcaaaagagtcgctgtggttcctgtggttacccagcagctcgcctacgtaaatataattggagtgtcaaggctatcagaagaaagaccaccggaactggtcgtatgaggtatctccgtcatgttacagttagattcaagactaatttcagggagggcacagaggcagcaccaaggaagaagggagctgcagcagcttcatcttagggtgccttttgattagaaatgaaatacaaaaagattgacagtttttggtttgtttgagagttgaggcttcttttttggagctacttagtgattttgtccgaaactgttaaattagccactttctgcccatacacaagtatagaaatgcttaccctcgtgccgaattctttgga

SEQ ID NO: 1860 - DNA, 510 bp, Secale cereale
gggaaccgggagcttcggcaagcgccggaacaagacccacacgctgtgcatccgctgcggccgtcgcagcttccacctgcagaagagcacctgctcctcgtgcggctaccccgccgcccgcatccgcaagtacaactggagtgtgaaggccattaggaggaagaccaccggcaccgggaggatgaggtacatgcgccacgtgcccaggcggttcaagagcaacttcagagagggaactgaggccgcaccaaggagcaagggtgcctcttccagcggcaactaggcgcggcagtcttgacttgttaagtgaagcggagccttgatcatcaaacttagctttttttttgctgctttctactggaattctatgtttctatgtcgagaggcagacgatatgatgcctggttatgttatttgcacaattgtcgtggacgttaatccttaagttttgaatgttgaattgtgttgatgtcctgtgttagatgctgcatctcttgttcaatgtgcttt

SEQ ID NO: 1861 - DNA, 552 bp, Amsonia hubrichtii
atcttctccccttctcagatgggtaaaggaacaggaagtttcggtaagaggcgaaacaagactcacacactctgtgtgagatgcggtcgccgtagcttccatctccaaaagagccgatgtggttcctgtggctaccctgctgctcgcgtccgcaaatataactggagtgtcaaggcaatcagaagaaagaccaccggaactggtcgtatgaggtatctccgtcatgttgcagttagatttaagagtaacttcagagagggcatggaagcagcaccaaggaagaagggagctgctgcagcttcatcttaaatatcaaagatggcttttgtttttcagttgtgcctttcagttttttgtgcaatactgttaattagcgacttcaatcatatgaatatagaaatatatgtcacatttgctttagttttgctcagtatcattgtggttttagcccccgctggaaatccttttcagcatctcatcataatttgttcagtttctgttgagaaaattgcaaaagctgtttcatgtttgagagagagccttttactgcta

SEQ ID NO: 1862 - DNA, 967 bp, Aristolochia fimbriata
tgcacgacggctgtactatataagctaaagctttaacctgattcgaagtcttggcggacaaagctccggggctagggtttctgccaccgccacaatgggtaagggaaccgggagcttcggtaagaggaggaacaagacccatactctctgtgtgaggtgtggtcgccgcagcttccacctgcagaagagcaggtgcgccgcttgcggatatccttcaagccgcatccgcaaatataactggagtgtgaaggctattcgaaggaagacaactggaaccggtcgtatgaggtaccttcgtcacgtgcctcgtcggttcaagagcaattttagagaaggtaccgttgctgctcctaggaagaagggcgcagctgccgcttcctcttaagagagttttccaggaggtgccttggcctagacaacactgttttagtttacttttttctgttggaatctggaacagttatgtgttttttgctgtctgtcctccccccaagtgtgttcttatattagagagaattctcttgaatgtcagttttgattaaatgatatttagttgtagtctcagcttggtttcaatcctcttttattgctttgattactttgacatgtggagaccaagggtagctgttcatgtgtctgtgcactgtttttagttctctccagtgttaagtaattttgcagaaattgactctcgtgtcaaatgttaccttgggtctttttagtggtaagtttgtttggattttagtttcaccatggaaattggtgtgatcctcttccttttcatggagaaaagatagcatgatgaggattttttaaacaaacaaacaaaaacaatccaatgttacatgcctggccatatattttttatagtatcaacgtaaatttgtgaggctgtttgttgagttccaagtgtcaaaattgaatctatttagccttcgtcatcaatgtaacattattctgttggagc

SEQ ID NO: 1863 - DNA, 545 bp, Avena sativa
ggcgttcttcttctccacttcctcggcggcggcgcaggcgcaggcgcagcggcgagaacaagacaaggcgaaatgacgaagggtacgggcagcttcggcaagcgccggaacaagacgcacacgctgtgcatccgctgcggccgccgcagcttccacctgcagaagagcacctgctcctcctgcggctaccccgcggcccgcatccgcaagtacaactggagtgtgaaggccatcaggaggaagaccactggctctggaaggatgaggtacatgcgccacgtgcccaggaggttcaagagcaacttcagagagggaactgaggccaaaccaaggaacaagggagcttcgtccagcggcaactaggagtcagtggcagtcttcacttgttaggctataagcagagccctgatcgttgaacttagctttattttgctgcttttctactggagaattctgtgtttctgtgtcgagaggcagacgatgcctggtattatgttatttgcacaattgttgtgaacgttaatccatcagttttgaatgttgaa

SEQ ID NO: 1864 - DNA, 532 bp, Panicum virgatum
tgaagtggtcggtaagttctcctcggcggcggcggcggcggcaagcgaagaaggcgtcggcgaaatgggcaagggtacggggagcttcggcaagcgccggaacaagacgcacacgctgtgcgtgcgctgcggccgccgtagctttcacctgcagaagagcacctgctcctcatgcggctaccccgcggcccgcatccgcaagtacaactggagcataaaggctattaggaggaagactactggcacagggaggatgaggtaccttcgccatgtgccccggaggttcaagagcaacttcagagagggaactgaggccgtgtcaaggaagaagggagctgcttctagcgccaactaagcatgttcaccacctatgctaggcaggaccgtgggtcatgaaactatgtttttgttgctttatttctatgttcctaaattgagaggcaaacgatgcttgtctgtgttatttcatatcctggatgttaaacgtactgttttgaatgtcgaatcaagccaggttgttagttgtcaccct

SEQ ID NO: 1865 - DNA, 534 bp, Panicum virgatum
gagttcttctcctcggcggcggcggcggcaagtgaagaaggcgacggcgaaatgggcaagggtacggggagcttcggcaagcgccggaacaagacgcacacgctgtgcgtgcgctgcggccgccgtagctttcacctgcagaagagcacctgctcctcatgtggctaccccgcggcccgcatccgcaagtataactggagcataaaggctattaggaggaagactactggcacagggaggatgaggtaccttcgccacgtgccccggaggttcaagagcaacttcagagagggaactgaggccgtgtcaaggaagaagggagctgcttctggcgccaactaagtgtgtgttctccacttatgctaggcaggaccgtgggtcaatgaatctagtgtttttgttgctttacttctatgttcctaaattgagaggcaaacgatgcttatctatgttatttcatatcctggatgttaatccttactgtttcgaatgtcgaatcatgccatgtgttgttagttgtcaccctatttacag

SEQ ID NO: 1866 - DNA, 629 bp, Panicum virgatum
acggatcgactctctaagaagactctgaagtgggcgagttcttctcctcggcggcggcggcaagcgaagaagccggcggcgaaatgggcaagggtacgggaagcttcggcaagcgccggaacaagacgcacacgctgtgcgtgcgctgcggccgccgcagctttcacctgcagaagagcacctgctcctcctgcggctacccagccgcccgtatccgcaagtacaactggagtgtgaaggccattagaaggaagactactggcacagggaggatgaggtaccttcgtcacgtgccacggaggttcaagagcaacttcacagagggaactgaggctgtatcacggaagaagggagcttctgctggtaccaactaagtgtgttctccacttacactaggccgggctgtggatcatgaaactaatgttttctttttctttacttctatgttcctgaattgagaggcaaacaatgcttgtctatgttatttcatattatgtatgttaatccttcagttttgaatgttgaaactttccagattgttagttgtcactctatttacagaattaaatctgcagctgcctgtgtgatgttgcttatgttaactgctatgatttcagtgaatgatgtaa

SEQ ID NO: 1867 - DNA, 1193 bp, Musa acuminata
gtcttcgttgggctccacaggcttggtttgacccgatatccccgtatgaaatcccgaagcaaatggcatcccggcggtctctcgcttcgcggctagggttttaccgagagcagctccgatggggaagggaaccggcagcttcgggaagcggaggaacaagacccataccctctgcgtccgctgcggccgccgcagcttccaccttcagaagagccgctgtggagcctgcggttacccatccagccggatccgcaaatataactggagtgtgaaggcgatccggaggaagacgacgggaactgggaggatgaggtacctccgccatgttccgcgtcgcttcaagagcaacttctgcgaaggcactcaagcggctcccaggaagaagcccgcagctgcggcgtagttgcaatacgtgggaaggagttgacttttttctttacgatcctatgttttactgcaaacgttagataattgttctgcatgttggaaatggattatgtaggtttgcttttttttctggaaatcatttggaatttttgtgttttgaatttaaaggttcgaagcttgtgatttaaacttaaaggtttgtctgtgaacttacatcttcgtaatattaatcatctggttgcttcagacgtattgtttcactttcagactcccgcaagactttcagactcccgcaagacgtaaaatttttgcatttcggatgctgggtttagtagcgtagtcatcagatccacaagtccaatgaactttttgacaaatacgagcttatggtctctttttgtggaatgggtcatttccttcctttgtcggatgcaggttaagctaatgaggagatgaatttaatggcgacgagtacagcattttctgctgccagcgatccaaaaattgaagcttcattggaccaggaaaagcctccaccagcctgatcagagagaagcctgaaggctatgaaagggacctattgctgaaggcatacaagtgctgcagctgcactctccatgtcaattggagtaacaccaaacttggatctcaggaactctgtaagctgcatgatccacaaatgtgttggcactgcaccaaacttgtagtgttaatgcactgtggtagcttcatgccctgatattgttcatcatgtcaattttggaacacaattattgccgagaaatattgcaactatgaagaactag

SEQ ID NO: 1868 - DNA, 573 bp, Phaseolus coccineus
agggtttgtgctctgctgctacaatggggaagggaacagggagtttcggtaagaggagaaacaagacccacaccctctgcgtgagatgtggccgtcgcagcttccacctccagaagagtcggtgttcggcgtgtgctttcccagcagcgcgcactagaaaatataactggagcgtgaaggccattaggagaaagaccactggaactggaaggatgaggtacttgcgtcacgtgcctcgcagattcaagagcggcttcagagagggtaccgaggctgcacccaggaagaggggagctgctgccaatgcctaagctttggaaggtagcaatttttctggatcattgaattgtaggagttcaggctttggtgttgtgcgaaaccctgtggaacatttttttttgctgtcattttaatctcatttgatatatatggattgtatttcaacttgaggatgatgctaaggaattttggtttgatattttttctcacgtctatattttagtttacaactcaggccttacttttggtattgtggttcgtagtgaaatataattaactagttttggtgattat

SEQ ID NO: 1869 - DNA, 568 bp, Cicer arietinum
ctatcggctgcgtttcaatgggtaagggaaccggaagttttggtaagaggaggaacaagactcacactctctgtatcaggtgtggccgccgcagtttccacctccagaaaagtcgatgctcagcatgcgcttaccccgctgctcgtgtcaggaaatataactggagtgttaaggcaattcgcagaaagaccactggaactggtaggatgaggtatttgcgtcatgttcctcgccgattcaagagtggcttcagagagggaactgaagctgcacctaggaagaagggaggagctgcaactgcttaagctttgaaaaagttgttgttttgctgggtacggagtttatagaattagcaatttttttgtatttttgataggggcaagtcttttagaactattgtttttgcagcctcattgctttggtcttattttctatttaatctgtacctttttttatatttcgatatgatgattataaaactatttgattgttcagttggattgtgttgcattagtacttttggttttagatgctactatttcagacatttgtcttgaagttttgccat

SEQ ID NO: 1870 - DNA, 824 bp, Aristolochia fimbriata
tagggtttcggatagcagaagaggtctgccgtctcttctactcttcaactccaaggggcgactgcggagaacacctgctcgaacgtcgaaatgggaaaaggtacgggaagttttggtaagaggaggaacaagactcacaccctctgcgtccgctgcggtcgtcggagttttcacctccagaagagccgatgcgcttcttgcggttaccctgcgagccgaatccggaagtataactggagcgtgaaggcaattaggaggaaaacaacaggaactgggaggatgaggtatcttcgacatgttcccaggaggttcaagagcggtttcagagaaggaacccaagcagcaccgaggaaacctgctgcagcctcttcaaattagttgattctctctttgatctggagctgagttttgttttgtctgactaggatatcattgaacgggttgttttgttacatctgttgagagtacacagtcataatgtttatcgtatggatctattttgaagttttgatgtgaaagtactttaatctagtagtactcctgctagactgcgaggaaagcgggttaaaggatttatcttttttgtgttaatttaatggcctcaaaagtagataatcggtttttggtagcttcatttctcagtcacgtatcttgagattgatgaatctcaagattgatcttagagacaactgtttgtactggttctaaaaatgggacgtaagatgtaccatttgtgggcaatcgtaatttaattcgtatatgacataatatgttaaattagtgcgtgtacgttgttctatgggaaaatattacacttcatgcta

SEQ ID NO: 1871 - DNA, 499 bp, Musa acuminata
gagggttttgtcgagggcacctccgatggggaagggaaccgggagcttcgggaagcggaggaacaagacccacactctctgcgtccgctgcggccgccgcagcttccacctacagaagagccgatgcggcgcttgcggctacccttccagcaggatccgcaaatacaactggagtgtgaaggctatccgtaggaagacgacgggaactgggaggatgaggtacctccgccacgtgccacgccgcttcaagaacaacttccgcgaaggtacgcaagcagccccaaggaagaagtccgtggctgcggcatagctgtagtatgcgaaaggagagatcggtattgtgcttctaccgtgaacaattttggatgctctaggatggattttatatgcttaatttttatggaattccattgggaactttgcattatgaaacttaaagaatgtcttggcatctatatagtgtgacataaatctagatgaacctaatgctctgattcaa

SEQ ID NO: 1872 - DNA, 594 bp, Musa acuminata
ggaaccaaatggcagtccggcagtctctcgcgtcgcggctagggttttcccgagagcagctccgatggggaagggaaccggcagcttcgggaagcggaggaacaagacccataccctctgcgtccgctgcggccgccgcagcttccaccttcagaagagccgctgtggagcctgcggttacccatccagccggatccgcaaatataactggagtgtgaaggcgatccggaggaagacgacgggaactgggaggatgaggtacctccgccatgttccgcgtcgcttcaagagcaacttctgcgaaggcactcaagcggctcccaggaagaagcccgcagctgcggcgtagttgcaatacgtgggaaggagttgacttttttctttactgatcctatgttttactgcaaacattagataattgttctggatgttggaaatggattatgtaggtttgcttttttctggaaatcgtttggaattttgtgttttgaatttaaaggttcgaagcttgtgatttaaacttaaaggtttgtctgtgaacttatatcttcataatattaatcatctggttgcttcaaaaaaaaaaaaaaaaaa

SEQ ID NO: 1873 - DNA, 585 bp, Cichorium intybus
ggccggataagctcgaagaggcaggatctcggcgacggcaatcaatggggaaaggtacagggagtttcggtaagagaaggaacaaaacacacacactgtgtgtccggtgtggtcgtcggagcttccatcttcagaagagtcgatgttctgcttgtgcttatcctgctgctcgcgtcaggaaatataactggagcgtgaaggcgatccgtaggaagacgactggaactggtcgcatgaggtatctccgtcatcttcctcgcagattcaagagcaacttcagagaaggcactcaagctgctcctaggaagatagctgctgcagcttcaacttaaagctccaaggaaatacatctaaaccgactatccgggtatcagtcaagcatatttcctttaggccaattagcgtaggcgaacatcgtttggtgctattaatccgtgatctggtttgagttttgtttggaaatctgttattctgatttatggatcatgatacattttcattaatcgttcgtgatgataaacacattttgctctttatcgatccttgctactcttccaaaagaaaaaaaaaagtccgtctcggagc

SEQ ID NO: 1874 - DNA, 701 bp, Cirsium arvense
gtttatgagatcaatcattagacgatcagagtattcagccgttggcgcaagggacctgctccgaagaatttaggttttttggaacctcattgcaatggggaaaggaacagggagttttggtaagagaaggaacaaaacacacactttgtgtataaggtgtggtcgtcgcagcttccatctccagaagagccgatgctctgcttgtgcttatcctgctgctcgcgtcaggaaatacaactggagtgtgaaggcgattcgtaggaagacaaccggaaccggacgtatgaggtatctccgtaatgtgcctcgcagattcaagagcaacttcagagaaggaactcaagctgctccaaggaagatcgctgctgcatcttcggcttaaatgatcaaaagttttgtgaagtatcatttgatcttcaattgtggttcgttttgtttagaaatttgtgatttttaatcatggagatacatacacttgctctgttttttaatcaagtagttcataacttcatacggtacccatatatagcacacacattcaaagaaaaaaagatgaagtgtgttttattagtagcttttaccttctaaacagcccagcaacaactagtttttcatggcatgggcaaaatacaaaaaaaacaattaacttagtataaataaatttactataaataatcatcaaaaagaacttgtactaaaaa

SEQ ID NO: 1875 - DNA, 535 bp, Ipomoea batatas
tcgggccttacggccggggcttccagtttgagattagggtttctgcaactgttcagcaatggggaagggaacagggagctttgggaagaggagaaacaagacccacactctctgtgtgaggtgtggccgtcgcagcttccatctccagaagagccgctgctcggcttgtgcttacccagccgcccgcaagaggacttataactggagcgtgaaggcgatccgtagaaagacgactggaactggccgcatgaggtatctccgccacgtgcctcgccgattcaagaccaacttcagggaaggtactgaagcagctccaaggaagaaggcagcagcagcttctgcttgaagttctttgagggtgaatctatgaaggttacttttaagttttcattttgatacttcaaagaattagaacaagtgagatattgagggaccttatccattcaatccttagctgtgtttatgttcaagcgtgtatttcaattttgcttatgtgacagtaaattggttttgaatgctcattttctttatggtg

SEQ ID NO: 1876 - DNA, 469 bp, Ipomoea nil
ggagatctactgcgaacttcagaagccagggtttttcgcctccgctgcgcaaatgggaaaaggtaccggaagttttggtaagcggaggaacaagacacatacactatgtgtgagatgcggccgccgcagcttccatatccagaagagccggtgttccgcttgtgcctatcctgctgcacgcattagaaaatataattggagtgtcaaggcaattaggagaaagactactggaactggccgcatgaggtatcttcgcaatgttcctcgtagattcaagaccaacttcagagaaggtactgaggcaactccaaggaagaagggagcagcagcagcctcttaaatttcatttcctcagttttagcagtgtttttattcttccaagagtttcccaaattttattacaaaacatgtttggtttttgcttgttagaggaccagttgttgtcaatgtggattattttgttttctga

SEQ ID NO: 1877 - DNA, 591 bp, Petunia hybrida
gcgggggaacacttgcgactcataagaagtttcgggcaacagagcttaaggtcttttccacatccactgcacaaatgggaaaaggaacagggagttttggtaagaggaggaacaagacacacacactgtgtgtccgatgtggtcgtcgcagtttccatctccagaagagtcgttgctctgcttgtgcttaccctgctgctcgtctcagaaaatataactggagcgtcaaggcacttagaagaaagaccactggaactggtcgcatgaggtatctccgcaatgtgccccgcagattcaagaccaacttcagagaaggtaccgaggcagctccaaggaagaagggtgctgctgcagcctcttaagaacgttgtttcattttgagttttcaccttgtattccctgatgaaccaagtcatgaaatatttgttcatcgagtattatctgtcctttgtttgtttggagttgttgctatttaagacctagatccagtggcgattgctttttgtcctttatatagtaagtagttcatttacattcctaagcctaacagtttgaaacaaatgattccctctttaatgatgaatataactg

SEQ ID NO: 1878 - DNA, 496 bp, Salvia sclarea
agaagttagggtttctgcaactttacagcgatgggcaagggaacggggagctttggaaagaggaggaacaagacacacacactgtgtgttaggtgcggccgccgcagctttcacctccagaagagccgctgctccgcctgtgcttatcctgctgctcgcaagaggacatacaactggagtgtgaaggccattcgccgaaagacaactggcactggacgcatgaggtatctccgccacgttccccggagattcaagaccaatttcagagaaggtaccgaagctgccccaaggaagaaggcagctgctgcatctgcttaaggtcctaatctggagagtgcctttgattgtactttcccttggtatttttatagtactagagagcaaatgaattttgaaacccgtttgaaaggcaattttgccaattggatacttagttttgtgctaattatgttgatgtactttgttttgcatttcaatacagatatctgaaagacta

SEQ ID NO: 1879 - DNA, 347 bp, Salvia sclarea
gggggccgagcttaggagagagagaatctagggtttctgcagcagcaccacagcaatggggaagggaaccgggagtttcggaaagaggaggaacaagacacacacactgtgtgtgaggtgcggccgccgcagcttccacttgcagaagagccgctgctccgcctgcgcttacccagcagctcgcaagaggacatacaactggagtgtgaaagccatccgtagaaagaccaccggaaccggacgcatgaggtatctccgccatgtgccccgcagattcaagacaaacttcagagaaggtaccgaggctgcaccaaggaagaaggcagcagctgcctcggcttaaggtc

SEQ ID NO: 1880 - DNA, 913 bp, Tabernaemontana elegans
gaacctcagagagaaactagggtttctgcaactcggcggagcgatggggaagggaacagggagctttggtaaaagaagaaacaagacccacacgctctgcgttaggtgtgggcgtcgcagcttccatcttcagaaaagccgctgcgctgcttgtggttaccctgctgcccgcaagaggaaatataactggagtgtgaaggcaattaggagaaagactactggaactggacgcatgaggtacctccgccacgtgccccgcagatttaagaccaacttcagagaaggtacccaagcggctccaaggaagaaggcagcagctgcatctgcttgagagtattgattctggagggtactcacaattgtagtttttgctcggttctttagtattccttagtattcaaacagctgaaatttttgcagaacatcatttgaagggttttgtgcccatttgaccgttgagtttggttaccttttgaatatgtactatttcatttggatccttaatacgaataaatgagtggctattggtagttggatttatatttatgctgctacttgaatttttattttctttctctgggattattttctgatgtgaggctggtatttgccatgtaagagtttcttcaattcttaaggttttgaaagtcatgctttcatgaatagttgttatgaactatctaatgcctatatactctattccttaatggaatgtacttagtataattcctgagtacagtttgcaagctgcctaatcatattactcaatgaatatgtcaaggagcgggtaaagaggaaaattgatgctgggattcctgagggcagatgctacctgccattttttattccatgctccaaaagtaggtggaccgaagattgtcttctctatcttcctagaagaacagataatgag

SEQ ID NO: 1881 - DNA, 491 bp, Fraxinus spp
ttctgcaactggacaacaatggggaagggaacagggagctttggtaagaggaggaacaagacacacacgattgtgtgtgaggtgtggccgccgcagcttccacctccaaaagagccgctgctccgcctgtgcataccctgctgcccgcaagaggacatataactggagcgtgaaggctatccggagaaagactactggaacggggcgcatgaggtacctacgccatgtgccgcgcagattcaagaccaacttcagagaaggtactcaagcggcaccaaggaagaaggcagcagcagcttctgcttaattttgatgggttctttggattttacttttcttagctcctctttgaagtattagagagcaaactgaatttggaaacttcacttgtccgcatttcatgatgaaattgaatttacattttccgttttgtgccttaatcttctcaatagtatggataatcagatgccatttatctattaattttaatg

SEQ ID NO: 1882 - DNA, 535 bp, Musa acuminata
gcggtctctaactcgcggctagggttttatcgagggcaactgcgatggggaagggaaccgggagcttcggcaagcggcggaacaagacccacaccctctgcgtccgctgcggccgccgcagctttcacctccagaagagccgctgcggagcctgcggctatccttccagccggatccgcaaatataattggagtgtgaaggcgatccggaggaagacgacgggaactgggaggatgaggtacctccgccatgtcccacgccgcttcaagagcaacttccgcgaaggtactcaagcagctccccggaagaaggcagtggctgcagcgtagtcctaagacgtggggaagagttaattttctatttatgatattttgcttctactacaaactttagatatttgttttggatgctggaaatgaattctgtagttctattgtttatgggagatctttgaaattttgcgtttgatactcaaaaagttgtctgtggatttacaactttcctaatagtaatgtggttgaaatttcatgtttct

SEQ ID NO: 1883 - DNA, 567 bp, Phalaenopsis aphrodite
gctccttctcctccttcctgccgccggtcttcttcgaaatgggaaaaggtacgggatctttcggcaagagaaggaacaagactcatacgttatgcgtgcggtgcggccggaggagctttcaccttcaaaagagcacctgctcctcctgcggctacccagctgctcgcattcgcaagtacaattggagtatcaaagcaatcaggaggaaaactactggcacaggaagaatgagatatcttcgccatcttcctcgtaggttcaagagcaactttagagaaggaacccaagctgcacccaggaagagggcagctgctgctgctgcttctgctgcattttaagcttttgttgattttgacattttagtgtttttttgaaccattatcttggttttgttgtggttcgattggcttcaattttcatttttaactattatctgaatttgttcaactcttcttattcattggccttgtttattttcttcagtgtagtgatgaatgacagagttttcttttattgtttgtctaatgggacccagcgataatattgaactgaaaaaaaaaaaaaaaa

SEQ ID NO: 1884 - DNA, 581 bp, Phalaenopsis aphrodite
gctccttctcctccttcctgccgccggcttcttcgaaatgggaaaaggtacgggatctttcggcaagagaaggaacaagactcatacgttatgcgtgcggtgcggccggaggagttttcaccttcaaaagagcacctgctcttcctgcggctacccagctgctcgcattcgcaagtacaattggagtatcaaagcaatcaggaggaaaactactggcacaggaagaatgagatatcttcgccatcttcctcgtaggttcaagagcaacttcagagaaggaacccaagctgcacccaggaagagggcagctgctgctgctgcttctgctgcattttaagcttttgttgatttttacatttcagtgtttttttttaaccattatcttggttttgttgtggttcgattggcttcaatcttcattttaaccattatctgaatttgttcaacttttcttattcattgggcttgtttattttcttcagtgtagtgatgaatgacatagttttcttttattatgtctaatggtgccagtgataatattgaaccgattgcagttgcccttgtttttggtggtttgagta

SEQ ID NO: 1885 - DNA, 605 bp, Elaeis guineensis
tcaggtttaatccgcagcgaagcagaacagatgggtaagggaacggggagcttcgggaagcggaggaacaagacccacaccctctgcgtccgctgcgggcgccggagcttccaccttcagaagagccgatgcgccgcctgcgggtacccgtccgcccggatccgcaaatataactggagcgtgaaggcgattcggagaaagacgaccgggactgggaggatgaggtacctccgccacgtccctcgccgcttcaagagcaacttccgtgaaggtactcaagcggctccgaggaaaaaggcggcggcctctgcatccttctaatttttgaaaaagagcgaaatttatattcataattttgtgatttcccgttatttagctgaacttatgctgctattgtttgcttttctttttacggagaatgtgggtgtggcttcgatcttgtctgattagagacttactgaatgaaggcagtatttttctttttatttctatattaagggttatattgtgatgtggttgtggatatcggtagcaaatacaaatttcttaagagaaaaaaaaaaaaaactaagtaagaacgtagttaccgaaacggtaacggaacc

SEQ ID NO: 1886 - DNA, 734 bp, Elaeis guineensis
gttttagcgagtacgcacttgtccttctcatttcgcgtccgccgccgagccaacctcagaaggtgcgaccgggaagaccgccgttccaaaatggggaagggcacggggagcttcgggaagaggaggaacaagacccacacgctctgcgtgaggtgcggccgcaggagcttccacctccagaagagccgttgcgcctcctgtggatacccttccgctcgaatccgcaagtataattggagtgtaaaggccataaggaggaagacaacaggcacaggaaggatgaggtatcttcgtcacgtgcctcgaaggttcaagagcaatttcagagaaggaactcaagcaactccaaggaatagggctgctgcagcagcatcttcttaacagggtcagagagctgcttccatttggatgacagtcaccaggaagcattttgatcagttttagtttaccagtttttttgtttgtttgtttgtttgattctagtcaagttaggttttagcaaatttttgttaccgagaattgaaggatataattttttacatgcttaatttggttaaaggcagtttggttcaggatgaaccattcttctgtcatcattcgctgtttactttggagtcaattaaatggagcctactgaggagctgtatcttcttcttggttgagttcccaggtgctattcttctataaatgagtttctggttggctgtttgaaatttcttttagttcaacaaaaa

SEQ ID NO: 1887 - DNA, 491 bp, Allium cepa
tttcatttctgatcggccgccagcacaaaaatgggtaagggaacagggagtttcggtaagaggagaaacaagactcatactttatgcgttcgatgcggccgccgcagcttccatcttcagaaaagccgttgcgcctcctgtggcttccctgctgcccgaacccgcaaatataactggagtgtcaaagctataaggagaaagacaaccggcactggtagaatgagatatcttcgtcatgtgtcccgtagattcaagagtggtttcagagaaggaactgaagctgctccgaggaagaaagctgcagctgctgcctcatcgtaatttgagtagtttatccatcttttgcgtgtactcaaacatcaaatttgtagctttgcttaattttgtgttgttttgctggagctagtttgtattatttttgtgatttttgtactcgttactccgaatatatccatgatggcgatagataccttgaatatgaacaatctttt

SEQ ID NO: 1888 - DNA, 693 bp, Ricinus communis
ctcggccacagcagatcagcactcctcaattctctcttaaccctaaaaccctagtataaatttcacaatcaacgccgctctctcttccttctttaacccagaacaaacttacacatccatagctagggtttctctgcaatgggtaagggaacaggaagttttggaaagagaaggaacaagacacacacactctgtgtcaggtgtggccgccgtagcttccacctccagaagagccgttgttccgcttgtgcttatcctgctgctcgcaagagaagttacaattggagtgtgaaggctattcgaagaaagacaactggaactggtaggatgaggtacctccgccacctgcctcggaggttcaagagtggttttagagaaggtactgaagcagcaccaaggaagaagggagcagcagcagcatctgcataaggtgtgaaagacttattttgggcaaaatttggttaccctgttatagatttagtcagcaattatgtgctgggccaagttttatgaggaaactatggatggtattcacttttggtgttatttaatcaattttacttttcattgatatgtagttttgattttgaaatgaagggttttcggattagaattgtttgaccattaattacttgaggtctcttttgaagtgcataaattttatcttctggttaatgtggttgaatttccaaa

SEQ ID NO: 1889 - DNA, 522 bp, Euphorbia peplus
gatcttctccaatgggtaagggtacaggaagttttggtaagagaaggaacaagacccacactctctgcgttaggtgtggccgccgtagcttccacctccagaagagccgctgctcggcctgtgctttccctgctgctcgcgtcaggaagtacaactggagtgagaaggctatccgaagaaagacaactggaactgggagaatgaggtatatgcgtcatgttcctcgcaggttcaagagtggcttcagagaaggtactcaagcagcacctaggaagaagggagcagccgctgcatctgcttaagatttgaatttttagacagcaagtacttgaagttttattgaccaattttaagtgaagaatgtttgatgttttttagtcaatttttagttttgtttgatctgcaattttgaatttgagtggtaagtacgagacttgtattgttctaccctccaatttactttctgagatatttacttaaaaggctcacaagtttgctattttggttaatgtgactgtccaa

SEQ ID NO: 1890 - DNA, 459 bp, Euphorbia peplus
ccaatgggtaagggaacgggaagtttcggaaagagaaggaacaagacacacactctctgcgttaggtgcggccgtcggagcttccacctccagaagagccgctgctctgcctgtgctttccctgctgctcgcgtcaggaagtataactggagtgagaaggccatccgaagaaagacaacaggaactgggagaatgaggtatatgcgtcatgttcctcgcaggttcaagagtggtttcagggaaggtactcaagcagcacctaggaagaagggagcagccgctgcatctgcttaagagtctttcttagcagaacttttagacagcaaggcttaaattcatattggacaagttttaagtgaagatgacttgtagaatgtgcttcacatttgattactttttagtctaagttttggttttcgcaattttgattttgagtgacgagtatgagaacttgtattg

SEQ ID NO: 1891 - DNA, 481 bp, Elaeis guineensis
atctccgcagcgaagcagaacagatgggtaagggaacggggagcttcgggaagcggaggaacaagacccacaccctctgcgtccgctgcgggcgccggagcttccaccttcagaagagccgatgcgccgcctgcgggtacccgtccgcccggatccgcaaatataactggagcgtgaaggcgattcggagaaagacgaccgggactgggaggatgaggtacctccgccacgtccctcgccgcttcaagagcaacttccgtgaaggtactcaagcggctccgaggaaaaaggcggcggcctctgcatccttctaatttttgaaaaagagcgaaatttatattcataattttgtgatttcccgttatttagctgaacttatgctgctattgtttgcttttctttttactgagaatgtgggtgtggcttcgatcttgtctgattagagacttactgaatgaaggcagtatttttctttttattt

SEQ ID NO: 1892 - DNA, 554 bp, Euphorbia esula
  misc_feature (121)..(121): n is a, c, g, or t
  misc_feature (127)..(127): n is a, c, g, or t
ggcacgaggcgcatcttctccaatgggtaagggtacaggaagttttggtaagagaaggaacaagacccacactctctgcgttaggtgtggccgccgtagcttccacctccagaagagccgntgctcngcctgtgctttccctgctgctcgcgtcaggaagtacaactggagtgagaaggctatccgaagaaagacaactggaactgggagaatgaggtatatgcgtcatgttcctcgcaggttcaagagtggcttcagagaaggtactcaagcagcacctaggaagaagggagcagccgctgcatctgcttaagatttgttaagattatttagacttttagacagcaagtacttgaagttttattggaccaattttaagtgaagaatgtttgatgttttttagtcaatttttagttttgtttgatctgcaattttgaatttgagtggtaagtacgagacttgtattgttctaccctccaatttactttctgagatatttacttaaaatgggcacaagtttgctattttggttaatgtgactgtccaattttaac

SEQ ID NO: 1893 - DNA, 914 bp, Musa acuminata
ctcctttatttcatttttgtttagaagcccgcctccatttttatgcatcgacgtaagcttcaacggctaggatgtgtttcctcgccgagtccgaatcgcgtccgtcagcttgagggctcggattgctccacgccgcgtataaaagaaagagccgaaccgactttcaagggagaacacggacgcgcgatgggtaagggaacggggagcttcgggaagcggaggaacaagacccacactctgtgcctgaggtgtgggcggaggagtttccacctccagaagagccggtgcggctcctgcggctaccctgccgctcggatccgcaagtataactggagtgtgaaagcaattaggagaaagacaacaggtacaggaaggatgagatatcttcgtcatgtgcctcgtaggttcaagagtaacttcagagaagggacccaagcaacttcaaggaagaaggctgcatctactgaagtttaaaaggatagagacaatgtctttactattggatcatcataaagtcttgtttatcagctactctttgtttgcgattcttctcttcgaacattattgttgaagataaagcttatgcaatttttaacatgcttgcttggaagacaatattttagtaattgcaattttgaatgagacatccatctattgatcttctgctttgcaatgttttaggctgtctggcgtttcttccaatcaattcatattctgtcagttctcctttcaatagccttctatatcataagatccagtttcattgtttatggtctaattcttgtcagctgtctcgatgttgtctgatattttgttgtgattacttatccattttatttagatagagcgtaagtgaaaagatttccgctgggaactttgcattcggaacaccttaattgaccaaattactgaag

SEQ ID NO: 1894 - DNA, 641 bp, Musa acuminata
atgatctcaccttttgaccgccacgtgtcactcacgaattggctggaaaatagtcacatgtttgttgtgctacaggctcctgcggccgacgcgttcgagactagggttttgttgagggcacctccgatggggaagggaaccgggagcttcgggaagcggaggaacaagacccacactctctgcgtccgctgcggccgccgcagcttccacctccagaaaagccgatgcggcgcttgcggctacccttccagcaggatccgcaaatacaactggagtgtcaaggctatccgtaggaatacgacgggaactgggaggatgaggtacctccgccacgtgccacgccgtttcaagaacaacttccgcgaaggtacgcaagcagccccaaggaagaagtccgtggctgcggcgtagctgtagtatgcggaaggagagattggtattgtgcttctaccgtgaacaattttggatgctttcggatggattttatatgtttaatttttatggaattccactgggaactttgcattatgaaacttcaagaatgtcttggcatctatatagtgtgacataaatctagatgaacctaatgctctgattcaactttcaatgctgtacagtattctggtagttcaatagtctgc

SEQ ID NO: 1895 - DNA, 606 bp, Vaccinium corymbosum
atagccgcccttcatctgcgtcctcagaatactagggtttctcctgctgcgcaccaatggggaagggaacagggagttttggtaagaggaggaacaagacccacaccctttgtgtgagatgtggccgccgcagcttccatctccagaagagccgatgctctgcttgtgctttccctgctgcccgcaagaggaaatataactggagtgtgaaggcgatccggaggaagacaaccgggactggtcgtatgaggtacctccgtaacgtgcctcgcagattcaagagtggtttcagagaagggactgaagcagctccaaggaagaaggcagcagcagctactgcttgagccattgaaggcttgtatcgggcgtgattagggtactgaattgtggtttcattttcaagtgtaggaactgagttcactttgggaacctcatttggaggctgttgctccaatttgatatctgttttaagatttttggtcttttaatctgtagtttattcgagtttttgatacaaatcagactatggctttgaattcccagtatcctgagtctaatgagatattacgatttccatggtatgattgaggtgcaagatagattatc

SEQ ID NO: 1896 - DNA, 519 bp, Amsonia hubrichtii
caagagagaaactagggtttctgctacttggcggagcgatggggaagggaacagggagctttggtaaaaggagaaacaagacccacacgctctgtgttaggtgtggacgtcgcagcttccatcttcagaagagccgctgcgctgcttgtggttaccctgctgcccgcaagaggaaatataactggagcgtgaaggcgattaggagaaagacaactggaactggacgcatgaggtatcttcgccatgtgccccgcagattcaagaccaactttagagaaggtacccaagctgctccaaggaagaaggcagcagtagcatctgcttgagagttggattctggagggtactcataattgtagtagtttttgctccgttatttagcatttccttagcattcaaagaaccgaaatttttgcagaacatcatttgaagggttttgtgcccatttgatcatcgagtatggttacttttttgaatatgtactattttcatttggatctttaatacgaatgaatgagt

SEQ ID NO: 1897 - DNA, 496 bp, Ocimum basilicum
gaagctagggtttctgctgctttactgccatgggtaagggaacgggaagctttggtaagaggaggaacaagacacacacactgtgtgtgaggtgcggccgccgcagcttccacctccagaagagccgctgctccgcctgcgcttatcctgctgctcgcaagaggacatacaactggagtgtgaaggccattcgcagaaagaccaccggtactggacgcatgaggtacctacgccatgtgccccgcagattcaagaccaatttcagagaaggcactgaagctgcaccaaggaagaaggcagttgctgcatctgcttagaggcctactttgaggagcgctgttgagtgtccttccccttggtatttttatagtactagagagcaactgaattttgtaagctatttctggaatttttatcaattgagttttggtttaactctgttgatgtactttgtttgacacttttaaaactgatgtctggaagaccttttatcatt

SEQ ID NO: 1898 - DNA, 570 bp, Ocimum basilicum
agggtttctgctgcttaaccctaacacccatggggaagggaacgggaagctttggtaagagaaggaacaagacacacactctgtgtgtgaggtgtggccgccgcagcttccaccttcagaagagccgctgctccgcctgtgcttatcctgctgctcgcaagaggacatacaactggagcgtgaaggccattcgcagaaagaccactggtactggacgaatgaggtatcttcgccatgtgccccgcagattcaagaccaacttcagagaaggtacggaagctgcaccaaggaagaaggcagttgctgcatctgcttaaggacctgattttgggagtgatgatgagtttcctttcctttgttatttttataatactagcaaacaagtgaattttgaaagccgttttgcagggcaattcgaccaatttgatacctagttctgtttatgtattttgtttgacattttaaaaccgacgaaatgctttttcctgtactaaagggtgttcttttctttgtgttagcttcaagtacttggttgtaggaatcttatatactttgtggcttgttggtgtc

SEQ ID NO: 1899 - DNA, 1128 bp, Citrus clementina
aagcttcccaggccagcagattagggtctaggaatttttattttttttaatttgtttccgcaaccgaagaagaaatggggaaaggaacaggaagctttggtaagagaaggaacaagactcacacactgtgcgtgagatgcggtcgcaggagtttccacatccagaagagccgatgcagcgcttgcgcttatcccgctgcccgtgttagaaaatataactggagtgtgaaggccatccgccgaaagaccactggaaccggacgcatgaggtaccttcgtcatgtgccacgcaggttcaagagtaacttcagagaaggtactgaagcagctccaaggaagaagaatgtggctgcatcttcttaagcttatgaaggaaatgatagtctgttttatcttgttatttgtatgtttgcaaacaagaattttggttcacaaagtgttacttattatcattcgcaagttttaaatattggagagttattatttttactgaattcattttttaatcctctcttttattattctaaggtaaatcaatatcatagatccttgtttttgatttgttaagagtttccagccttgaatatgtaaatgacacatctatttgttgggtctctccataacaccgagtccctttttcttcaatagcaaaggaaaggaaaagtgaagtcagacgaaaataaatggtttttagttaacggtgtttgtggtttatgttgcccaaggcttgagagctcttgaatggcaaggcctattgctcaagacaatgcttagttaagtcaatctatgcaatggaccttgagaaatgagagggagtattgttaacttgcaaggttttgctgttaagcagatttaaatatacacaggctgacggtttagtaatgtttgtctcccagattcttaggcctctgttagaagtcatttatgcagattcgattcttcattcagttcctccaattagaataccacaagaacacgatagcaaaccaaggggcagtaacactgagctgctgattgaagaaatcctgaattaaaaagcaagtatccgacggtctcatttgattctatatttcagagcacagaaagcataaaaactgaggtcatgcagcacccacctacacccttttcg

SEQ ID NO: 1900 - DNA, 617 bp, Cucurbita pepo
aggaattcgaaggcttcatcgtcgaatccgattaaatgggtaagggaacgggaagtttcggtaagaggaggaacaagacccacactctctgtgttaggtgtggccgtcgcagcttccacctgcagaagagtcgatgttccgcctgtgcatttccggctgcccgtaagcgaaaatataactggagcgtgaaggcgattaggaggaagaccactggaactgggcggatgagatacatgcgccatgttccacgcagattcaagagtggtttcagagaaggtactgaagcagcgcccaggagcaaaggagcagcagcgtctgcctaaaacattgaaggttaattgtggcacaactttagtactctattgtagtttctaggtgggttttgtgtttttggaccagaatctatatgaattttgttggataatgttattaccttcaataccgaagctcattttatttcttacagttttgtttatggaattcagatgattgggttcaaaccacttgagtcgtatacttattaatcattttatgagaggttaatactgatcgatattatcaccctgaaggctgaggtagaatgtattagtaagaaagtttggatgttaaaatcatga

SEQ ID NO: 1901 - DNA, 635 bp, Cucurbita pepo
gattattaaaacagccattttctcttctggaagctgcagatagaacttttccaccctagggtttcttcgtcctgcatcaatgggtaagggtacgggaagttttggtaagaggaggaacaagacccatactctctgtgtgcggtgcggccgccgcagcttccatctccagaagagtcggtgttcagcatgtgctttccctgctgcacgcaagcgaaagtataactggagtgtgaaggccattaggagaaagacaaccggaactggaaggatgaggtacatgcgccatgttccgcgtagattcaagagcggcttcagagagggtactgaagctgcacccaggaacaaaggagctgcagcatcagcataaggttttggaaggagttcaacttaatttcagttcccaactatagctttcagtagggtggctttactcgtctgagaatcatttcatataattttgttttctagttttgccttttcatgatttagttgaacgcggtttctttaatatttaatgttttgaaatttggacaaatgatgaatcagattatgcgtactctggtacttgttttgtgaacgaaaaaaaaaaaaaacaaaatctctgtcgttagactacactgtccgttctaggaacg

SEQ ID NO: 1902 - DNA, 549 bp, Cynara scolymus
  misc_feature (20)..(20): n is a, c, g, or t
  misc_feature (545)..(545): n is a, c, g, or t
cttggcggggagatagctcnagaacacgatttcgacgacggcaagcaatggggaaaggtactggaagcttcggtaagagaaggaacaagacacacactctgtgtgtccgctgtggtcgtcggagcttccatctccagaagagtcgatgttccgcatgtgcttatcctgcagctcgcgtgaggaaatataactggagcgtgaaggcgatccggaggaagacgactggtactggtcgcatgaggtatctccgtcatctgccacgcagattcaagagcaatttcagggaaggtactcaggctgctcccaggaagatagctgcatcggcttcgacttaagattctgaggaattacatccaaactaatatccggtatcaatcaagcatatttcctttagggcaattagtgtaggtgaacattgttttgtgctattaatcccgtaatctgtttttaagtcttgttttggaaattttgttattctgatttatgaatcatgactcattttgatgcaatcgtttgtgatgttaaacgttttgatgctcttttanaaac

SEQ ID NO: 1903 - DNA, 639 bp, Taraxacum officinale
catcagatcagagtatactgccgcttcccccttcgttccgactaaagggacgtgctcgaagaattaaggtttgtaggacctcgtaacaatggggaaaggaacagggagttttggtaagagaaggaacaaaacacatactttgtgtgtacggtgtgggcgccgtagcttccatctccagaagagccgatgctctgcttgcgcctaccctgctgctcgcgtcaggaaatataactggagtgtgaaggcgattcgtaggaagacaaccggaactggacgtatgaggtatttacgtaatgtgcctcgccgattcaagagcaacttcagagaaggtactcaagctgctccaaggaagattgctgcagcatcttcaacttgaattgagtttccatttttttgaacaagtttaatttagtgcgtgatcaagtattatgaacatcattagatgtgtttaatccagtgacttcaagttgtggttatgtttagaaattgtgatttttgatcatgatttaaatgatgttttagaatcaagcagttcattttgtacatctaaaagtgagaagcttgtaaaatccaagtggaagttgctaaaatataaacacgtactttaaagatttttcttgtaaaaaaaaaaaaaaaaaa

SEQ ID NO: 1904 - DNA, 573 bp, Taraxacum officinale
cggggatatagctagaagagcaggatcttggcacggcaaacaatggggaaaggtacagggagttttggtaagagaaggaacaaaacacacacactctgtgtccggtgtggtcgtcggagcttccatcttcagaagagtcgatgctctgcttgtgcttatcctgccgctcgcgtcaggaagtataactggagcgtgaaggcaatccgaaggaagacgactggtactggtcgcatgaggtatctccgtaatgttcctcgcaggttcaagagcaacttcagagaaggtactcaagctgcccctaggaagatcgcagctgcctcttcaacttaaagctccgaggaatcacatctaaatcaacattacgggtatcatcaagcatattttcgttaggtcaactagtgtagtcgaacatcgtttggttctattaatccagtgatctgttttaaaattttggaaatctgttattgacatttatggatatgacgcattttgatttaactgtttgtgatgttaaacgccttttgctctttatcgatcctttctgttcttccgctaaaaaaaaaaaaaaaaaaa

SEQ ID NO: 1905 - DNA, 659 bp, Solanum melongena
atcggaagaggacgctagggtttctccaactgcactgcaatgggtaagggaacaggaagctttggtaagaggaggaacaagactcacacactgtgtgtgagatgcggtcgccgcagtttccatctccagaagagtcgatgttctgcttgtgcctatcctgctgcccgtaaaagatcatacaactggagtgtgaaggcaatccgcagaaagacaactggtactggacgcatgaggtacctccgcaacgtccctcgcagattcaagactaatttcagagaagggactgaagcagctccaaggaaaaaggcagcagcagcttcagcttgaagcccatcgagagagtaattgaggaggttgctcttttatgatagcttcattttggtattcaattattagagagccaggaaattttgggaaagcttatttccggtgtttgatgtcaacattagaagtacttaaattttggaatgtgttgtttaaattgatattcagatacttgtggattttatttataggctgctttttaattttatttgctgtttgatgtcctctcagttgcttttgtctttgtgatttcgagaactgaggttttgagctcgtaattttactatgtttattcagcctatgccatcagtatatatcatcatttgttgctggtc

SEQ ID NO: 1906 - DNA, 569 bp, Fagopyrum esculentum
acgccgaaccgagttccttccgctctttgtttcagtctcccacctgcacatccctgaagttccgcttcatctgctgcttcaatggggaaaggaacagggagtttcggtaagcgaaggaacaagactcacacgctctgcgtgcgatgtggtcgtcgcagcttccacctccagaagagccgttgttccgcctgtgcttaccctgccgctcgcctgaggaagtataactggagtgtgaaggctattaggagaaagaccaccggaaccggtaggatgaggtacctccgcaatgttcctcgccgattcaagaccaacttcagagaaggaactcaagcaacaccaaggaaggtgtctgctgcagctgcttgaagaggttcgtaaggaggggatggagaatgtcaaattttgatttggggtactcttatataacttcaacccatatttttattggcctcttttggaagttgtggaactattgaaagtttgaaacatcatttcatgatctttagtctttactcatccgtgtagtcaaattgacccgagttattgaatgatttgtgtgatggtagctt

SEQ ID NO: 1907 - DNA, 529 bp, Fraxinus spp
atcgaatcggtgtgtacatttctttggctagagctcaaggataatctagggttactgcaactgcacaacgatggggaagggaacagggagctttggtaagaggaggaacaagacgcacacactgtgtgtgaggtgtggccgccgcagcttccacctccaaaagagtcgctgctcagcctgtgcataccctgctgcccgcaagaggacgtataactggagtgtgaaggccattcgtagaaagactaccggaacagggcgcatgagatacctgcgccatgtgccacgcagattcaagaccaacttcagagaaggtactcaagctgcaccaaggaagaaggctgcagcagcttctgcttaattcgatgggttcattgaattctacttttctagtttctctttcaagtattagagaacaagtgaatttggaaacttcatatgaaggcattcgttccatttcattatgaattgattttactttgtttgttttgttccttaatccttcttaagagttatggtatggattcagtag

SEQ ID NO: 1908 - DNA, 470 bp, Ipomoea batatas
ggtgcctgcaactgcatagcaatggggaagggaacagggagcttcggaaagaggaggaacaagactcacactctctgcgtgaggtgtggccgccggagcttccatctccagaagagccgctgctccgcatgtgcttaccccgctgcacgcaagagaacatacaactggagtgtgaaggcgatccgtagaaagaccactggaaccggccgtatgaggtatctccgcaacgtgccccgccgttttaagactaacttcagagaaggtactgaagcagctccaaggaagaaggcagcagcagcatctgcttgaaggccttagaacaaatgagattttgtgagggctgcttaaattgtaacttttcattttggtacttgcagtattagaacaaatgagaatttggttcactttattctaatgattttgttcccattactatatctttcaaaagttgaattcagattttgattgct

SEQ ID NO: 1909 - DNA, 541 bp, Ipomoea nil
gagtttgagattagggtttctgcaactgttcagcaatggggaagggaacggggagctttggaaagaggagaaacaagacccacactctctgtgtgaggtgtggccgtcgcagcttccatctccagaagagccgctgctcggcttgtgcttacccagccgcccgcaagaggacatataactggagcgtgaaggcgatccgtagaaagacgactggaactggccgcatgaggtatctccgcaacgtgcctcgccgattcaagaccaacttcagggaaggtactgaagcagctccaaggaagaaggcagcagcagcttctgcttgaagttcattgagggtgaatctatgaaggttacttttaagttttcattttgatacttcaaagaattagaacaagtgagatattgaggcaccttattgtgtgaccattcaatccttagctgtgtttatgttaagcgtgtatttcaattttgcttatgtgacagtaaatttgttttgaatgctctttttcttcatggtgttacttttctggcaaaaaaaaaa

SEQ ID NO: 1910 - DNA, 515 bp, Ipomoea nil
gaaggtgcctgcaactgcatagcaatggggaagggaacagggagcttcggaaagaggaggaacaagacccacactctctgtgtgaggtgtggccgccggagcttccatctccagaagagccgttgctccgcatgtgcttaccccgctgcacgcaagaggacgtacaactggagtgtgaaggcgatccgtagaaagaccaccggaaccggccgcatgaggtatctccgcaacgtgccccgccgttttaagaccaacttcagagaaggtactgaagcagctccaaggaagaaggcagcagcagcatctgcttgaaggccttagaacaaatgagattttgtgaaggctgcttaaattgtaacttttcattttggtacttgcagtattagaacaaatgagatttggtacactttattccaatgattttgttcccattactatatctttcaaaagttgaattcagattttgattactgatatggatggataagaaagttctattgattttaaaaaaaaaa

SEQ ID NO: 1911 - DNA, 528 bp, Lactuca sativa
ggtagctcgcagaagcaggatctcggcaacggcaagcaatgggtaaaggtacagggagtttcggtaagagaaggaacaaaacccacacactgtgtgtccggtgtggtcgtcggagtttccatcttcagaagagtcgatgctctgcttgtgcttatcctgctgctcgcgtcaggaaatataactggagcgtcaaggcgatccgaaggaagacgactggaactggtcgcatgaggtatctccgtaatcttccccgcagattcaagagcaacttcagagaaggtactcaagctgcgcctaggaagatcgctgctgcagcttcaacataaagctccaaggaatcacatctaaatcgactatacgggtatcaatcaagcatatttcctttagggcaattagtgtaggtgaacatcgtttggagctattaatcccgtagtctgttctaagttttttctttttgggaaatctgttattctgatttatggatgatgatgcattttgaattaagtgttattaaacacctttcgctct

SEQ ID NO: 1912 - DNA, 548 bp, Lactuca sativa
ggatctgggcaacggcaagcaatggggaaaggtacagggagtttcggtaagagaaggaacaaaacccacacactgtgtgtccgatgtggtcgtcggagcttccatcttcagaagagtcgatgctctgcttgtgcttatcctgctgctcgcgtcaggaaatataactggagcgtcaaggcgatccgaaggaagacgactggaactggtcgcatgaggtatctccgtaatctgcctcgcagattcaagagcaacttcagagaaggtactcaagctgctcctaggaagatcgctgctgcagcctcaacataaagctccaagtaatcacaactaaatcggctataccggtatcaatcaagcatatttcctttagggcaattagtgtaggtgaacatcgttttggagctgttaatccggtagtctgttctaaggtttttttttttttttttttgggggaaatctgttattctgatttatggatgatgatgcattttgaattaaatgtttgtgatgtgaaacacattttgctctttattgatcctttttactct

SEQ ID NO: 1913 - DNA, 533 bp, Glycyrrhiza uralensis
cctatggcaattagggttttgtttgcgatcttcttcttctgctgcacctacaatgggtaagggaacaggtagtttcggtaagaggaggaacaagacccacaccctctgtgtcaggtgtggccgccgcagcttccaccttcaaaagagtcgttgttccgcatgcgctttccctgctgcacgcacaaggaaatataactggagtgtgaaggctattaggagaaagactactgggactggtagaatgaggtacttgcgtcacgtccctcgcagattcaagagcggtttcagagaaggtaccgaagctgcacccaggaagaagggagcagctgcttctgcttaagcctttgaaagatcgttttcattttttgctataggagtaaggggttttattgttggggcctggctttgctgactctatggaacattgttattctatctgctattttcattttcttttaatatgtagttgctttgtgtttcaacatgaggattgtaagacattttggttgttcaaggagagttctttttgactt

SEQ ID NO: 1914 - DNA, 505 bp, Medicago truncatula
agggttttggaatcggcttcgcgcatctacaatgggtaagggaactggaagtttcggtaagaggaggaacaagacccacacactctgtgtcaggtgtggccgccgcagtttccatctccagaagagtagatgctccgcttgtgcttacccagctgctcgtgttaggaaatataactggagtgaaaaggcaatccgtaggaagactactggaaccggtaggatgaggtacttgcgcaacgttcctcgccgtttcaagagtggtttcagagagggaactgaagctgcacctaggaagaagggagctgcatctgcttaagcattttgacaattgttgttttgtttggtaccaagtttatttatagaattagtttgttgtttttgattggggcaaagttttttgaactatcgtttctacagcctcattggttttgtcttattgtctatttactgtgtactttcgttatatttcaatatgatgatgattataaaactatttcattgctgg

SEQ ID NO: 1915 - DNA, 608 bp, Medicago truncatula
atgtcattcactagggttttggaatcggcttcgcgcatctacaatgggtaagggaactggaagtttcggtaagaggaggaacaagacccacacactctgtgtcaggtgtggccgccgcagtttccatctccagaagagtagatgctccgcttgtgcttacccagctgctcgtgttaggaaatataactggagtgaaaaggcaatccgtaggaagactactggaaccggtaggatgaggtacttgcgcaacgttcctcgccgtttcaagagtggtttcagagagggaactgaagctgcacctaggaagaagggagctgcatctgcttaagcattttgacaattgttgttttgtttggtaccaagtttatttatagaattagtttgttgtttttgattggggcaaagttttttgaactatcgtttctacagcctcattggttttgtcttattgtctatttactgtgtactttcgttatatttcaatatgatgatgattataaaactatttcattgctggatcggttgtgttacattactagtttggaattaaatggttgttttagtagattaaatactaccgttatgataatatttctagtaatctaaac

SEQ ID NO: 1916 - DNA, 565 bp, Momordica charantia
gcagatacaatttctcctccctagggtttctgcgtcctgcaacaatggggaagggtacgggcagttttggtaagaggaggaacaagacccatactctctgtgtgcggtgcggccgccgcagcttccatctccagaagagtcgctgttcagcatgtgccttccctgctgctcgcaagcgcaaatataactggagtgtgaaggcaattaggagaaagacaaccggaactggtaggatgaggtacatgcgccatgtcccgcgtagattcaagagcggcttcagagagggtactgaagctgcacccaggagtaaaggagctgcagcatcagcataaggttttggaagaagttcgccttaatttcagtacccaactatagtttttaggagggttttactcaactgagaatcatttcatataattttgttttctagttttggcttttcatgatttagttgaacgcagtttatttgaaatgtattgttttcaattatggtcaaatgacgaatcagattgttcgtactgcttcttgattaagctgtttccagcgtgttctgttttgcccttat

SEQ ID NO: 1917 - DNA, 594 bp, Olea europaea
ctagagctcaaggaaaatctagggttcctggaactgcacaacaatggggaagggaacagggagctttggtaagaggaggaacaagacacacacattgtgtgtgaggtgtggccgccgcagcttccaccttcaaaagagccgctgctccgcttgtgcataccctgctgcccgcaagaggacatataattggagcgtgaaggctattcggagaaagactactggaacggggcgcatgaggtacctacgccatgtgccgcgcagattcaaaaccaactttagagaaggtactcaagcagcaccaaggaagaaggcagcagcagcttctgcttaattttgatggtttctttggattttacttttcttagctcctctttgaagtattagagaacaaatgaatttggaaacttcatttgaagggcatttgttcgcatttcatgatgatttgaatttacatttttcgttttgtgccttaatcttctcaatagtatggatggatcaaagaccattatatattaatttgaatgctcattcttggcatagttagaattgctaatttctcgagttatgaagttctcaaattttagtgtgtttgtc

SEQ ID NO: 1918 - DNA, 1129 bp, Citrus sinensis
aagcttcccaggccagcagattagggtctaggaatttttattttttttaatttgtttccgcaaccgaagaagaaatggggaaaggaacaggaagctttggtaagagaaggaacaagactcacacactgtgcgtgagatgcggtcgcaggagtttccacatccagaagagccgatgcagcgcttgcgcttatcccgctgcccgtgttagaaaatataactggagtgtgaaggccatccgccgaaagaccactggaaccggacgcatgaggtaccttcgtcatgtgccacgcaggttcaagagtaacttcagagaaggtactgaagcagctccaaggaagaagaatgtggctgcatcttcttaagcttatgaaggaaatgatagtctgttttatcttgttatttgtatgtttgcaaacaagaattttggttcacaaagtgttacttattatcattcgcaagttttaaatattggagagttattatttttactgaattcattttttaatcctctcttttattattctaaggtaaatcaatatcatagatccttgtttttgatttgttaagagtttccagccttgaatatgtaaatgacacatctatttgtcgggtctctccataacaccgagtccctttttcttcaatagcaaaggaaaggaaaagtgaagtcagacgaaaataaatggtttttagttaacggtgttggtggtttatgttgcccaagacttgagagctcttgaatggcaaggcctattgctcaagacaatgcttagttaagtcaatctatgcaatggaccttgagaaatgagagggagtattgttaacttgcaaggttttgctgttaagcagatttaaatatacacaggctgacggtttagtaatgtttatgtctcccagattcttaggcctcgttagaagtcatttatgcagattcgattcttcattcagttcctccaattagaataccacaagaacacgatagcaaaccaaggggcagtaacactgagctgctgattgaagaaatcctgaattaaaaagcaagtatccgacggtctcatttgattctatatttcagagcacagaaagcataaaaactgaggtcatgcagcacccacctacatccttttcg

SEQ ID NO: 1919 - DNA, 675 bp, Arachis hypogaea
ggggctctcagcagcttcgtcttcttcagccacataaaaaggttctttgctgcatcctctagggtttctgcatctgcttcaatgggtaagggaacagggagctttggtaagaggaggaacaagactcacaccctctgtgtgaggtgcggccgccgcagctttcacctccagaagagtcgctgctccgcctgcgctttccccgctgcacgcaagaggaaatataattggagcgtgaaggccatccgcagaaagaccaccggcaccggcaggatgaggtacctccgccacgtgcctcgccgattcaagagcggcttcagagaaggtactgaagctgcaccaaggaagaagggagcagctgcatctgcataagccttttggattagaagatcgttgtttggtggttaccgaattagagtggtagattgttattcttgtgttgttgacgcaaggcttttggaacatttgtttattttgatagcctcattgcttctgtcacttttggtcttgtttactttaattttgtagttgctattaaatttaaacgagatgattatcagactttttggatattcagtttgattgcatgacaattatagttttggtttcgaatggtttactttgccaaatatatactcttatgctcagaataatatctaaacattcataggatttaca

SEQ ID NO: 1920 - DNA, 1225 bp, Arachis hypogaea
atttcgcagtattcacttcattgtcgtcatcgtcaactcgcatatattaatataagaaacaacctttcttttcgccgtttctcttccagccacattctagggttagggtttcttctgcatctgcttcaatggggaagggaacagggagctttggaaagagaaggaacaagactcacacgctctgtgtgaggtgcggccgccgcagcttccatctccagaagagtcggtgctccgcttgcgctttccctgctgcccgcaagagaaaatataactggagtgtgaaggccattaggagaaagaccaccggaaccggtaggatgaggtacttgcgccacgtccctcgcaggttcaagagtggcttcagagaaggcacagaagctgcaccaaggaagaggggagctgctgctactgcctaaggctttcaaagattgtttcttttactcaatttataggattgcaagaattttatatattgaggcaaagttcactgagacattacttatcaattttgatttccttctacctttataattcttcaacatatcaatactgtaagactttttgtttgtttaacgagagttttttacatctaaatttttgctctgaagtatgttgaagctgtgttgatttatctgctttgatcttacacatgcatagtagtttctcccgcaggcctcgcttttccgctgtgttgatcagtctttcttaagtgtctaagtgattactgattgattcaatgcggattcatataatgtaaattctctaatgttgaatgtggctaatctataattagattttgtagtaatatgtctttgcatatttgtgtaattgaattatttcaggtggagctatgtgtctcggagttttatttgctgctaatatttttcctctgcgctagttactttgcttgacttgtttttctctagttaaagcagccaacataggttttaatataagaaatgagaacctggttgtaacaagctcaggccactaggcatagaaagttagaaacttaagtccaaatgcacagcaaccaagttaatatatgaaatccaatcgtattacctagagaagaaaggaaagcgataaatgagtttaggcttttgggtgttcttggtaaatggtatataaacttggctccttttggagtttacatagtaaactaagattttagccccaaagaataaactattgtatgtaatattaccatgtaaatgtagtttac

SEQ ID NO: 1921 - DNA, 608 bp, Salvia sclarea
ctactagaccttggctgtcactcaattttcttcgaccgctcacctcagccaggagaagctagagtttctgcaactttacagccatgggcaagggaacggggagtttcggaaagaggaggaacaagacacacacactgtgtgtgaggtgcggccgccgcagcttccatctccagaagagccgctgctccgcctgcgcttatcctgctgctcgcaagaggacatacaactggagcgtgaaggccatccgccgaaagaccaccggtactggacgcatgaggtatctccgtaatgtgccccgcagattcaagaccaatttcagagaaggtactgaagctgcaccaaggaagaaggcagctgctgcatctgcttgagggcctaatttggagagtgctgttgattctactttcttgggtatttttatagtactagagagcatatgaattttgaaacctgtttgaatgacaattttgccaattggatactttgtttcattctaatgctctgttttgaccccactattttgagttcttgtttgcttcaaatattgtcttaatacagttatattctttatcacctggttcttatgtccgagtatcataataggattg

SEQ ID NO: 1922 - DNA, 667 bp, Sarracenia psittacina
ttcatctgcggagccgccccttcatctgcttcgattagatctcagaaagttagggtttctacagctttgcaacaatgggaaaaggaacagggagcttcggtaagaggaggaacaagacacacacactctgtgtgagatgtggccgccggagctttcatcttcagaagagccgatgctccgcgtgtgcttttcccgcagcccgcaaaaggaaatataactggagtgtaaaggcgatccggaggaagacaactgggacaggtcgtatgaggtaccttcgccacgtacctcgcagattcaagagcggcttcagagaagggactgaagctgctccgaggaagaagggggctgcagcttctgcttgaggcaaatgcttgtaccaggcgtgatgtggggtactagatctttgtttcatttgataccatcaattgttgaacattgatgattttgggaaccagatatggaggctgcttctctgatttaatattaagttcacgcctgttgttttaataactagttcgtgtgagttttggataccaaatggatcagactttgctttaaatgttcctgcaaactgaattttcaatgagatattgtgatttatatgctgtcattccgatgccatttgaaaatcaggaggatttagtagatcccaaaatcagtgttattt

SEQ ID NO: 1923 - DNA, 1076 bp, Glycine max
gccgtagaatagagagctcctccaattagggtttttgtgatctgcagctacgatgggtaagggaacggggagtttcggtaagaggaggaacaagacccacaccctctgtgtgaggtgtggccgccgcagcttccacctccagaagagtcgttgctctgcgtgcgcttaccccgctgcgcgcaccaggaaatataactggagcgtgaaggccattaggagaaagaccaccggaactggaaggatgaggtacttgcgtaacgtgcctcgcagattcaagagcggcttcagagagggtaccgaagctgcacccaggaagagaggagctgctgcctctgcctaagctttgaatgaatgacagcaatttttgctgggtcagtgaattataggagttaatgtttctgtgttggtgccaaactctttggaacacattttctttctgtcgttttaatttcatttaatatgtagtggctttgtatttcgaaatgaggattgtaaggaattttggtttttcaatgggagtttttgacatccatattctggctaatttttttgggcgtttctttcggtattgtggtgcataataaatagtatttaaatcaatttaggaaaaggctattagtgggtgttaattattgtcaacaatttgtttgagtttttgtgccttggcatagattttgttcttactaaacatatgttttgttaattaattgtagtatctgtatcttgagagaaacataaccctgctacaaatcactttgctaatgttaaggaatatgttatgtttgaagtatggatcgtgctatatcatatttgggaactcgggtattaccttgtgtttgtattgattggggattcatgtgatgatgggttctgatcttgttagaaagttcttgtgctcttttcatatctttattaggttgccattgtgttattaagtagtttattctgctgttttagtttgactcagactcgattgagttgtcttaagagtatttagtgtaaaatatgctactatttatgaaataggatcggcttgtgcattggaattacaagcttgctaaaagcattttactttt

SEQ ID NO: 1924 - DNA, 520 bp, Camellia sinensis
tctctgcgaagaccttcgaagctagggtttttccaccaaggagatgggaaaaggaacaggaagctttggaaagaggaggaacaagactcacaccctgtgtgtgagatgtggccgccgtagcttccatctccagaagagccgatgctccgcttgtgcctttcccgccgcccgcaaaaggacttataactggagtgtgaaggcaattcgaaggaagaccactggaactggtcgcatgaggtatctccgtaatgttccccgcaggttcaagagtggcttcagagaaggtactgaggctgctccaaggaagaagggggctgctgcagcctcgtaaggttttcattgtgttcttggttttcattgtcttaaattttgcaagaagcacaatttttggattttgtctactctgttacttattatcagtcacaaattgttattgttttggattaatgagattttagtgctttattttgacaatgtaagttaaattactttttaaatttcactccatgccttattattg

SEQ ID NO: 1925 - DNA, 538 bp, Trigonella foenum-graecum
gccttgcagcacaactcggtggtttccgcatctaagcttcaatgggtaagggtaccggaagtttcggtaagagaaggaacaagactcacacactctgtgtgaggtgcggccgccgcagtttccaccttcagaagagccgttgctctgcttgtgcttatcctgcagctcgtgtcaggaaatacaactggagtgaaaaagcaatccgcagaaagaccactggaactggtaggatgaggtacctacgtaacgttcctcgccgattcaagagcggtttcagagagggaactgaagctgcaccgaggaagaagggagctgcaaccgcttaagaattttgaggattgttgttttgttgggtacggagtttatagaattagtttgttatttgtgattgaggcaagtttgttagaacttcaatttttacagcctcattggttttgtcttattttctgtttgatttgtacttttgttatatttcaagatgatgattataaaactatttcattgttcaattggttgtgtggcgttactagttttgatt

SEQ ID NO: 1926 - DNA, 506 bp, Vinca minor
actcggccgccggagctatggggaagggaacaggaagttttggtaaaaggaggaacaagacccacactctatgtattaggtgtggccgccggagcttccatcttcagaagagccgctgctctgcttgtgcttaccccgctgctcgcaagaggacatataactggagtgtcaaggcaattaggaggaagacaactggaactggacgcatgaggtatttgcgtcatgttcctcgtagattcaagaccaacttcagagaaggtactcaagctgctccaaggaataaagcagctgctgcatctgcttaagagtgttgattctggagggtactcttaattgtagttcttgctcagttatttagtattccatattattcgaacagctgaaatttttgcagaacattatttccaagggctttgtacccaatttatttacttttttgtagtttgttacttatttctatttggtatctttaattaacgaattgaatagagtggtcgtattgtata

SEQ ID NO: 1927 - DNA, 549 bp, Vinca minor
gaagaactcgagagataaagaaagaaaccagggtttctgcaaatcggccgcaggatctatgggtaagggaactggaagttttggtaaaaggaggaacaagacccacaccctatgtattaggtgtggtcgccgcagcttccatcttcagaagagccgctgctctgcctgtgcttaccctgctgcccgcaagaggacatataactggagtgtgaaggcaattaggagaaagacaactggaactggacgcatgaggtatttgcgtcatgtgccccgcaggttcaagactaacttcagagaaggtactcaagctgctccaaggaagaaggcagctgttgcatctgcttgatagagttgattcaggagggtacttgttattgtagttttttatcagttatttagtatttcttagtatttgaacagttggaatttttgcagaacatcattaagggctttgtacccattttatttacttttttgagtttgtactgtttcatttggatctttaatacgaatgactggttattggtagttggtagttggtatcctata

SEQ ID NO: 1928 - DNA, 570 bp, Capsicum annuum
tcagcatagtagtgggtttctgcaacttcactgcaatgggtaagggaacaggaagtttcggtaagagaaggaacaagacacacacactctgtgtgagatgcggccgccgtagcttccatctccagaagagccgttgttctgcttgtgcttatcctgctgcccgtaaaagatcatacaactggagtgtgaaggcaatccgcagaaagacaactggtactggccgcatgaggtaccttcgcaacgtccctcgccgatttaagaccaatttcagagaagggactgaagcagctccaaggaagaaggctgcagcagcttctgcttgaagcccttgaagagagtaattgaggagggtacttttaatggtagcttcgctttggtattcaagtattagagagcaagggaattttgggaaagcttaagtatttaagtttttgaaatgtgttgttgaaattgtcattcggatacagattttataggctgctttctatttttggtttctctgaacgccttgtgtttcattaaattgagaatttatgttttttgagctcataattttgcaatttttaccct

SEQ ID NO: 1929 - DNA, 796 bp, Lactuca sativa
agcgaatgcaagcaaaaccctgaaatatttgatattgaattgatatatagccgccatcgtctcttccctccggccgcagggtaagctcgcagaagcaggatctcggcaacggcaagcaatgggtaaaggtacagggagtttcggtaagagaaggaacaaaacccacacactgtgtgtccggtgtggtcgtcggagtttccatcttcagaagagtcgatgctctgcttgtgcttatcctgctgctcgcgtcaggaaatataactggagcgtcaaggcgatccgaaggaagacgactggaactggtcgcatgaggtatctccgtaatcttccccgcagattcaagagcaactttagagaaggtactcaagctgcgcctaggaagatcgctgctgcagcttcaacataaagctccaaggaatcacatcaaaatcgactatacgggtatcaatcaagcatatttcctttaggcaattagtgtaggtgaacatcgtttggagctattaatcccgtagtctgttctaagttttttctttttgggaaatctgttattctgatttatggatgatgatgcattttgaattaagtgttattaaacacctttcgctctttattgatcctttctactctttaatatgatctttttgtgatcttctgaccaagataaaaccagtctctaattagccaggtttcttaaatttacaaacttcttgctcaatctctgtttgaatatcaagaacacagtttgacaatagaacttctattgcttgatatgagggtaaaggcgaactgggagacc

SEQ ID NO: 1930 - DNA, 572 bp, Artemisia annua
acagccgcctgattccaaaaactagcgtttctgcagcagcatcatctcaaacaatggggaaaggaacagggagttttggaaagaggaggaacaaaacacacacactgtgtgtgagatgtggaaggagatccttccatttgcaaaaaagcagatgctctgcttgtgcttacccagctgcacgcgtcaggaaatacaactggagtgagaaggctattcgtcgcaagacaactggaactggacgtatgaggtatatgcgtaatgtgcctcgcaggttcaagagtggtttcagagaaggcacccaagctgctccaaggaagatcgctgcagcgtctgcttaagttctgtgggttttgatttgaagcggtattttggtagtttgaaacatagttctattggcaatttagtgatcgaagttttgaacttttattgtggatcaagtttgtttagaaatctgctgtttattttgaattaaatgatgtatacacttggtcggttttggaatcaagcagattatctttgtgttccgcttaattattcctagctctcttcctatataatctggtcaaatatgg

SEQ ID NO: 1931 - DNA, 382 bp, Artemisia annua
atatcgcgagagtactccgacgggggccgcctgattgtccttccaaaaactagcgtttctgcagcagcagcatctcaacaacaatggggaaaggaacagggagttttggaaagaggaggaacaagacacacacactgtgtgtgagatgcggaaggagatccttccatttgcaaaaatcccgttgctctgcttgtgcttaccctgctgctcgcctcaggaaatacaactggagtgagaaggctattcgtcgcaagacaactggaactggacgtatgaggtatatgcgtaatgtgcctcgcaggttcaagagtggtttcagagaaggcacccaagctgctccaaggaagatcgctgcagcgtctgcttaagttctgtgggtttt

SEQ ID NO: 1932 - DNA, 471 bp, Musa acuminata
gcggttttgcggagggcgactccaatggggaagggaaccgggagcttcgggaagcggaggaacaagacccacaccctctgcgtccgctgcggtcgccgcagcttccacctccagaagagccgctgcggtgcctgcggctacccttctagccggatccgcaaatataactggagcgtgaaggcgatccggaggaagacgacgggaaccgggaggatgcggtacctccgccacgtaccacgccgcttcaagagcaacttccgcgaaggtactcaagcggctcccaggaagaaggccgtggctgacgcttaattttaatgtcaaccttcagtgagtcgcttcggacttggagctcaggagttctttccaagtagaaactgatgcaaatcgatctaccttcttagttgttggatcgaactttcaatctcagattattattgaactttgagttgaaatagaaaagattactatttt

SEQ ID NO: 1933 - DNA, 667 bp, Solanum melongena
ctatcaaactataagagctgcctaaatcgccgcagttctcagttgagaaagctcaggaggaggtcgctagggtttctgcagctgtatcgtgatggggaagggaacaggaagctttggtaagaggaggaacaagacccatacactatgtgtgaggtgtggaagacggagctttcatctccagaagagccgttgttctgcttgtgcttaccctgctgcccgtaaaaggacatacaactggagtgtgaaggcaattcgcagaaagacaactggaaccggccgtatgaggtatctccggaacgtccctcgcaggttcaagaccaatttcagagaaggtactgaagcagctccaaggaagaaggcagcagcttctgcttgaggcctttgaaacaattacttgagaggctagcagtggtagcttcattttgatatttcaagtgttagagcaagtataattttggggtcttctatcttaggttttattggcctttgaaagattaatgtgcttaaaatttccgagtatgtattccaacatggtatttttatggaggatcttgatacttccatcacttattggatcttatctgcctgactagttatcatgtttaccttgtgtttgttcaaattactcattttgagtctcttgctatatgaaatgattccatttatc

SEQ ID NO: 1934 - DNA, 950 bp, Vitis vinifera
tgatgctaaaatacgcagggatgtgcacaacttctcagccttcgcccaccagcccaaaaccctaaaaatcacaacacaacactcgcactataaatatcttcaacattttctcctcctaaaattctcgtccgaagctagggtttctgcaactccacaaatgggtaagggaacaggaagcttcggaaagaggaggaacaagacccacacgctctgtgtccgatgtggacgcagaagctttcaccttcagaagagccgatgcgctgcttgtggatttccttctagccggatccgaaaatataattggagtgtgaaggcaatccgcaggaagaccactggaacagggcgaatgaggtatctccgtcatgttccatgtaggtttaagagtaacttcagagaaggtactgaagcagctccaaggaagaagggagcagcagcctcttgagattcaaaatccatttaaagtctatttctgttttagtttttctgaattatgcaaaacaaattttggaccattattgagtgtactcaacttgttaccaaacgcatgttttcccctactttggagatgttaaatttatatactataaggtcggatggtaacttattcatatttctcatcatatatactcatggttttatgtaggtgtcacatgtttgccatagctttggattaactaaacagtatggtagctgcgcctgtacattgactctagcttttacatgcataacccttgagaaggttcaaggcgcagtttccttgctgcctaatgcccttgggcaattcaccacccccttttttgggtcctttgtcatatggggcggttacccttttgttcatcaggttgaagatttgcaatgccttggttcaaattcgaggataaattttactatgtgcttggatgtaagaaataggatgggagtgggttgggctgaatcatgatttatgtgga

SEQ ID NO: 1935 - DNA, 904 bp, Marchantia polymorpha
ctgtctcgtaccccggctcacgcagggctccgtctgagctacattccttagggtttcgaattgtttccgatttcggagcaagatgggtaagggaacaggaagtttcggcaagcgccgaaacaagacacatactctctgcaggcgatgtggacggaggagtttccacattcagaagagccgctgctcggcttgtgcctaccctgccgcccgcattaggaagtacaactggagtgtgaaggctatccgtagaaagactaccggaaccgggcgtatgcgccacctccgccacctgccccgccgcttcaagaacagcttcagagaaggtaccgaagcggctcccaagaagccagcagccgccggggtctagctttacaaacctagagatttgtttagagaaatctgtataccgatgaagcagaatcaaattttatgacctggaattttcgagagtttggtacataagagaaactggagctcccgaggttgtcctcttaaaatctccgcgtttttgcttcagattcccttcggcagagtctttgaaatgcaattggtatgcacaatcctcaacgatgtttacaccagttgagaaaggtcattgtcgtgaacagtccttgttctactgaattggtattttgagtcaccgtaccttgttattgcagcatggtagtgttcattagccataatgtacttctcaattgtgtgaatacgttttcacatgtgaactttgactgcaagggcctattttaggtcaaacttgaacactcgcaagttcccttgtattggccattcagaattcacaagaggtatatttttactttctgctagatcaaacgtcacgagagattactcgatcggattgtgaatctaaattttaaatataacttatattttctcttcaaaaaaa

SEQ ID NO: 1936 - DNA, 546 bp, Capsicum annuum
ctgtcacctagggtttctgcaactgcagcttaatgggtaagggaacaggaagttttggtaagaggaggaacaagacccacacactatgtgtgaggtgtggaagacggagtttccatctccagaagagtcgttgctctgcttgtgcttaccctgctgctcgtaaaaggacatacaactggagtgtgaaggcaatccgcagaaagacaactggaactggacggatgaggtatcttcgtaatgttcctcgcaggttcaaaaccaatttcagagaaggtactgaagcagctccaaggaagaaggcagctgcttctgcttgaggtctttgagacagttatttgagagctgagaggctattagttgtagcttcattttgatatttcaattgttagtgaaattttggggaaccttctatcttgtgtttattgcccgttgaaagattaatgtgcttaaaattctcgaagtatgtattccaacttggcatttttataaaaaaggatcttgagacttccatcacttaatgatttgagctgcctgtccagttattaa

SEQ ID NO: 1937 - DNA, 591 bp, Capsicum annuum
cgcagttctctgtcacctagggtttctgcaactgcagcttaatgggtaagggaacaggaagttttggtaagaggaggaacaagacccacacactatgtgtgaggtgtggaagacggagtttccatctccagaagagtcgttgctctgcttgtgcttaccctgctgctcgtaaaaggacatacaactggagtgtgaaggcaatccgcagaaagacaactggaactggacggatgaggtatcttcgtaatgttcctcgcaggttcaaaaccaatttcagagaaggtactgaagcagctccaaggaagaaggcagctgcttctgcttgaggtctttgagacagttatttgagagctgagaggctattagttgtagcttcattttgatatttcaattgttagtgaaattttggggaaccttctatcttgtgtttattgcccgttgaaagattaatgtgcttaaaattctcgaagtatgtattccaacttggcatttttataaaaaaggatcttgagacttccatcacttaatgatttgagctgcctgtccagttattatgtttaccttgaggttgttcaaattgctcattttgaa

SEQ ID NO: 1938 - DNA, 711 bp, Phaseolus coccineus
gtagggaaagggaacagggagtttcggtaagaggagaaacaagacccacaccctctgcgtgagatgtggccgtcgcagcttccacctccagaagagtcggtgttcggcgtgtgctttcccagcagcgcgcacaagaaaatataactggagcgtgaaggccattaggcgaaagaccactggaactggaaggatgaggtacctgcgtcacgtgcctcgcagattcaagagcggcttcagagagggtaccgaggctgcacccagaaagaggggagcggctaccaatgcctaagctttggaaggtagcaattttcctggatcattgaattgtaggagttaaggcttctttgttgtgcgaaaccctgtggaacattttttctttctgtcgttttaatctcatttgatatatatggatttctatttcaacttgaggatgataaggaattttggtttgatagtttctttacttctatattgtagtgtcctactcaggcctcatttttggatttgtggttcgcaatgagttataattaactagtttatggtaattatactaataaggtagttttgattatggccttggcttacattttgttcatacttacataggttttagttatttgaatggaatgtcttccccagtataaacaatcctgattcaaatctccttcctgatgtcaagttatgtttgaagttttggttgcgtcaatgaac

SEQ ID NO: 1939 - DNA, 677 bp, Cajanus cajan
gaggtaattttgattctgcgacgatgcttacgatgtttgaattttggatgagtgcaggggaagggaacggggagttttggtaagagaaggaataagacacacaccctgtgtgtgaggtgtggccgccgcagcttccacctccagaagagtcgctgctccgcgtgcgctttccccgccgcgcgcaagaggaaatataactggagcgtgaaggccattaggagaaagaccactgggactggaaggatgaggtacttgcgtcacgtgcctcgcagattcaagagcggcttcagagagggtaccgaagctgcaccaaggaagagaggagcagctgccagtgcctaagctgggtcagtgagttaattataggagttgaggtttctatgttggggccaagctctatggggtatttttctttctgtcgtttttgtttttatttaatatgtagttgctttgtgtttcgacatgaggattgtaaggaattttgatttttcaatgagagtttttgacatccatattttggcgtatcaattttagcttgagttttggtatcgtggtgcataatgaactgtaattagctgggtttgtcttgcatgatcgtttacattttggtctagtttctgtgttttggattagttttttatcacttaatatgtgttaattacttgtaacatatatag

SEQ ID NO: 1940 - DNA, 657 bp, Allium cepa
gagggaaaggaaaaagggcttatacagaatgaattctcttataaattcactgctctaatcttcgccgagggtttcatcttctctccaaccgccgccaggtctaatgggtaaaggaacaggaagtttcggaaaaaggaggaataagactcacactttatgcgttcgatgcggtcgccgtagcttccatctccagaagagtcgctgcgcatcgtgcggttttccagctgcccgaaccaggaaatataactggagtgcaaaagcgatcagaagaaagacaaccggcaccggaaggatgaggtaccttcgccatttgcctcgaaggttcaagagtgggttcagagaaggaactgaagctgctccaaggaagaaggctgcagctgctgctacatcttagtttccagtggtttcattttgtttttcctcaacgcacaattcagattagctgtacttgtttatctagtttgtgttctcggtttacgccgttgtttttcttgttttcagctaccaatctacccaatgtattttgatgttacaattttcttttatgaaacaccgttgttctttattgcacttttgtcgtttgctgtgtgattataagtgttggctgctgagattgcgattaactttctatttttaaatttattgatgtctttggtt

SEQ ID NO: 1941 - DNA, 459 bp, Euphorbia peplus
gcttctctgcgatgggtaaaggaaccggaagttttggtaagaggaggaacaagacccacaccctctgcgtcaggtgtggccgccgtagcttccacctccagaaaagccgatgttcagcctgtgccttccctgctgctcgcaccaggaaatataactggagtgtaaaggccatccgtaggaagacaaccggaactggaaggatgaggtatttgcgtcatgttcctcgcaggttcaagagtggtttcagagaaggcacccaagcagctcctaggattaagggagcagccgcagcaactgcttaaggtgaaacagtcttcttcatcattattttttgtcaagaattgcttgaattattgtgggacaaatttatgagatggtttgatgaacggatgtacttcaaatttgatgctttttagttgatatttagttttctttgatctgcagttttgaaaacaaaaa

SEQ ID NO: 1942 - DNA, 466 bp, Euphorbia peplus
cttcttctggatcatcaatgggtaagggtaccggaagttttggtaagagaaggaacaagacccacaccctttgcgtccggtgtggccgccgtagcttccacctccagaagagccgttgctccgcctgtgctttccccgctgcccgcgtcaggaagtacaattggagtgaaaaggccatccgaagaaagacaaccggaacaggaagaatgaggtatatgcgccatgttcctcgcaggttcaagagcggtttcagagaaggcactcaagcagcacctaggcaaaagggagcagctgcagcatctgcttaagttgaaagattatctccagcataagttatttagacagcgagttattaaatttttgttggacaaattttaagagaagattgtttgctgaatgtacttcgcatattgctatttagttaatttgagtttttcatctatgtgtttttattttgaatgaaaac

SEQ ID NO: 1943 - DNA, 511 bp, Euphorbia esula
agttggagttgggacttcttctggatcatcaatgggtaagggaaccggaagttttggtaagaggaggaacaagacccacaccctttgcgtcaggtgtggccgccgcagcttccacctccagaagagccgttgctccgcctgtgcttttcccgctgctcgcgtcaggaagtacaattggagtgaaaaggccatccgaagaaagacaactggaacaggaaggatgaggtatatgcgccatgttcctcgcaggtttaagagcggtttcagagaaggcactcaagcagcacctaggcaaaagggagcagctgcagcatctgcttaagttgatagattcatctccagaacaattctcagacagcaagttattagaatttttgcaggacaaatgttaacaggaagattgtttgatgaatgtacttcatactatttggtctatgaattttctatgataatatgtacttgattttgaatggaaattttgaaagggctgtttcttttgatttatgtggtt

SEQ ID NO: 1944 - DNA, 499 bp, Fagus grandifolia
gtagcgcaaacctctcctctcactcgcttagggcttctgcatctgcaccttcaccaatgggaaagggaacagggagtttcggtaagaggaggaacaagacccacacactctgtgtcaggtgtggccgccgcagcttccatctccagaagagtcgctgctctgcctgtgcctacccagctgctcgcaagaggacatataactggagtgtgaaggcgatccgaagaaagactaccggaaccggaaggatgaggtacatgcgcaacgtgcctcgcagattcaagagtggcttcagagagggtactcaagctgcaccaaggaagaagggagcagctgctactgcttaaggcatcattggagagtggtttttgatgatgtaatttggataccaaattgcagtttttagattgagtttattgtgttggaactggttttataaaagcactgtttgatgggtgttataaccttacaatttagttatttttgatttggttcagtatgt

SEQ ID NO: 1945 - DNA, 608 bp, Vaccinium corymbosum
gtataatagccgcccttcatctgtttcctcagaatactagggtttctcctgctgcgcaccaatggggaaggggacagggagttttggtaagaggaggaacaagacccacaccctttgtgtgagatgtggccgccgcagcttccatctccagaagagccgatgctctgcttgtgctttccctgctgcccgcaagaggaaatataactggagtatgaaggcgatccggaggaagacaaccgggactggtcgtatgaggtacctccgcaacgtgcctcgcagattcaagagtggtttcagagaagggactgaagcagctccaaggaagaaggcagcagcagctactgcttgagccattgaaggcttgtatcgggtgtgatttagggtactgaattgtggtttcattttcaagtgtaggaactgagttcactttgggaacctcatttggaggctgttgctccaatttgatatctgttttaagatttttggtcttttaatctgtagtttattcgagtttttgatacaaatcagactatggctttgaattcccagtattctgagtctaatgagatattacgatttccatggcaaagaaacagaacaaagacaaa

SEQ ID NO: 1946 - DNA, 1429 bp, Gossypium raimondii
gatggtttttgggtctgatggtttgttgtaacccaaaacccggagacccgaaagcctaaaaccaatccccacaatggaaccgaaaaaccctaatccggaattcgtatatttgttagattaaaaacactttttccgttaaagctctctccgcagagacaaagcccctcacaattctagggtttttgccgcaccaccaacagaagaaatgggtaaaggaactggaagctttggaaagagaaggaacaagactcatactctctgcgttcgatgtggacgtcgaagcttccatctccaaaagagccgttgcggtgcttgtggctatcctgccagccgcatccgaaaatataactggagtatgaaggctattagaagaaaaaccaccgggactggccgcatgagatatcttcgtcatgtgcccaggagattcaaaactggctttagagaaggtactgaagcagctccaaggaagaaggcagctgtagctgcttcataagtttaattgtggtgttttcttttcagattcctataaacacaagttttgtgtttttatcaactgtgttacttttatttttcaagtaatatttacaaatggtaagttttactttgttatgaatcttttcaacttattttgattattgagtatactttgtgcttcgtgagatagtgatgtcatccatagattatcttatattactcaaatttcgtaaatgtcttgtttgctatttattgcatttggagatgtgattctttttcacttggtgtggggaaaacccaaagagattttgaacgtggcttagtgaagctctactattaggctgagttaggcgtcaatacttgaaaatggaaatgccataaaatgccattgtttcttacccgatctaataggaatgaaaatgtaatcataggaatgcatcgtaagggatgttatctagaatatattcttgcgtgctttgttttggccaatggtcaaatctctccagcttctgattttcttttattttggtcaattgctgattcaatcggcatgttaatcttgacaaaaataaactttcgctatagatactagagaaagccctttgctccttaccccgtttattcaagcctaaatgccatatgtttgacacattacttggcatctgaagcaaataaaatcctgataccctggctagcttttggggcgtttacagcagcattcctttgaacgtgtggtaggcccaactcattcagccacaaaggaattgttgatattgtaaactctaaataacgttgaagaacccattttatttgcgacatacaaggcatttcttgttataacttataatccatgaggcaacaatctggcgaagtttagtcctttgttccccattttttatagtttctcttgtatttggtgcggttatggcctaatgggaatctgaggatggcaatt

SEQ ID NO: 1947 - DNA, 636 bp, Phaseolus coccineus
tagttggcatttatggccggggatagagagatccttcaacaactagggtttctgattcgctgcgacaatggggaaaggtacagggagtttcggtaagaggaggaacaagactcacacgctctgtgtgaggtgtggtcgtcgcagcttccaccttcagaagagtcggtgttctgcgtgtgctttccccgctgcgcgcacaagaaaatataactggagcgtgaaggccattaggagaaagactaccggaacaggaaggatgaggtaccttcgtcacgtgcctcgcagattcaagagcggcttcagagagggtacggaggcagcaccaaggaagagaggagcggcttccactgcctaatctttcgaagtaatcaatttttctgggttagtgaattataggagtcaaggattgtttgctgtttctaaagaacattttttgtttctgtcgtcttaatttcatttaatatgtaatggatttttatttcgacatttgatcgatttgatagctctgcgttcactttatcaacattcatagtagaaatccatttgagaattttgatggacttatttagttttataattaattgttaatattggtactatatattaaaatcacttcaacatgaactagcgcaaaaa

SEQ ID NO: 1948 - DNA, 743 bp, Phaseolus coccineus
tggccggggagggtttcttctcttgctgctacaatggggaagggaacagggagtttcggtaagaggagaaacaagacccacaccctctgtgtgagatgtggccgtcgcagcttccacctccagaagagtcggtgttcggcgtgtgctttcccagcagcgcgcacaagaaaatataactggagcgtgaaggccattaggcgaaagaccactggaactggaaggatgaggtacctgcgtcacgtgcctcgcagattcaagagcggcttcagagagggtaccgaggctgcacccaggaagaggggagctgtttccaatgcctaagctttggaaggtagcaattttcctggatcattgaattgtaggagttaaggcttctttgttgtgcgaaaccctgtggaacattttttgtttctgtcgttttaatctcatttgatatatatggatttgtatttcaacttgaggatgataaggaattttggtttgatagtttctttacttctatattgtagtgtccaactcaggcctcatttttggaattgtggttcgcaatgaattataattaactagtttatggtaattatactaataaggtagttttgattatggccttggcttacattttgttcatacttacataggttttagttatttgaatggaatgtcttccccagtataaacaatcctgattcaaatctccttcctgatgtcaagttatgtttgaagttttggttgcgtcaatgaac

SEQ ID NO: 1949 - DNA, 549 bp, Phaseolus coccineus
caacaactagggtttctgagtcgctgcgacaatggggaaaggtacagggagtttcggtaagaggaggaacaagactcacacgctctgtgtgagatgtggtcgtcgcagcttccaccttcagaagagtcggtgttctgcgtgtgctttccccgctgcgcgcacaagaaaatataactggagcgtgaaggccattaggagaaagacaaccggaacaggaaggatgaggtaccttcgtcacgtgcctcgcagattcaagagcggcttcagagagggcacggaggcagcaccaaggaagaggggagcagcttccactgcctaatctttgagaggaatcaatttttctgggttagtgaattataggagttaaggattgtgtgctgtttctaaagaacattttttgtttctgtcgtcttaatttcatttaatatgtaatggatttttatttcgacatttgatcgatttcatagctctgcgttcactttatcaacattcatagcattttgatagaaatccctttgagaattttgatggacttatttagttttataa

SEQ ID NO: 1950 - DNA, 717 bp, Theobroma cacao
aaactgtctcctactataaaccatctcctccgcgccgctctctttcttcttcagagccaaaagcactatatcttagggtttctcctgcgacagctccgatgggaaagggtacagggagttttggtaagagaaggaacaagacccacactctctgcgtgagatgtggccgccgtagcttccatctccagaagagccgttgcgctgcctgtggtttccctgctgcccgtaagaggaaatataactggagtgtgaaggcaatcagaagaaagaccactggaactggtaggatgaggtatctccgccatgtccctcgcaggttcaagagtggtttcagagaaggtactcaagcagccccaaggaagaaggttgcagcagcttcagcttaaggtcttgtgagattgttttgaatgagccgttttatgggaacattacttgaggagttgtcattacattggatgctttagttggttttagtttctacttttatgtagttgctttaaattttgaacaaaagtggttgaggctattattgttagacccttaattacttgatgaagttaatgatgttcttgttttggttacattgccctgaatctaatctaaggatggcaagcccctaattattgcctgggagtagtcattaattgtactagtttggaattatcgcttgaatagaaattcacgaggtcatcctaaccttggatgaaagggggaaaa

SEQ ID NO: 1951 - DNA, 597 bp, Cephalotaxus harringtonia
tgggtcgcttagagcagataaggaacgacagcaacaatgggaaagggaaccggaagttttggtaagaggagaaacaagacgcacaccctttgcgtgcgctgtggccgacgcagttttcacattcagaagagtcgatgttctgcatgcgcataccctgctgcacgtattcgcaaatacaactggagtgtgaaagcgattcggagaaagactacagggactgggcgaatgagataccttcgtcacatgccccgtcgtttcaagaataatttcagggagggtactcaagcaacccccaggaagaaggctgctgccgcctctttttaaatttgttaggaatgaatctactgagttgtttgggaaccgttctttttaaatttgttaggaatggatctacttagttgttttggaaccattttccgacttttcgttgatattatgataagatttatatttggaaaagttaaacaagctattttaagcactgaatggatggtttctgcgtagattaatgatttgtaatgctatttgattttgaggatttttgtgacgttatagattacaaaaactaggccacgctgtggctaatgtacctgcgaa

SEQ ID NO: 1952 - DNA, 638 bp, Castanea mollissima
gccgcgttcagtcttctttgtttagcctaagaagaaccacacctcttctcttcctcctcctagggttttgcatctgcatctgcaccaatgggtaagggaacagggagtttcggtaagaggaggaacaagacccacacactgtgtgtgaggtgtggccgccgcagtttccatcttcagaagagtcgctgctctgcctgtgcctaccctgctgcccgcaagaggacttataactggagtgtaaaggcaatcagaagaaagaccaccggaactggaaggatgaggtacctccgccacgttcctcgcagattcaagagtggcttcagagagggtactcaagctgcaccaaggaagaagggagcagctgctactgcttaaggcatcattggagagttgtttttggtgtaatttggtacccaaattacaagtttagattgagcttaatatgttggaactggtttttgaatgtaatgtttgaagggtgtcataaccttataatgattttagttatttttgatttggttcaatatgtagttgctttaattttggacaaggatgaatgcgtctactatgttttcccctttatattccaaaatgaattctgaattttgtttctggttaacatttcttgagtactgaga

SEQ ID NO: 1953 - DNA, 541 bp, Cirsium arvense
ttgaattgatatatagccgccttcgtctcttccctccggcaaggataagctcgaagaaccacgatctcatcgacggcaagcaatggggaaaggtactggaagcttcggtaaaagaaggaacaagacacacacactgtgtgtccgctgtggtcgtcggagcttccatctccaaaaaagtcgatgttcagcttgtgcttatcctgctgctcgcgtgaggaaatataactggagcgagaaggcgatccggaggaagacgactggtactggtcgcatgaggtatctccgtaatgtgcctcgcagattcaagagcaatttcagagaaggtactcaagctgctccgaggaagatagctgcatcagcttcgacttaaaaactctgaggaattacatcgaaactaatatccggtatcaattttctttaattagggcaattagtctattaatctcgtaatctgtttttttaaagtcttgtttggaaattttgttattctgatttatgaatcatgactcattttgattttaatttgtttgtgatgttaaaa

SEQ ID NO: 1954 - DNA, 693 bp, Gossypium hirsutum
gggggggtctgatcgtttgttggaacccaaaatccggagaccagaaagcctaaaaccaatccccacaatggaaccgtaaagaccctaatccggaattcatatatttgttagattaaaaacactttttccgttaaagctctctccgcagagacaaagcccctcacaattctagggtttttgcggcaccaccaacagaagaaatgggtaaaggaaccggaagctttggaaagagaaggaacaagactcatactctctgcgttcgatgtggacgtcgaagcttccatctccaaaagagccgttgcggtgcttgtggctatcctgccagccgcatccgaaaatataactggagtatgaaggctattagaagaaaaaccaccgggactggccgcatgagatatcttcgtcatgtgcccaggagattcaaaactggctttagagaaggtactgaagcagctccaaggaagaaggcagctgtagctgcttcataagtttaattgtggtgttttcttttcagattcctataaacacaagttttgtgtttttatcaactgtgttacttttatttttcaagtaatatttacaaatggtaagttttactttgttatgaatcttttcaacttattttgattattgagtatactttgtgcttcgtgaaaaaagaaaaaagtaccgactgcgactctgcgttgatac

SEQ ID NO: 1955 - DNA, 685 bp, Gossypium hirsutum
gggggggtctgatcgtttgttggaacccaaaatccggagaccagaaagcctaaaaccaatccccacaatggaaccgtaaagaccctaatccggaattcatatatttgttagattaaaaacactttttccgttaaagctctctccgcagagacaaagcccctcacaattctagggtttttgccgcaccaccaacagaagaaatgggtaaaggaactggaagctttggaaagagaaggaacaagactcatactctctgcgttcgatgtggacgtcgaagcttccatctccaaaagagccgttgcggtgcttgtggctatcctgccagccgcatccgaaaatataactggagtatgaaggctattagaagaaaaaccaccgggactggccgcatgagatatcttcgtcatgtgcccaggagattcaaaactggctttagagaaggtactgaagcagctccaaggaagaaggcagctgtagctgcttcataagtttaattgtggtgttttcttttcagattcctataaacacaagttttgtgtttgtattaactgtgttacttttatttttcaagtaatatttacaaatggtaagttttactttgttatgaatcttttcaacttattttgattattgagtatactttgtgcttcgtgagatagtgatgtcatccatagattatcttata

SEQ ID NO: 1956 - DNA, 695 bp, Cryptomeria japonica
gagggtttcatagaagatttttgaaggttttcagtagcggaggcgcaaagaagcggaaggagcaggagcagcaatgggaaagggaacaggaagttttggtaagaggaggaacaagacgcacactctttgcgtgcgctgtggccgccgcagtttccacatccaaaagagtcgatgttctgcctgtgcataccctgctgcccgtattcgcaaatataactggagtgtgaaagccattcgaagaaagactacagggactggacgaatgagatatcttcgtcatatgccccgacgtttcaagaataatttcagggaggggactcaagcaatccccaggaagaaggctgctgctgcgtcattctaaatttttttagaatgtatgcactggggtgtagatttgaattcattatgtactattggatggcttttctagttaattgtagaaagcctagattccagttaaaagcctgctttttggaaggaaatgcttttacaatttttttggctcatattatagtaaagactatggaatattaaacaaagttatttcgagcaccagtagagactgcttatgtgcagtaataatttctaatgctgtttgaatttgagattttcatttcttgagttttagatgatcaaattttgtaccttttagcaacagctagtaacttgcaagttttgaagaagactttttgagc

SEQ ID NO: 1957 - DNA, 483 bp, Cucurbita pepo
catcaatggggaagggtacgggaagttttggtaagcggaggaacaagacccatactctctgtgtgcggtgcggccgccgcagcttccatcttcagaagagtcgttgttcagcatgtgctttccctgctgctcgcaagcgcaagtataactggagtgtgaaggctattaggagaaagactactggaactggaaggatgaggtacatgcgccatgttccgcgtagattcaagagcggcttcagagagggtactgaagctgcacccagaaataaaggatctgcagcatcagcgtaaggtattggaagaagttcgacttaatttcagcacccaattatagttttcagtagggtttttacgcatctgaggattatttcacataattttgtttcctagttttgcctttttcatgatttagttgaacgcagtttctttgaaatgtattgttttgaattatggacaaatgacgaatcaaatgttcgtactc

SEQ ID NO: 1958 - DNA, 512 bp, Cucurbita pepo
gctgctgatagaatttctcctcccttgggtttcttcgttctgcatcaatggggaagggtacgggaagttttggtaagcggaggaacaagacccatactctctgtgtgcggtgcggccgccgcagcttccatcttcagaagagtcgttgttcagcatgtgctttccctgctgctcgcaagcgcaagtataactggagtgtgaaggctattaggagaaagactactggaactggaaggatgaggtacatgcgccatgttccgcgtagattcaagagcggcttcagagagggtactgaagctgcacccagaaataaaggatctgcagcatcagcgtaaggtattggaagaagttcgacttaatttcagcacccaattatagttttcagtagggtttttacgcatctgaggattatttcacataattttgtttcctagttttgcctttttcatgatttagttgaacgcagtttctttgaaatgtattgttttaaattatggataaatgacgaatca

SEQ ID NO: 1959 - DNA, 342 bp, Cucurbita pepo
agagccgaggtgctgatagaatttctcctcccttgggtttcttcgttctgcatcaatggggaagggtacgggaagttttggtaagcggaggaacaagacccatactctctgtgtgcggtgcggccgccgcagcttccatcttcagaagagtcgttgttcagcatgtgctttccctgctgctcgcaagcgcaagtataactggagtgtgaaggctattaggagaaagactactggaactggaaggatgaggtacatgcgtcatgttccgcgtagattcaagagcggcttcagagagggtactgaagctgcacccagaaataaaggatctgcagcatcagcgta

SEQ ID NO: 1960 - DNA, 607 bp, Cynara scolymus
gcggggacgtcatcgatcagagtatttagccgtttgcgttcttccatccggccaaagggacttgctccgaagaattagggtttctggaacctcatagcaatggggaaaggaacagggagttttggtaagagaaggaacaaaacacacactttgtgtgtacggtgtggacgtcgcagtttccatctccagaagagccgatgctccgcttgtgcctaccctgctgctcgcgtcaggaaatacaactggagtgtgaaggcgattcgtaggaagacaacaggaacgggacgtatgaggtatctccgtcatctgcctcgcagattcaagagcaacttcagagaaggaactcaagctgctccaagaaagatcgccactgcatcttcagcttaaatttctgaggtgtcatcagaaatggtatgatggtattctttttaaaccgagaatcgggcgattcagcacatgatcaaagcgttgtgaagcatcatttgatgtgcttaatctattgatcttcaatcgtggttcgtttcgtttagaaatttgtgattcttaatcatggattaaatgaaaacatacacttgctctgtctttataatcaagtagttcatctggt

SEQ ID NO: 1961 - DNA, 720 bp, Fagopyrum esculentum
ccacctgcacatccctggaggtttgcttcatccgctgcttcaatgacgaaaggaacagggagtttcggtaagagaaggaacaagactcacacgctctgcgtgcgatgtggtcgtcgcagcttccacctccagaagagccgttgctccgcctgtgcttaccctgccgctcgcctgagaaagtataactggagtgtgaaggctattaggagaaagactaccggaaccggtaggatgaggtacctccgcaatgttcctcgtcgattcaagaccaacttcagagaaggaactcaggctacaccaaggaaggtgtctgctgcagctgcttgaagagcttcgtaaggagggaatggagaatgtcaaattttgatttggggtactcttatatacttcaactgatatttttattgtcctgttttggaagctgtggaactattgaaagtttgaaacatcatttgatgatctttagtctttactcatccttgcaatcaaattgacctgatttattgaatgatttgcttggtcctatcaagtataatctttaggtttatttatgttgctatcaagtatcaacaatagacataaactgaagcaacatgcgtcgaactatatgtttgtgcttgtaattgagatgattctcatgtttcaagcatttcatttaagtcgggaacccgctgggttgtaactccggaaacggaaacggaatggaaatgaatctagtcc

SEQ ID NO: 1962 - DNA, 477 bp, Fraxinus spp
ttgaacctctatcttcgattcgctcatgggaaagggaacggggagttttggtaagcgaaggaacaaaactcacactctgtgtgtgagatgcggtcgccgcagcttccacatccagaagagtcgttgctcagcctgtgcttaccccgccgcacgcgtaaggaaatataactggagtgtcaaggcgatacgaagaaagaccactggaactggtcgtatgaggtatctccgtcatgtagctgttaggttcaagagtaacttcagagaaggtactcaagcacctccaagaaagaagggcgctgctgcagcatcgtaaggtcttgaaggaaatcctgaatcttctaatatcaatatctttaatttgtgagagaatcgagttttggttattcagtgtaggttatcgactgtaaaaatctttagtaagacgtgaacaagttttacatgaagttgaaaaatgacaacagtttaccgctagtaaac

SEQ ID NO: 1963 - DNA, 593 bp, Fraxinus spp
gaaggaaaatctagggtttctgcaaactgcacaacaatggggaagggaacagggagctttggtaagaggaggaacaagacacacacattgtgtgtgaggtgtggccgccgcagcttccacctccaaaagagccgctgctccgcatgtgcataccctgctgcccgcaagaggacatataactggagcgtgaaggctatccggagaaagactactggaacggggcgcatgaggtacctacgtcatgtcccgcgcagattcaagaccaacttcagagaaggtactcaagcggcaccaaggaagaagacagccgcggcttctgcttaattttgacgggttctttggattttacttttcttatctcctgtttgaagtactagagagcaaactgaatttggaaacttcttttgttcgcatttcatgatgaaattgaatttacattttccgttttgtgccttaatcttctcaatagtataccattatctattaatttgaatgctcattcttggcattgttataattgctaatttcttctgttatgaatttctaaaaattttagtgttattcaataaatatttgtgggatagtatgttagc

SEQ ID NO: 1964 - DNA, 811 bp, Vitis vinifera
ctctggttcatggtataaagcctatcgataacgccgctctgaggtccttggccagggagctcctaagttagggtttttttttctctctgctacaatgggaaaaggaacaggaagcttcggtaagagaaggaacaagactcacaccctctgcgtccggtgcggtcgccgcagcttccatctgcagaagagccgatgcgccgcctgcggttttcccgcagcccgtatcagaaaatataactggagtgtgaaggcgatccggaggaagacaactggaactggtaggatgaggtaccttcgccatgttgcttgtaggttcaagagcaacttcagagaaggtactcaagcagctccaaggaagaagggagcagctgcctcagcttaaggtgtagaagagccatactgggcataatttgggtgctgcccttcttagtttcagttggcatcaggtgttggaacaagatttttgggaacattatttgatcagtgttgcttatttttcattccaaaattgctctcagttttccttgatatgtagttggtttaaattttggatgcgaattggacgattctactgttagtttggccttttacttactttttggttggtttttctttgatggaagtttatggttttcatgttggctaatcattatttatctcatgagaatgctgttagtagaccttttgtttttggggaaatgcagtatagtggttctaggaaaacttgtgcgttacttcttaaacttcaattatttggcttctcccgcctttttaggtggggtgaaggtgttagatgttgggttctgttttg

SEQ ID NO: 1965 - DNA, 603 bp, Ipomoea batatas
ggccgggggactactgcgaacttccgaagccagggtttttcgcctccgccgagcaaatgggaaaaggtaccggaagttttggtaagcggaggaacaagacacacacactatgtgtgagatgcggccgccgcagcttccatatccagaagagccggtgttccgcttgcgcctatcctgctgcacgcaccagaaaatataattggagtgtcaaggcaattaggagaaagactactggaactggccgcatgaggtatctccgccatgttcctcgtagattcaagaccaacttcagagaaggtactgaggcaactccaaggaagaagggagcagcagcatcctcttaaatttcatttcctcagttttagcagtgtttttattcttccatgagtttcccatattttattacaaaacaagtttggttttgcttgttagaggaccagttgttgtcaatgtggagtattttgttttctgacaagcagattcagattctacactatatctttcttctttgaaagctagttgtaatttaattttgtattgcttgatattataaaactcagacccccttcatcaaatcaaaatgctccaatctatttatgaggt

SEQ ID NO: 1966 - DNA, 569 bp, Lactuca sativa
ggcggggagagatacaattacagccgcctcccccttcaacgtggtagaaggatcagcgtatctagcaccttgtaacaatgggaaaaggaacaggtagttttggtaaaagaaggaacaaaacacacactctatgtgtacgctgtggtcgtcgcagcttccatctccaaaagagccgatgctctgcttgtgcttaccctgctgctcgcgtcaggaaatataactggagtgtgaaagcgattcgtaggaagacaaccggaactggacgtatgaggtatctccgtaatgtgcctcgccgattcaagagcaacttcagagaaggtactcaagctgctccgaggaagattggtgctgcatcatcagcttaaatttcaaatttagttcgtgatcaagttttgtggaacatcattagatgtgtttaatataattgactttcagttgtaatttttcaagtctgtttagaaatttgtgttttttaatcaatgattaaatgagacatacactcgcattgttatagaatctcaaggttttagtgacaaattaagtccgtattagaaattttatgactcaca

SEQ ID NO: 1967 - DNA, 716 bp, Glycyrrhiza uralensis
agtaacagatatacactataaatattactctccacgccgtttcgtcttcttcagccacatagctccctcgctgcatagcttagggtttcttcagcatctgcttcaatggggaagggaactggaagcttcggtaagaggaggaacaagacccacactctctgtgtgaggtgtggccgccgcagcttccacctccagaagagtcgctgctccgcctgcgctttccccgctgctcgcaccaggaaatataactggagtgtcaaggcaatccgcagaaagaccaccggaactggtaggatgaggtacttgcgtcacgtgcctcgccgattcaagagtggcttcagagaaggaactgaagctgcacccaggaagaagggaggagctgccaccgcttaaggattcggaagattgttgtttgctgggtacggagttatagattctcatattgtttttttgtcgtcggggcaaagtctattagaacatttgttttttgtggcctcattgtttctgtcttattttcccttaatttgtagttgctttacagttcaacatgattataagacttattgattgttcagttggattgtatggcttttatagttttggttctaaatggttctcttctgggaaatagagatcccttaacctgaaatactattttcggcattcgtcatgaagtttgtcgtaataataaccattgagccataattagtcttgcg

SEQ ID NO: 1968 - DNA, 568 bp, Mimulus guttatus
atcttctctcacttcatttcacttccatcttcatataaacgcccttacgacgccgcttctccccggaaaagagaatctagggtttctgcaaactgatctgcaatgggcaagggaacagggagtttcggaaagaggaggaacaagacacacacactgtgtgtgaggtgcggccgccgcagctttcacctccagaagagccgctgctccgcctgcgcgtaccccgctgctcgcaagaggacatacaactggagtgtgaaggcaattcgccgaaagactactggaactggaaggatgaggtatctgcgcaacgtgccccgcagattcaagaccaacttcagagaaggtaccgaagctgctccaaggaagaaggcagcagttgcttctgcttaagtgttcgttggaaggttcttttttggatgtatttcttttattttcgtcttgagagcattagtcaacaattgagttttcgaatagctattgattttgtttttgttattttaatatcattttaatacatatggatggaagaccattaattacttgatgtgcattttccggattttcattt

SEQ ID NO: 1969 - DNA, 606 bp, Mimulus guttatus
atttctccatcttcagctcagcgaggaagcctgtttctgcaacttcacagccatgggtaagggaacggggagtttcggtaagaggaggaacaagacacacacactgtgtgttaggtgcggccgccgcagttttcaccttcagaagagccgctgctccgcctgcgcttaccccgccgcccgcaagaggacctataactggagtgttaaagctatacgccgaaagaccaccggaactggacgcatgaggtaccttcgcaacgtaccccgcagattcaagaccaacttcagagaaggtactgaagctgcaccaaggaagaaggttgctgctgcttctgcctaagtgtaggcttctcttgattgtacttttccattcgtattccgaaagaattagagtgcaagttaattttgaaactccaattttcgtttgttggatacttagttttggttctgattttgttgatgtactttgttgggcatcttattatggatgatcaaagaccatttttttacttatgtgctttctttcgttattataactatctttcttttctcggagtgtttgatattgtgctatactgcaaagcaaccgtctttttgggggtttga

SEQ ID NO: 1970 - DNA, 578 bp, Nuphar advena
  misc_feature (39)..(39): n is a, c, g, or t
  misc_feature (45)..(45): n is a, c, g, or t
  misc_feature (47)..(47): n is a, c, g, or t
  misc_feature (51)..(51): n is a, c, g, or t
  misc_feature (58)..(58): n is a, c, g, or t
  misc_feature (429)..(429): n is a, c, g, or t
  misc_feature (499)..(499): n is a, c, g, or t
tcgctggctggcttttctctccctttccctctcacgcanagaggngnccgngagaganaaggagctatgggtaagggaacgggaagcttcgggaagaggaggaacaagacccacaccctctgcgtgagatgcggtcgccggagtttccatctccagaagagccgctgcggttcctgtggctatccgtctgctcggattcgcaagtataactggagcgtgaaggcgatcaggaggaagacgacggggtcaggccgtatgcgctacctccgccacatgccccgtcgattcaagagcaatttcagagaaggaacccaagcggtgccgcgaaagagggcggatgcagcgtcgtcttagagcgtatcgattctcaagaagtagctgaaagtcgcgatgttattctcgtttgggatcttcctttctgtcgttttntcctatttatggaccaaaccgttttgaagatgggttgttcatcagagttgatgatattagaattatcaanttttttgtattgtgttaattttaagatgttcacgttccattgaggcatcttatttctgtcatcaagtgctttaattctc

SEQ ID NO: 1971 - DNA, 956 bp, Quercus alba
atggggctaaaagcaaaacccctcgttctctttctaatataaaacgtgaacttcaccgccgcgttcagtcttctttgtttagccctaagaagaaccacacctcttctcttcctcctcctagggttttgcatctgcatctgcaccaatgggtaagggaacagggagtttcggtaagaggaggaacaagacccacacactgtgtgtgaggtgtggccgccgcagtttccatcttcagaagagtcgctgctctgcctgtgcctaccctgctgcccgcaagaggacttataactggagtgtgaaggcaatcagaagaaagaccaccggaactggaaggatgaggtatctccgccacgttcctcgcagattcaagagtggcttcagagagggtactcaagctgcaccaaggaagaagggagcagctgctactgcttaaggcatcattggagagctgtttttggtgtaatttgggacccaaattacaagtttagattgagcttaatatgttggaactggtttttgaatgtaatgtttgatgggtgtcataaccttataatgattttagttatttttgatttgtttcaatatgtagttgctttaattttggacaaggatgaatgcgtctactatgttttccccgttatattccaaaatgaattctgaattttgtttctggttaacttttgttgagtactgagatagtagtgaaattaactccacaatgtcagattaacggggggtaattatagttactgtttagactttttggacatgcaatggttgaactgcattatagtttctacaattaataatcaatattagctcaattagcctagaaatttgtttctgaaactggattggatgtattttctaccactcattttaatagaaaaggaatgctataagagctttgagtaagtggtgttcaagacacttgattgcattgtttttactattgt

SEQ ID NO: 1972 - DNA, 871 bp, Quercus alba
aatataaaacgtgaacttcaccgccgcgttcagtcttctttgtttagccctaagaagaaccacacctcttctcttcctcctcctagggttttgcatctgcatctgcaccaatgggtaagggaacagggagtttcggtaagaggaggaacaagacccacacactgtgtgtgaggtgtggccgccgcagtttccatcttcagaagagtcgctgctctgcctgtgcctaccctgctgcccgcaagaggacttataactggagtgtgaaggcaatcagaagaaagaccaccggaactggaaggatgaggtatctccgccacgttcctcgcagattcaagagtggcttcagagagggtactcaagctgcaccaaggaagaagggagcagctgctactgcttaaggcatcattggagagctgtttttggtgtaatttgggacccaaattacaagtttagattgagcttaatatgttggaactggtttttgaatgtaatgtttgatgggtgtcataaccttataatgattttagttatttttgatttgtttcaatatgtagttgctttaattttggacaaggatgaatgcgtctactatgttttccccgttatattccaaaatgaattctgaattttgtttctggttaacttttgttgagtactaagatagtagtgaaattaactccacaatgtcagattaacagggggggaattatagttactgttttagacttttttggacatgcaatggttggactgcattatagtttctacaattaataatcaatattagctcaattagcctgaatttgtttctgaaactggattggatgtattttctgccactcattttaatagaaaaggaatagctataaga

SEQ ID NO: 1973 - DNA, 671 bp, Orobanche aegyptiaca
acaacgccgctctcgtcttctccacctcagacctcaaacagagagaattagggtttctgcaacttcacagatatggggaagggaacaggaagctttggtaagaggaggaacaagacacacacactgtgtgtgaggtgcggccgccgcagtttccatcttcagaagagccgctgctctgcgtgtgcttaccccgccgcccgcaagaggacatacaactggagtgtgaaggctattcgtagaaagaccactggaactggacgcatgaggtacctccgccacgtgccccgcagattcaagaccaactttagagaaggtactcaagctgcacctaggaagaaggcagcagatgcttctgcttaagctcgtatttggaaggcagtcttgattgtatttttcatttgtctttttaaagaattagagagcaagggagttttgggaaccatttgtaggggatcttccccagtcggatattgagttttgtttctaattttgttctgctttgtttggcattttaatacttatgtctgaaagacacttactagctctcttatgctttctttttgaagtttgcatcacatatattttcagttcattttggtgtgatttgagtggattgcatctgtaaatctaattgagatatctgcaattaaacagcctatttgggattggta

SEQ ID NO: 1974 - DNA, 637 bp, Orobanche aegyptiaca
acctcaaacagagagaaactagggtttctgcaacttcacagatatggggaagggaactggaagctttggtaagaggaggaacaagacgcacacactgtgtgtgcggtgcggccgccgcagtttccatcttcagaaaagccgctgctccgcgtgtgcttaccccgccgcccgcaagaggacatacaactggagtgtgaaggctattcgtagaaagaccactggaactggacgcatgaggtacctccgccatgtgccccgcagattcaagaccaactttagagaaggtactcaagctgcaccaaggaagaaggcagcagatgcttctgcttaagctcgtatttggaaggcagtcttggttgtatttttcatttgtctttttaaagaattagagagtaagggaggtttgggaaccatttgtaggggggctgggaagttggatattgagttttgtttctaattttgttctgctttgtttggcattttaatacttatctgaaagaccattactagctctcttatgcctcgtctctttgaagtttgcattacatttattttcagttcattttgttgtgatttaagtggattgcatatgtaaaataaatagagatctctgcaattaaacagcctatttgggatt

SEQ ID NO: 1975 - DNA, 565 bp, Capsicum annuum
gcacgaggggtttctgcaacttcactgcaatgggtaagggaacaggaagtttcggtaagagaaggaacaagacacacacactctgtgtgagatgcggccgccgtagcttccatctccagaagagccgttgttctgcttgtgcttatcctgctgcccgtaaaagatcatacaactggagtgtgaaggcaatccgcagaaagacaactggtactggccgcatgaggtaccttcgcaacgtccctcgccgatttaagaccaatttcagagaagggactgaagcagctccaaggaagaaggctgcagcagtttctgcttgaagcccttgaagagagtaattgaggagggtacttttaatggtagcttcgctttggtattcaagtattagagagcaagggaattttgggaaagcttaagtatttaagtttttgaaatgtgttgttgaaattgtcattcggatacagattttataggctgctttctatttttggtttctctgaacgccttgtgtttcattaaattgagaatttatgttttttgagctcataattttgcaatttttacccta

SEQ ID NO: 1976 - DNA, 758 bp, Petunia hybrida
gaatctttatcgatcaggaggagagcacgcttagggtttctgcaactacactgcaatgggtaagggaacagggagtttcggtaagagaaggaacaagactcacacactatgtgtgaggtgtggtcgccgcagtttccatctccagaagagccgttgttctgcttgtgcttatcctgctgctcgtttgaggaaatataactggagtgtgaaggcactacgcaggaagacaactggtactggtcgcatgaggtacctccgcaatgttcctcgcagattcaagactaacttcagagaagggactgaagcagcaccaaggaagaagggagcagcagcttctgcttaaggttctttgagagagttgttgaagagggagcttttgttatggtagctgcattttgttattcaagcattagatcaattttgggaaccgtatgtccagggtttgttgatgcccagacaaagttaatgtgcttaagttttcgaaatatgtatttgagattggcattctgatacaacagatggtttttaatagactgttttctacttttggctgttccgactgtcctgtccatttctcatgtttcattgagttttgagattgaggttttgagctcataattcctgtcttaaacacagtgctatgctgatcatcttttaagcgcctattctggctggcctgccttgtgttattaggagtcttatgatggattgttggtcggttgcctatgtgatgtgcataatatgtcgatgccattttt

SEQ ID NO: 1977 - DNA, 530 bp, Plantago ovata
tcaactccgcacataatcgtctgtgacgccgctatcatctctcgctcagcctagagtctctgcaactcgatcgcaatgggtaaaggtaccggaagtttcggtaagaggaggaacaagacacacactctgtgtgtccgttgcggccgccgcagctttcacctccagaagagccgctgctccgcttgcgcttacccagctgcccgcaagaggacatacaactggagtgttaaggctatccgaagaaagaccaccggaactggccgcatgaggtacctgcgcaatgtgcctcgccgcttcaagaccaacttcagagaaggtactgaagctgcaccaaggaagaagtcagctgctgcttccgcttaagttataatgttggatgtgacttgactctgcggtgttaatcttaaaaacattagcgagttacagaattgaagttcttttttgttatgacagtgagtcttaaatgatactgcctagtttgatattaaattttgtttctgtatcttgatgtggatgatttatcgaagacc

SEQ ID NO: 1978 - DNA, 669 bp, Solanum tuberosum
ataagcactgcctagatcgccgcagttctcagttgagaaagcttaggaggaggtcgctagggtttctgcaactgtagcgtaatgggtaagggaacaggaagcttcggtaagaggaggaacaagacccacacactatgtgtgaggtgtggaagacggagcttccatctccagaagagccgttgctctgcttgtgcttaccctgccgcccgtaaaaggacatacaactggagtgtgaaggctattcgcagaaagacaactggaactggccggatgaggtatcttcgtaacgtccctcgcaggttcaagaccaatttcagagaaggtactgaagcagctccaaggaagaagggagtagcttctgcttgaggcctttagacagttacttgagaggctattagtggtagcttcattttgatatttcaatatttagatcaagtaaaattttgggaccttctatcttaggttttattgccctttgaaagattaatgtgcttaaaattttcaaagtatgtattccaacttggcatttttataaagaagggatcttgagacttccataacatattggatctgatctgcctgtctagtttttatgttaccttgtggttgttcaaattgctcattttgaatctgttgctgtatgaaatgattccatttaatttagtgtta

SEQ ID NO: 1979 - DNA, 530 bp, Prunus persica
cacttctttagcctgaacacctccatctcacaagctagggttttctctgcgctccaatggggaagggaacagggagttttggtaagaggaggaacaagacccacaccctctgcgtgaggtgtggacgtcgcagcttccacttgcagaagagtcgctgctcggcttgtgcctttcctgctgctcgcaagaggaagtacaactggagtgttaaagccatccgaaggaagaccactggaaccggaaggatgaggtatctgcgcaatgttcctcgcagattcaagagtggcttcagagaaggtactgaagctgcaccaaggaagaagggagcagcagcaactgcttaagccttccaatgagtgattttgaatgtcatttgggatacccagttatagctttagaaagcgattttatgagtttggacaagttctctatgagctttgttattgtttttgatggatgttataactgttattgttttaattggatcttcacttccttttaatagtagttgctttcagtttgtgacaaga

SEQ ID NO: 1980 - DNA, 482 bp, Sesamum indicum
ggaaagcgagaaggtctagggtttctgaaacctcgcagcaatgggcaagggaactgggagctttgggaagaggaggaacaagacacacacactgtgtgtcaggtgcggccgccgcagcttccatctacagaagagccgctgtgccgcctgcgcttaccctgctgcccggaagaggacatacaactggagtgtgaaggccatccgtagaaagactaccggaactggacgtatgaggtacctccgccacgtgccccgcagattcaagaccaactttagagaaggtactcaagctgcaccaaggaagaaggcagcagctgcttctgcctgagggtcttcactttggggggtagttttgattttattgtacttctttcattgctgttgtgaaagcaaagaacagttgaattttgggaatgtcatttttcttatggttatcgatttgaacagccttttacctcgctgcctacttagttatcagtttt

SEQ ID NO: 1981 - DNA, 653 bp, Sesamum indicum
cttcatataaaagtccccgcgacgccgctgctctctctttaaccacagagctcaggaaagcgagaaggtctagggtttctgaaacctcgcagcaatgggcaagggaactgggagctttgggaagaggaggaacaagacacacacactgtgtgtcaggtgcggccgccgcagcttccatctacagaagagccgctgtgccgcctgcgcttaccctgctgcccggaagaggacatacaactggagtgtgaaggccatccgtagaaagactaccggaactggacgtatgaggtacctccgccacgtgccccgcagattcaagaccaactttagagaaggtactcaagctgcaccaaggaagaaggcagcagctgcttctgcctgagggtcttcactttggggggtagttttgattttattgtacttcttttattgctgttgtgaaagcaaagaacagttgaattttgggaatgtcatttttcttatggttatcgatttgaacagccttttacctcgctgcctacttagttatcagttttgtttgtgttctccaatcgcacttcaatacagattgatgaaagaccattatttgctttactgtgcactgtcttcgaatatatgcaactcttcgaatttgcattttctttcctcaagcc

SEQ ID NO: 1982 - DNA, 601 bp, Solanum phureja
gcaggcacaaccctaaaagccttcttccttcactaccaaactataagcactgcctagatcgccgcagttctcagttgagaaagcttaggaggaggtcgctagggtttctgcaactgtagcgtaatgggtaagggaacaggaagcttcggtaagaggaggaacaagacccacacactatgtgtgaggtgtggaagacggagcttccatctccagaagagccgttgctctgcttgtgcttaccctgccgcccgtaaaaggacatacaactggagtgtgaaggctattcgcagaaagacaactggaactggccggatgaggtatcttcgtaacgtccctcgcaggttcaagaccaatttcagagaaggtactgaagcagctccaaggaagaagggagtagcttctgcttgaggcctttagacagttacttgagaggctattagtggtagcttcattttgatatttcaatagttagatcaagtaaaattttgggaccttctatcttaggttttattgccctttgaaagattaatgtgcttaaaattttcaaagtatgtattccaacttggcatttttataaagaagggatcttgagacttccata

SEQ ID NO: 1983 - DNA, 690 bp, Fragaria vesca
attagttggattgcatgaggccctcgacccgggagcccaaattaacccgacccggggagttccactttaacctaacacacacattctccttcatataaattctctcctttccgccgctcagctctttagtctaaacaactccgtctcagtagcagcagctagggtttggtttctctgcctcgcatccatgggtaaggggactggaagtttcggtaagaggaggaacaagacccacactctctgtgtgagatgtggccgccgcagcttccatctccagaagagtcgctgctctgcttgtgcctaccctgctgcccgcaccaggaaatttaactggagtgtgaaggctatcagaaggaagaccactgggaccggaaggatgaggtatctgcgcaatgtgcctcgcaggttcaagagcggtttcagagaagggactgaagctgcaccaaggaagaagggagctgcagcttctgcttaagtgagagtgtcttattcggtaccagttatagctttactagggcactttatgattctaagacaagctctttaagaacattgttattgttattatcgatggcagaacttatattactgctttgagttttgaacatgaaatgtatcagactagtgttactttctaattacatgatggtttgatgatatatgaaattctgtgtttttattgtttggacc

SEQ ID NO: 1984 - DNA, 514 bp, Helianthus annuus
caggatctcggcaaccgcaaacaatgggaaaaggtacaggaagcttcggtaaaagaagaaacaaaacacacacactgtgtgtccggtgtggtcgccggagctttcatcttcaaaagagccgatgctctgcttgtgcttatcctgctgctcgtgtacggaaatataattggagcgagaaggcgatccggaggaagacaaccggaactggtcgcatgaggtatcttcgtaatgtgcctcgcagattcaaaagcggtttcagagaaggtactcaagctgctcctcgaaagatagctgcagctgcttcgtcttaaatttctgatcagaaccgctattttggtaccaatcaagcttattttatttagatcaattcgtgtatcgaacatcatttggcgcttttgattctgtaggatcattgaactttgttatgattttttttattatgattttgtgcatcatgagttcatgacatttaatttaaattggttgcgataataaaatttttaatatattatgt

SEQ ID NO: 1985 - DNA, 598 bp, Helianthus annuus
caactcatagtacgctggggccaccgtcttccctgtcctgctagggtttgctccaagttgcaggatctcggcaaccgcaaacaatgggaaaaggtacaggaagcttcggtaaaagaagaaacaaaacacacacactgtgtgtccggtgtggtcgccggagctttcatcttcaaaagagccgatgctctgcttgtgcttatcctgctgctcgtgtacggaaatataattggagcgagaaggcgatccggaggaagacaactggaactggtcgcatgaggtatcttcgtaatgtgcctcgcagattcaagagcggtttcagagaaggtactcaagctgctcctcgaaagatagctgcagctgcttcggcttaaatttctgatcagaaccgctattttggtaccaatcaagcttattttatttagatcaattcgtgtatcgaacatcatttgtcgcttttgattctgtaggatcattgaactttgttatgattttttttattatgattttgtgcatcatgagttcatgacatttaatttaaattggttgcgataataaaatttttaatatattatgttccaagaaaaaaaggagatagaaa

SEQ ID NO: 1986 - DNA, 597 bp, Solanum lycopersicum
acaaccctaaaagccttcttccttcactaccaaactataagcactgcctagatcgccgcagttctcagttgagaaagctcaggaggaggtcgctagggtttctgcaactgtagcgtaatgggtaagggaacaggaagcttcggtaagaggaggaacaagacccacacactatgtgtgaggtgtggaagacggagcttccatctccagaagagccgttgctctgcttgtgcttaccctgctgcccgtaaaaggacatacaactggagtgtgaaggctatccgcagaaagacaactggaactggccgcatgaggtatcttcgtaacgtccctcgcaggttcaagaccaatttcagagaaggtactgaagcagctccaaggaagaagggagtagcttctgcttgaggccttcgagacagttacttgagaggctattagtggtagcttcattttgatatttcaagtgttagagcaagtaaaattttgggaccttctatcttagtttttattgccctttgaaagattaatgtgcttaaaattttcaaagtatgtgttccaacttggcatttttataaagaagggatcttgagacttccataa

SEQ ID NO: 1987 - DNA, 629 bp, Solanum lycopersicum
aattccttttcgtataattttctagccaagacatcgtcgaagcttgaggaaaagctgcacaaatgggaaaaggaacaggaagtttcggtaagaggaggaacaagacacacacactgtgtgttagatgtggtcgacgtagcttccacatccagaagagtcgttgttcagcttgtgcttaccctgctgctcgtctcagaaaatataattggagtgtcaaggcacttagaagaaagaccactggaactggtcgcatgaggtatctccgcaatgttccccgcaggtttaagacaaacttcagagaaggaactgaagcagctccaaggaagaagggtactgctgcagcctcttaagtttctaaagaagcagttttgatgctgtttcgttttgattgtctttcatttcgctgatgaatcgaagttttgaatatttttttctggaatattacctctcatctgttagattggaattattgctgttaaaaagatatatgtccaatggatttggtttctatttgatatttagcttaatcatctaatgattatactttttaaaatgtggtataacttcgtatagtttaggattagaaattatatcttgaaaattcacttattattattatctcttaacaa

SEQ ID NO: 1988 - DNA, 616 bp, Tragopogon dubius
taggggagttgagaatcaatcatcaaagtatatagccgccgcttcccctttctctccgaccaaagggacgtgcttgaagaattagggtttctaggacatcgtaacaatgggaaaaggtacagggagttttggtaaaagaaggaacaaaacacacactctgtgtgtccggtgtggacgtcgcagtttccatctccagaagagccggtgctctgcctgtgcctaccctgctgctcgcgtcagaaaatacaactggagtgagaaggcgattcgtaggaagacgaccggaaccggacgcatgaggtatctccgtcatcttcctcgcaggttcaagagcaatttcagagaaggtactcaagccgctcccaagaagatagctgcaacatcttcagcttaaatttcgagggtttttatctgaagcggtttattggtaatctgtttgaagcataattcaatttagttcgtgatcaaatcaagtcgtttgcagtttttgtttagaagtttgtgagtttaaattttgggttaaatgatacatacacttgttctgtttcttgaatcaagcagtttgctttgtgttatgtcctactcatatatacgaatcttgatgaattcccttaag

SEQ ID NO: 1989 - DNA, 539 bp, Trigonella foenum-graecum
ggattgattagggttttgcgaaaacgtaaaaaaccttaaacttaactaaacaatgggtaagggaacaggtagtttcggtaagagaaggaacaagacccacacactctgcgtcaggtgtggccgtcgcagtttccatctccagaagagtcgctgctcagcatgtgcttatccagctgcacgtgtcaggaaatataactggagtgagaaggctattaggagaaagactactggaactggtaggatgaggtacttgcgtaatgtgcctcgcagattcaagagcggattcagagaaggtactgaagctgcacccaggaagaagggagcagctgcttctgcctaaatctatgaaagcttggtttttgctgtgctctaattaaatgataggagctaagatttttgtttaggggcatggatcttttgaacaatactctatctgttgttttcatttccctccatatgaatttgtttatgttataacatcagaattgcaagatatttttgttgttaaatgagaatttgagctggatatttctgattat

SEQ ID NO: 1990 - DNA, 545 bp, Zostera marina
gaagagaactagggttagtactccggcgcgaaggaaatggggaagggaactggaagttttggaaagcgaaggaataagactcacacactctgcgtacgatgtggtcgtcgtagctttcatcttcagaagagtcgatgtgcatcttgtgggtaccctgcggctcgaatcaggaaatataactggagtgtgaaggccctcaggaggaagacaacaggtactggtaggatgaggcaccttcgtcatcttcctcggcgatttaagagtggcttccgtgaaggctctgaagctgcccctaagaatagatctgcaactgtcgcgtaatgaaggaagaaaaacaatttcaattcaaagtaattttgatcctgtagtgtttttttataaatgtgatgtgttcttgcttgtttttgtttatgaccttttgtttgtcttaaacatcttattttaaacataaagtttcatttctcaattaatcttcatgtttctgtttggtaacatgaatttttctctcaaacattatacatttaatctcaatagtaatttaactc

SEQ ID NO: 1991 - DNA, 556 bp, Rosa hybrid cultivar
aaacagctccatctcagtagcagcttagggtttctctgccgtacccatgggtaagggaaccggaagtttcggtaagaggaggaacaagacccacaccctctgcgtgaggtgtggccgtcgcagcttccatctccagaagagtcgctgctctgcttgtgcctacccagctgcccgcaccaggaaattcaactggagcgtgaaggccatcaggaggaagaccaccgggaccggaaggatgaggtatctgcgcaatgtcccacgcaggttcaagagcggtttcagagaaggtaccgaagctgcaccaaggaagaagggagctgcagcttctgcttaagtatgtgagagtgtcattttgggtaccggtcatagctttactagggcgctttatgattctggacaagttctttaagaacattgttattgttattatcgagggcaaaacttctattattgctttagttgctttgagttttgaacatgaaatgtatcagactagttttactttcttattaacttaactatagtagttggttagttagtagtatattataaaaaa

SEQ ID NO: 1992 - DNA, 628 bp, Phaseolus coccineus
tcattatgcagtcatagagagatcctccaacaactagggtttctgagtcgctgcgacaatggggaaaggtacagggagtttcggtaagaggaggaacaagactcacacgctctgtgtgaggtgtggtcgtcgcagcttccaccttcagaagagtcggtgttctgcgtgtgctttccccgctgcgcgcacaagaaaatataactggagcgtgaaggccattaggagaaagacaaccggaacaggaaggatgaggtaccttcgtcacgtgcctcgcagattcaagagcggcttcagagagggcacggaggcagcaccaaggaagaggggagcagcttccactgcctaatctttgagaggaatcaatttttctgggttagtgaattataggagttaaggattgtgtgctgtttctaaagaacattttttgtttctgtcgtcttaatttcatttaatatgtaatggatttttatttcgacatttgatcgatttcatagctctgcgttcactttatcaacattcatagcattttgatagaaatccctttgagaattttgatggacttatttagttttataagtaattgttaatattggtactatacagtaaaatcacttcaacctgaactagc

SEQ ID NO: 1993 - DNA, 677 bp, Lactuca sativa
atggtattatactattatataatcttttaatgaaaaatgatccagttagcccattcaaatatacaaagcccagtttatcgagaggctaacaaaaccctagtttggacgatcaatcatcagagtatacaattacagccgcctcccccttcaacgtggtagaaggatcagcgtatctagcaccttgtaacaatgggaaaaggaacaggtagttttggtaaaagaaggaacaaaacacacactctatgtgtacgctgtggtcgtcgcagcttccatctccaaaagagccgatgctctgcttgtgcttaccctgctgctcgcgtcaggaaatataactggagtgtgaaagcgattcgtaggaagacaaccggaactggacgtatgaggtatctccgtaatgtgcctcgccgattcaagagcaacttcagagaaggtactcaagctgctccgaggaagattggtgctgcatcatcagcttaaatttcaaatttagttcgtgatcaagttttgtggaacatcattagatgtgtttaatataattgactttcagttgtaatttttcaagtctgtttagaaatttgtgttttttaatcaatgattaaatgagacatacactcgcattgttatagaatctcaaggttttagtgacaaattaagtccgtattagaaattttatgact

SEQ ID NO: 1994 - DNA, 489 bp, Picea glauca
cggggaagagcggaggagtcggtgcgcgctgcaacaatgggcaagggaacaggaagttttggtaagaggagaaataagacccacactctttgtatccggtgtggtcgccgcagttttcatatccagaagagtagatgttcggcatgcgcctacccatcaaagcgcatccgtaaatacaactggagtgtcaaagccattcggagaaagactactggaacaggacgaatgagatacctgcgtcacatgcctcgtcgcttcaagaataatttcagggaggggactcaggcaaccccaagaagaaggctgctgctaccacattttaaattagctttaagaaatggccctgaaatattttgtagagttttaaccttcgttgttgagctggcacgacttgacttattttcatatgctgtcattgacagctttattttctttcacaactcatggttttgaagtaaactcgtttcctatacttttgtattgatgttg

SEQ ID NO: 1995 - DNA, 691 bp, Citrullus lanatus
aaatttaagtgcgttaatcgacttgtttattgatcggtaattagggtaagggaacgggaagtttcggtaaaaggaggaacaagacccacactctatgtgttaggtgtggccgccgcagcttccacctgcagaagagtcgatgctccgcctgtgcatttccagccgcccgtaagcgtaaatataactggagcgtcaaggcgatccgaaggaagaccactggaactgggcggatgagatatttgcgccatgttcctcgcagatttaagagtggtttcagagaaggtactgaagcagcgccaaggaacaaaggagcagcagcatcagcctaagacatcgaaggttaattgtggcacaacttggtatctttatagcttctaggaggattttgtcattttcgggactagaatttataagaattttgttttatgatgttattaccttcaatactgaagctcatttttatttcttactatgttgtttatggaatttctgatgattgtttccagaccactttcacctttggttaatctatgtcttgagttatatacttctagttctagccattttaggagatttttgctggtagatattgtttccttgaaggccagggtagaatctattagtaagaaatttgggtgtttggatcatttgttaatgtttgagttgttccttattctgggtctcaagcctc

SEQ ID NO: 1996 - DNA, 782 bp, Amborella trichopoda
gggtttctcaactccacaagaaaggtggcagaggttctctctcgcagccttttctgcgaaggggcgacctagaagagaacacagagaacaatcttcgtcatgggaaaaggtacagggagctttggtaagaggaggaacaagacccacaccatctgtataaggtgtgggcgccggagttttcatcttcagaagagcagatgtgcttcatgtggatatcctgcagcccgcatcagaaaatataattggagtgtcaaggcaattaggaggaaaactacggggacagggcgcatgaggtatcttcgtcacatggcacgaaggtttaagagtggtttcagagaaggaactgaagcagcacccaggaggaagactgctacttgatcatgagtcaacgataaagcagattacgaagcacacattcacgtcctttattaaatgagcattcttttgggtggcctctcggactgattttagtcactggattcttttttttttttgtttttccattagagaaataaaagatgagaacatatgtttctacattttgtagttttgaggcagtatgttatcttttctttttttttgacaaattatttacggtttcttatcagaaacctgtgttttggggttactactgttctttgaatgttgtgtcttagacagtgcaagcatggtgcttatggttcttggtgggtttatttatggttagcagtttcaacattcaatgtccggtgttgtgcgaaaccgtccccattttcttttgaatgttgacaatccctataata

SEQ ID NO: 1997 - DNA, 665 bp, Musa acuminata
atgtgcccggctagtgttcacgggttttgggtgtatccttctcctcatgtgaactctggcagcgccttcaccatcgatgatagaaatgtaagggaccaatatgtaaatataacgtctctatttataagcctaacctatccaccgtcttcctcttcggtcgcggctacggttttgcggagggcgactccaatggggaagggaaccgggagcttcgggaagcggaggaacaagacccacactctctgcgtccgctgcggtcgccgtagcttccacctccagaagagccgctgcggtgcctgcggctacccttctagccggatccgtaaatataactggagcgtgaaggcgatccggaggaagacgacgggaaccgggaggatgcggtacctccgccacgtaccacgccgcttcaagagcaacttccgcgaaggtactcaagcggttcccaggaagaaggccgtggctgacgcttaattttaatgtcaaccttcagtgagtcgcttcggacttggagctcaggagtttttttccaagtagaaactgatgcaaattgatctctcttcttaggtgttggattgaactttcaatctcagatgattattgaactttgagttgaaatagaaaagattactattttctgggaaaaaagttgtgtattccgtttt

SEQ ID NO: 1998 - DNA, 678 bp, Beta vulgaris
atctagggtttctgccgccaagaaatgggtaaaggtacaggtagtttcggtaagaggaggaacaagacccacactttgtgtgtgaggtgtggtcgtcgcagttttcatctccagaagagtcgatgctctgcttgcgcttatcctgctgctcgcgtcaggaagtacaactggagtgtgaaggctatcaggaggaagacaacaggaactggtaggatgaggtacctgcgtaatgtcccaaggaggttcaagactggtttcagagaaggtactcaagcagctccaaggaagcatgtcgcagctgcctcttaattttagtttctgaaattctattgggcgtaaaattgcattttgggttgtttctagttttccttgaaaacgtgggatagccatttttggattattgttggagaactgcataattgtattagtaatgagagttttttttaccctgggaaatttttgacttgtttagctaaatgacatcatactgcaatctaaagtttcaatatcagcttagttatggttctcttaataattcttttactcaagcgattttttgtaggcaattcacccacggttacagtatatagtaatatagtatcttcaatgtactctacagtagaaaactggtaattatatatgttttgtacccatttccagaaatcgtttcgtggtcgg

SEQ ID NO: 1999 - DNA, 613 bp, Amorphophallus konjac
gcggccggcgagtcctccaggggctaccgaagcgaacaccgcatacgaaatgggcaagggcacggggagctttgggaagcggaggaacaagacccacacgctgtgcgtgaggtgtgggaggaggagcttccacctccagaagagcagatgcggctcctgtggctacccttccgctcgcatccgaaagtataattggagtgtgaaggctctccggagaaagacaactggtactgggaggatgaggtatcttcgtcatgtacctcgaaggttcaagactaatttcagagaagggacccaagccaagccaaggagggcagctgctgcatcagcttaacatcttattgaggaacagttgttgtctggagcagagtcttacaacatctcagttcattttgttaccttacttttccttaaggtttttacctgtggattttttgttttgttgagagcaaaacagtcaaacttcagcatgttcaagtattatgacatgttgaaatgctctaaaaatgtgataaacctttggcctttatctttccatgcacttcttttgtttcatctttgaatccgtttccttcatattcggtttgtttttctccttcttttgtgatttatg

SEQ ID NO: 2000 - DNA, 630 bp, Antirrhinum majus
gtaaaactagggtttttctgcaactttcaaagcaatgggcaagggaacagggagttttggtaaaaggaggaacaagacacacacactgtgtgtgagatgcggtcgccgcagttttcacctccaaaagagccgttgctctgcttgcgcttatcccgctgctcgcaagaggacctataactggagtgtgaaggctattaggcgaaagactactggaaccggacgcatgaggtacatgcgccatgttacccgcagattcaagaccggcttcagagaaggtactcaagctgcacctaggaaggttgcagccgcttctgcttaagagcttgttattgagggtacttcttgatgtacttttttttcttaaaagaagtagagagcatttgaattttgggatttatatttgaagggaaatgtcgttttgatggttccttagtagcttgatatttgtggttgttcagttggcaattaaaatggattaatgaaagactattgtcagctttgtttttatagtatctattagtcagctttgtgtttcatgctccatctctttcattgttttatgaagccagaagctggagcgctgctgtttatttgggttcgttactattgcagtttcattgcaaatttgct

SEQ ID NO: 2001 - DNA, 694 bp, Beta vulgaris
ccaacatccatctctattgattctttcccatcttaaaaccctaatcccataaacttataacccttgcagtcgaaattctctctcttcgaatccttcgaacatcagcaacgtctagggtttccgccgcaaaaaatgggtaaaggtacaggtagtttcggtaagaggaggaacaagacccacactttgtgtgtgaggtgtggtcgtcgcagtttccatctccaaaagagccgatgctctgcttgtgcttatcctgctgctcgcgtcaggaagtacaactggagtgtgaaggctatcaggaggaagacaacaggaactggtaggatgaggtacctccgtaatgtcccaaggaggttcaagactggtttcagagaaggtactcaagctgctccaaggaagcatgccgcagcttcttcttaattctagtacctgaatttcgttgggcggacaattgcctctggtggtgtttttagtttcctttaaaagcgtggaatagccaattttggatcattgtttaagaacagcagaatttgtacttgtaatgagatgttttgaaattctgagaagttttgagttgtttagctaattgacgtcatactgcaatctaaagtctcaatatcattttagttatggttcttgatattacttttgcttcatagattgtttgattgcgatttcacgaatgtggtaattgtat

SEQ ID NO: 2002 - DNA, 596 bp, Beta vulgaris
  misc_feature (55)..(55): n is a, c, g, or t
  misc_feature (86)..(86): n is a, c, g, or t
gggattcggccattacggccgggggcagtcgaaattctctctcttcgaatccttnaacatcagcaacgtctagggtttccgccgcnaaaaatgggtaaaggtacaggtagtttcggtaagaggaggaacaagacccacactttgtgtgtgaggtgtggtcgtcgcagtttccatctccaaaagagccgatgctctgcttgtgcttatcctgctgctcgcgtcaggaagtacaactggagtgtgaaggctatcaggaggaagacaacaggaactggtaggatgaggtacctccgtaatgtcccaaggaggttcaagactggtttcagagaaggtactcaagctgctccaaggaagcatgccgcagcttcttcttaattctagtacctgaatttcgttgggcggacaattgcctctggtggtgtttttagtttcctttaaaagcgtggaatagccaattttggatcattgtttaagaacagcagaatttgtacttgtaatgagatgttttgaaattctgagaagttttgagttgtttagctaattgacgtcatactgcaatctaaagtctcaatatcattttagttatggttcttgac

SEQ ID NO: 2003 - DNA, 563 bp, Fagopyrum esculentum
gcagatagcgggggggtaccgttcgaagccactctcgtcaagtccagagcctaccggagaagctagggttagttcgagcatcgacgatgggtaagggaacagggagttttggtaagagaaggaacaagacgcacaccctttgtgtgcgctgtggccgcaggagtttccatctccagaagagtcgctgttccgcttgcgcctatcctgccgcccgcttgaggaaatacaactggagtgtgaaagctatcaggagaaagaccaccggaaccggacgtatgaggtatctccgcaacgttccaaggaggttcaagaccaacttcagagaaggtactcaagcagctccaaggaagcaggttgcagcttcatcttaagtatcaggcatcgtagtactcttttgtttagcattatttcggtttcctgagttgtacgaaaaaatttaccggattttgagttattattgactataagattgtttttctgttctggagtttcagtttgatttctgaaatacttgatttgatccattgtatcgccattgttccgatgaattgggttcaccatag

SEQ ID NO: 2004 - DNA, 523 bp, Fagopyrum esculentum
gcgcagcctccgtagaacctaggttttcttcagcaaaaatgggtaagggaactggaagttttggtaagaggaggaacaagacgcacacgctttgtgtgcgttgtggtcgccggagtttccaccttcagaagagccgctgttctgcctgcgcctaccccgctgctcgcctgagaaagtataactggagtgtcaaagccatcaggagaaagacaaccggaacaggtcgtatgaggtatctccgcaatgttccaaggagattcaagaccaacttcagagaaggtacccaggctgccccaaggaagcaggttgcagcatcagcttaagttatagatgcaaacatgtttgtactcttttagcttattgattcagtttttggcctgaaagcaagttttggatactcgttttagtttgcaatgagagattttatcctgtttcatttagacatcagaaatgttttggttttaactgtgtttgaatttgcaatgacctattcatgatgaatatgtgcatattctcttaccca

SEQ ID NO: 2005 - DNA, 577 bp, Fagopyrum esculentum
cgacgatgggtaagggaacagggagttttggtaagaggaggaacaagacgcacaccctctgtgtgcgctgtggccgcaggagtttccatctccagaagagtcgctgttccgcttgcgcctatcctgccgcccgcttgaggaaatacaactggagtgtgaaagctatcaggagaaagaccaccggaactggacgtatgaggtatctccgcaacgttccaaggaggttcaagaccaacttcagagaaggtactcaagcagctccaaggaagcaggttgcagcttcatcttaagtatcagacgtcttagtactgttttgtttagcaccatttccgtttcctgagttgtatgaaagaagtttacgggatttcgagttattattgactataagattgttttacccatgctggagttcagtttgatttctgaaatgcttggtttgattcattgtgccgccagtcctccgattaattgttttcaccatgatcggagctgagccttttcgttcatttccacgatcctgatcgtgttccaatgaactgtcatatactcaatttgatacaaattatgccaagttcga

SEQ ID NO: 2006 - DNA, 624 bp, Mesembryanthemum crystallinum
gcctcgtgccgaattcggcacgagggtagacttagaggtttctgccatcgacgaaaaatgggtaaaggtacaggaagtttcggtaagaggaggaacaagacccacactctatgtgtgaggtgtggtcgtcgcagtttccatctccagaagagccgttgctctgcttgtgctttccccgccgctcgcgtcaggaagtataactggagtgtgaaagcaatcaggagaaagacaaccggaactggtcgcatgaagtaccttcgtaatgtcccaaggaggttcaagtctggtttcagagaaggtaccgaggcagccccaaggaagaaagcagcagcttcctcttaagctatagttatcggggttttgtttggtgggcagttgcctttgtgggtgttcctagtttctttcttgaatcgtagaaaaagccaattttgggttattgttggacaactgcgcaatttgtattagctatgacaatgagatgtttgctattctggaaagttttcaagttctagataattgatatcatactgaagtttaacgatgcttcgttctgcttcactgaatattgctataatcgagtatagtttttgatgactcgtgtggtaatgcaacccttcatgtcat

SEQ ID NO: 2007 - DNA, 553 bp, Carica papaya
agagtaggacagagcccccgacctcctagggtttctcttttcatctgcttcaatgggaaagggaacagggagtttcggtaagaggaggaacaagactcacactctctgcgtgaggtgtggccgccgcagtttccatctccagaaaagtcgttgcgctgcttgtggtttcccggctgcccgcaagaggaaatacaactggagtgtgaaggcaattcgaaggaaaactactggaactggtaggatgaggtatctccgacatgttcctcgcaggtttaagagtggcttcagagaaggcacccaagctaccccaaggaaagcagctgctgcatcaacttaagcagttgaaggttcatagtgggcataatttgtagttttaaattgagttctacatgtttaagacagcttttttccatgggaagttgttgtaggatttcattatgtttcatgcttcattggtttttagttctgcttaccaaatagttacttcaaattttgagcgacatggatgataactgttgtttgtcaattcattgtttccttgtgctttaacgag

SEQ ID NO: 2008 - DNA, 612 bp, Platanus occidentalis
tttttttcttcgacctgcaaaatgggaaaaggtacaggaagcttcggtaagaggaggaacaagacccacactctctgtgtgaggtgcggacgccggagctttcatcttcagaagagcagatgcgccgcctgtggttatccttcgagccggatccgtaaatacaactggagtgtgaaggcgattaggaggaagaccactggaactggtcggatgcggtacctgcgccacttacctcgcaggttcaagagtaacttcagagaaggtactcaagcagcaccgaggaataaaggagctgctgcggtctaaaggagcattttagagcgttactttggtattttattttagtttcagtaatcctgagttctggaaactagtttttgagctttgttttgtgagtgttcctactagaaaatatggatgaatgactattattgttttttatttcattttgatagaaattggattttaagaaccgaaattacttagtacttcacctttaccgtattacatgttacctgttgccaggagtctaccataatagttgagaaaaaattgggacctgcacatgtttttttctgacagttctaaatgtttctacttgtataacattga

SEQ ID NO: 2009 - DNA, 606 bp, Tamarix hispida
agtcagtgagcgaggaaggggaggtcaagactgtgtgctttccttcttccgctgcagcaatgggtaaaggaacagggagctttggtaagaggaggaacaagactcatacactctgtgtccgatgtggtcgtaggagttttcaccttcagaagagtcgatgttctgcttgtgcattcccagctgctcgcaagaggacatacaactggagtgtgaaggcaattagaaggaagacaactggaactggtcgtatgaggtacctccgtcatgttccccgtcgattcaagactaatttcagagaaggcactcaagctgcacctaggaagcaggctgccgcctcagcttgagatgatttagtggtttcattttggtactccaatacaggcttctttttcttattattggaagctttggatggaggctaagtattttaaaagatgatttgttatctgttattgcttttagtcttctctctttactatgtcttagttttgaaatttgaatgatatggtgattgctagcatcagttttcgtgttcatcttggtacgtgcttcttctgtttacatgctacattggcatatgctcttgatgtttatcaattatcatgg

SEQ ID NO: 2010 - DNA, 505 bp, Tamarix hispida
gggggtcaaccatatttctgtttcctcgaaagcttccgacagctagggttctgccttgacgccgaaatgggtaagggaacagggagctttggtaagagaagaaacaagactcacactctctgtgtgagatgtggccgccgcagctttcatctccagaagagtagatgctctgcgtgtgctttccccgccgcccgtaaaaggaaatataattggagtatcaaggcaatcagaagaaagacaacaggaactggtcgtatgaggtatcttcgccatgttcccaggaggttcaaaaccaacttcagagaaggtactgaagctgctccaaggaagcagactgcgtctgcatcttaagtcttgaagcgggaactttggcatttagtgatcgtattgtcgcttttaactaaatagttttttattgttgttgattccaaattttgctaatgagatctttgatattttgtggagtgttttaactgttgtccagttcaaatatgaaaatgcagga

SEQ ID NO: 2011 - DNA, 467 bp, Tamarix hispida
ggggactggtaatcgagtagaaaaaccctagagctctctttaagcaaagaaggcagccttcgtccaggtcctcgcgttagtgcgtctcctcctgctgcaacaatgggcaaaggaacagggagctttggtaagaggaggaacaagacccacacgctctgtgtccgttgtggtcgtcgaagctttcaccttcagaaaagtagatgttctgcttgtgcattccctgctgctcgcaagaggaaatataactggagcgtgaaggcgattagaagaaggactaccggaaccggtcgtatgaggtaccttcgtcatgttccccgtcgatttaagactaacttcagagaaggcactcaagctgcaccgaggaagcaggctgctgctactgcttgaggtgattttgtggttcactatgggactccaattagcctttttttaatgtattattggaagttttggattagattaagaaa

SEQ ID NO: 2012 - DNA, 544 bp, Nicotiana tabacum
gccgcaggtctcagtcgaaagagctgaggaagaggtcgttaggatctctgcaactacagtgtaatgggtaagggaacagggagttttggtaagaggaggaacaagactcacacactatgtgtgaggtgtgggcggcgcagctttcatcttcagaagagccgttgctctgcttgtgcttaccctgctgcccgtaaacggacatacaactggagtgtgaaggcaattcgcagaaagacaactggaactggccgcatgaggtatcttcgtaacgtccctcgcaggttcaagaccaattttagagaaggtactgaagcagctccaaggaagaaggcagcagtttctgcttgaagcctttgagacagtcacttgagagttgagaggctattagtggtagcttgattttgatagttcaagtgttagagcaagttaaattttggggaaccttctatcttaatgcccattgaaaagattgatgtgcttaaagttttcaaagtatgtattccaacttggcatttttataaagaagcattttatggacttcaaa

SEQ ID NO: 2013 - DNA, 513 bp, Phalaenopsis aphrodite
aaaggcacaggttctttcggtaagaggaggaacaagactcacacgctttgcgtgaggtgcggcagaaggagcttccacctccagaagagcacctgctcttcctgcggctatccggccgctcgcatccgcaagtacaattggagcatcaaagcaataaggcggaagacaactggcacagggaggatgaggtacctccgccatttaccacgaaggtttaaaagcaactttagagaaggaacccaagctacaccgaggaagagggctgctgctgctgcgcccagcgcattttaaacatttccaattgtgattttattactctgctttacagcaggtatctatgttttgttgtttttatgtgctctttaatttttcaatttacctatatgaccagaaacatcttagtgtaaacttttgagatatttggcgaaggattccagtattttagatttgctgttatttctaattcatcagtgtaattttgaatgaatgtttgcctttttaatgtgaagtgct

SEQ ID NO: 2014 - DNA, 726 bp, Cannabis sativa
atttgtttccaaccctagatattctaaaaccctcgcacttggctcttataaactcctctcagcgccgcttccttctatttagccaaactcgtcctcttcaccgcctagggtttcttcatttctctctgctacaatgggtaagggaactggaagtttcggtaagaggaggaacaagacccacactctctgtgtgaggtgtggtcgccgcagtttccatctccagaagagtcgatgctcggcttgtgcttacccagctgcccgcaagaggacttacaactggagtgtcaaggcgatccgtaggaagaccaccggcactggaaggatgaggtaccttcgtaacgttcctcgcagattcaagagcggtttcagagagggaactcaagcagcacccaggagcaagggagcagccgctgcaaccgcataaggtgcttatagaaggtcattttgatcagatttgagcaaacttgttatagctttacaaagctttttttttttcttttatgttgggcaagttttataagtacattgtttgttggagagtttaagacctatttcattagtagttatttgaatgtagttctaaattttggacaaggatggtaagactactgtcatttgctcaagtttcaatgaagttttgattcttattatattgtttagtatttatttttcttgggcggtttgatctctttcctctctacaattcaaccgtatatttttctaaaa

SEQ ID NO: 2015 - DNA, 608 bp, Elaeis guineensis
cgttttgattgccgacttaccgtctctcgtatataagccctcaacatcgattgccggaggcctgggctagggtttaatccgcagcggaccaggcaagatggggaagggaacgggaagcttcgggaagcggaggaacaagacccacaccctctgcgtccgctgcggccgccggagcttccacctccagaaaagccgatgtgctgcctgcggctacccctccgcccggatccgcaaatataactggagcgtgaaggctatccggaggaagacgaccgggactggtaggatgcggtacctccgccacgtccctcgccgcttcaagagcaacttccgtgaaggtactcaagcgactccgaggaagagggcagtggcctctgcatcttcttaatgcacgaaaaagagtgaaatattatttgcataattttgtgatttcctgtgatttagctgaatcttcgcgagtgctaaaattggctattgcttgggtttccttttaatgagaatgtggttttggattttctgattagagacttcctaaatgaaggtagtatgtgtttttttaattatatatgcatgcaattgagatgttatgacttaaaaaaaaaaaaaaa

SEQ ID NO: 2016 - DNA, 691 bp, Allium cepa
ggggatcgaaatcaaaagcagttggtaattccttcgatcaaaactcggccctcctctctcctcatataaattcgttcttctcaatttctagggttttgcctttttaatatcctctctcacctgccgccaattccaaaatgggcaagggaacaggaagtttcggaaagaggaggaacaagactcatactttatgcgttcgctgtggtcgtcgcagcttccatctccagaaaagccgttgcgcatcctgcggttttcctgccgcccgacttcgcaaatataactggagtgagaaagctatcaggagaaagacaactggcactggaaggatgaggtatcttcgtcatgtgtctcgcaggttcaagagtggtttcagagaaggaacccaagctgctcccaggaagaaggcagcagctgctgccacatcttaattttgcgtatccatggaccattttgcatgtgtgcaggacgtcaaacttgttgcacttatttatctgtatctgtcatgctgagctagtttgcaatgtcattattgttttcaagctacaactttgttattatgcattttgatgttattttttctatgatatgaactatattttcatcttttgccatcaaacttagctttcttctgaaattttgtacgctaaaagaatttgtttatttacgtgttctatttccatttatgattttt

SEQ ID NO: 2017 - DNA, 1610 bp, Ricinus communis
gttaagacttttactttctccgctcgatcagcaaatcgtgaagtagctgcggcgagataagaaatggggaaaggtacaggtagttttggtaagaggaggaataagacgcatacactttgcgtgcgatgcggccgccgtagctttcacctccagaagagccgctgcagtgcctgtgcttatcctgctagtcgcctcaggaaatataactggagtgtgaaggctatccgcagaaagaccacaggaaccgggcggatgaggtacctccgccacgtcccacgcaggttcaagactaatttccgagagggtactcaagcacctccaagaaacaagggtgctgctgcagccaccgcataagctttgcaagggcgatgccagactgttttgtttttatatttatcagtttgcaaactagaagttttggatcaatgtttaatttttactcgtcatatcttgagtattttaatcatggagagttataaacattttctttctattaagatttttgggtgcatattgtcattcatcttgcttacttggctttgcaattcagaattttgaatcttgtcaaatctgatgtaatgctggcgaatccaaattcccatcagacctgtccttgtaggtgcattttgttttgttgctgatattgataaattttttaatacataaggtcttggtggtctattcttattcgagttatcttagttgtaagccagcattttaaaagttttgacatttgtagtgctttcagaatcagaccgccttagtaacccagttagaagtgagacgttaatacacttaaaatagcagcaagcacaatactaaaacaagagcaaggaggcattcgattacaccagcaagagatttacattgtattctctaaagccacaaacaaaacttgcaaccagttcagcagctgcatcttcaatactcaagaaggatctagtaggtggaagttatgcaggctgccactcgaagttcaatttgttcaccatttcggttctgctttccagaatgggtgttcttccattttcttgacgcatctgttatgcctcgagcaagttaagacactgattagctttccaataaaaaacattatataccctttccatttttttcttttccaagataatggaattgaactagttgagttccaatgggaaaacgaaaacatgttctgccaatctcataagctcctggaaagttttggaccaacgattataattcctatatggtttccagattaagatttaagggactggcagaaactctaaaggcaaactcaatgagaaaagggtctgcgagtaagataatataacagggaaggtttcaaatataagatgtaccaggatatatagaataatcttgattctgcattatcttttatctcagtgtttgagccagtagttccgcagctgagccatgtgcagtagcatctcatcacggccttgattagtagtgctgctggtcataatccaagggggtgccgtcttgaagaagctccgtatcaactcttgaaaatcattcacgttctcatcaggtcttttccctccattctttttcttcttgcgcttgtcacatttggtgaagatcaaagtcatcggtatctgaaa

SEQ ID NO: 2018 - DNA, 448 bp, Flaveria ramosissima
ctcaatctgcagagatgggtaaaggaacagggagtttcggtaagaggaggaacaaaacgcacacgctgtgtgtgagatgcggcagacgcagctttcatctgcagaagagccgatgctctgcgtgtgcgtatcctgctgctcgcctcagaaaatataactggagtgaaaaggcaatcagaaggaagactacaggaactggtcgtatgcgttaccttcgtaatgttccccgcaggttcaagagcaacttcagggaaggtactcaagcaacaccaaggaccaaaggagctgctgctgccagcacttgaaaatgaaatacaattttgtttggttttgtgttggtactatttatttatatgcttttcagaaaacttatctgggatttttgtttgtttattttagcttgtttccaacattttatccagttatgagcactagaatgctatttatt

SEQ ID NO: 2019 - DNA, 340 bp, Flaveria ramosissima
tgcagagatgggtaaaggaacagggagcttcggtaagaggaggaacaaaacacacacgctgtgcgtaagatgcggcagacgcagctttcatctgcagaagagccgatgctctgcgtgtgcctatcctgccgctcgactcagaaaatataactggagtgaaaaggcaatcagaaggaagactacaggaactggtcgtatgcgttaccttcgcaatgttccccgcaggttcaagagcaactttagggaaggtactcaagcaacaccaaggaccaaaggagctgctgctgccagcacttgaaaatgaagtactaattttgtttggtttttgttggtactactt

SEQ ID NO: 2020 - DNA, 472 bp, Flaveria ramosissima
aatctgcagagatgggtaaaggaacagggagcttcggtaagaggaggaacaaaacacacacgctgtgcgtaagatgcggcagacgcagctttcatctgcagaagagccgatgctctgcgtgtgcctatcctgccgctcgactcagaaaatataactggagtgaaaaggcaatcagaaggaagactacaggaactggtcgtatgcgttaccttcgcaatgttccccgcaggttcaagagcaactttagggaaggtactcaagcaacaccaaggaccaaaggagctgctgctgccagcacttgaaaatgaagtactaattttgtttggttttttgtttggtactacttatttatatggttttcagaaaacttatctgggatttttgtttgtttacaatattttatccagttatgagcactggaatgatatttattgttgttctaatttttgttttgcatctttttcctcttgtt

SEQ ID NO: 2021 - DNA, 470 bp, Flaveria ramosissima
aatctgcagagatgggtaaaggaacagggagcttcggtaagaggaggaacaaaacacacacgctgtgcgtaagatgcggcagacgcagctttcatctgcagaagagccgatgctctgcgtgtgcctatcctgccgctcgactcagaaaatataactggagtgaaaaggcaatcagaaggaagactacaggaactggtcgtatgcgttaccttcgcaatgttccccgcaggttcaagagcaactttagggaaggtactcaagcaacaccaaggaccaaaggagctgctgctgccagcacttgaaaaatgaagtactaattttgtttgttttttattggtactacttatttatatggttttcagaaaacttatctgggtatttttgtttgtttacaatattttatccagttatgagcactggaatgatatttattgttgttcaatttttgtttgcatctttttccccttgtt

SEQ ID NO: 2022 - DNA, 705 bp, Linum usitatissimum
cattctaaaccgcacacctatccggcgcctagggtttattctcctgctgcgtctgctccaatgggtaagggaacagggagtttcggtaagagaaggaacaagactcacacgctttgcgtcaggtgcggccgccgcagcttccatctccagaagagtcgctgctccgcttgtgcttaccctgctgctcgtgtcagaaagtataactggagtgagaaggctatccgtaggaagacaactggtaccggaaggatgaggtacatgcgccatcttcctcgcaggttcaagagtggtttcagagaaggtacccaagcggcaccaaggaccaagggaactgctgctgcatccacttagaccgggtccttcttgatggtgcaaatgctttcttaactgctccgtctatgagttgtttgaggcattatggtttacaaggattgatgttgttcgcattttggcggtctttagtaagaactttagtctttctgatactgcaattgctttctttttcgaaagatagtccagacaatgtaattgtgatcaatttcatgaatcattagtatttgaagtttggtttatgtggcctttacatatctccaccatactctgcacagcagagagttgttcttgcagttttatatttgaactcatcagaagccttgttgcattttcaaataccattttttgaatcaacaacacaagttttggcag

SEQ ID NO: 2023 - DNA, 667 bp, Humulus lupulus
ccaaccctagacattctaaaaccctcgcactttggctcttataaactcctctcaacgccgcttccttctatttagccaaactcatcctcttcaccgcctagggtttctgcatttctctctgctacaatgggtaagggaactggaagtttcggtaagaggaggaacaagacccacactctctgtgtgaggtgtggccgtcgcagtttccatcttcagaagagtcgatgctcagcttgtgcttacccagctgcccgcaagaggacttacaactggagtgtcaaggcgatccgtaggaagaccactggcaccggaaggatgaggtacctgcgcaacgttcctcgcagattcaagagtggtttcagagaaggaactcaagcagcacccaggagcaagggagcagctgcagctaccgcataaggtgcttatagaaggtcattttgatccgatttgagcaaacttgttatagctttactaagctctttttatgtgttgggcaagttttattagtacattgtttgatgaggagttaaaagacctatttctttagtagttattttgattgtagttctaaattttggacaaggatggtaagacaactgtcatttgctcaagttttaatgaagtttttgattcttatgtttttagtttaaaaaaaaaaaaagaacta

SEQ ID NO: 2024 - DNA, 542 bp, Actinidia deliciosa
actagggtttcttcagctgcgataccaatggggaagggaacagggagcttcggtaagagaaggaacaagactcacaccctctgtgtgaggtgtggccgccgtagctttcatctccagaagagccgatgctccgcttgcgctttccccgccgcccgcaaaaggacttataactggagtgtgaaggcgattcgaaggaagacgactggaacaggtcgtatgaggtacctccgcaacgtgcctcgcagattcaagagtggttttagagaaggtacccaagcagcgccgaggaagattggatctgcagctgctgcttgaaatggtggaatgctttaagtgagccggattttggggtactgaattactagtttcatttggctttttcaagtgttggaacagagttaatttttgggaacattatttgaatattatattccaatttaatatttggctttcgattttgttcttctgatatgtagttgatttgagtttgtgatacagatggacgagtctattgctttgaatccccattgtcttcaggcttt

SEQ ID NO: 2025 - DNA, 550 bp, Solanum tuberosum
taattttctagacaagacattgtcgaagcttaaggaaaagctgcacaaatgggaaaaggaacaggaagtttcggtaagaggaggaacaagacacacacactgtgtgttagatgtggtcgtcgtagcttccacatccagaagagtcgttgttcagcttgtgcttaccctgctgctcgtctcagaaaatataactggagcgtcaaggcacttagaagaaagaccactggaactggtcgcatgaggtatctccgcaatgttccccgcaggtttaagactaacttcagagaaggaactgaagcagctccaaggaagaagggcactgctgcggccgcttaagtttctaaagaggcagtttgacgttgttttattttgattttgccttccatttcaccgatgaatcgaagttttgaatatttgtttctggaatattacctctcatttgttagattggagttattgctgtttaagatatatgtcgaaatggattggtttctgtgtttgatattagcctaatcatctaaaggctaatgatatactttttaaatgtggt

SEQ ID NO: 2026 - DNA, 554 bp, Solanum phureja
acttccttttcgtataattttctagacaagacattgtcgaagcttaaggaaaagctgcacaaatgggaaaaggaacaggaagtttcggtaagaggaggaacaagacacacacactgtgtgttagatgtggtcgtcgtagcttccacatccagaagagtcgttgttcagcttgtgcttaccctgctgctcgtctcagaaaatataactggagcgtcaaggcacttagaagaaagaccactggaactggtcgcatgaggtatctccgcaatgttccccgcaggtttaagactaacttcagagaaggaactgaagcagctccaaggaagaagggcactgctgcggccgcttaagtttctaaagaggcagtttgacgttgttttattatgattttgccttccatttcactgatgaatcgaagttttgaatatttgtttctggaatattacctctcatctgttagattgaagttattgttgtttaagatatatgtcgagtggattggtttctgcgtttgatattagcctaatcatctaaaggctaatgatatacttttt

SEQ ID NO: 2027 - DNA, 451 bp, Fagus grandifolia
ctggaccttggctgtcactctccccgaaaaacctccaaactaaactagggtttctctctgcaaccgaaaaaatgggcaagggaacagggagttttggaaagagaaggaacaagacccacacgctgtgtgtgcgatgcggtcgcagaagcttccatctccagaagagtcgctgctccgcctgtgcctatcccgctagccgcatcagaaaatataactggagtgtgaaggctatccgcagaaagaccactggaactggccgtatgaggtacctccgtaatgtgccacgcaggttcaagactaatttcagagaaggtactcaagcaactccaaggaacaagggaacagctgcagcctcttaaagttctgaagggttattctgttttgtttgatattattgaattcccagacaagttttggatcattgtttaaggagtagttacttattgttaca

SEQ ID NO: 2028 - DNA, 560 bp, Centaurea maculosa
atttagccattttcacgcttttcgatccggccagaaggcgacgtaatcagaagaattagagtttctggaaactcatagcaatggggaaaggaacaggaagttttggtaagagaaggaacaaaacacacacactgtgtgtacggtgcgggcgtcggagcttccatctccaaaaaagccgatgctctgcttgtgcttaccccgctgctcgcgtcagaaaatacaactggagcgagaaggcgatccgtaggaagacgaccggaactgggcgtatgaggtatctccgtcatctgcctcgcagattcaagagcaacttcagagaaggtactcaagctgctccaaggaagatcggtgcagcatcttcggcttaaattcgtgaaatcgtggtcattctttaacctagaattgggcaatttagaggataatcgaagttttgtgaaacatgatttgatgtggttcatcatctatcgatatcttcaattgtggttttctttctgtttagaaatttgtgatttttgatcatggattgaatgatatatacacagttgctctgttttttttaa

SEQ ID NO: 2029 - DNA, 545 bp, Centaurea maculosa
acgcttttcgatccggccagaaggcgacttaatcagaagaattagagtttctggaacctcatagcaatgggtaaaggaacaggaagttttggtaagagaaggaacaaaacacacacactgtgtgtacggtgcgggcgtcggagcttccatctccaaaaaagccgatgctctgcttgtgcttaccccgctgctcgcgtcagaaaatacaactggagcgagaaggcgatccgtaggaagacaacaggaactggacgtatgaggtatctccgtcacttgcctcgcagattcaagagtaacttcagagaaggtactcaagctgctccaaggaagatcggtgcagcatcttcagcctaaattcgtgaaaccgatggtcattatttaacctagaattgggcgattttgaggataatcgaagttttgtgaaacatgatttgatgtggttcatcatctatcgatatcttcaattgtggttttctttctgtttagaaatttgtgatttttgatcatggattgaatgatatatacagttgctctgttttttttaa

SEQ ID NO: 2030 - DNA, 548 bp, Centaurea maculosa
gcggggaggataagctagaagagctccgatttcgtcgacggcaagcaatggggaaaggtactggaagcttcggtaagagaaggaacaagacacacacactgtgtgtccggtgtggtcgtcggagcttccatctccagaagagccgatgctccgcctgtgcttatcctgctgctcgcgttaggaaatataactggagtgagaaggcgatccggaggaagacgactggaactggtcgcatgaggtatctccgtcatttgcctcgaagattcaagagcaatttcagagaaggtactcaagctgctcccaggaagatcggtgcatcagcttcgacttaaaacacttgaggaattacatccaaactaatatccggtatcaattaagcaagcatattttcatctagggcaatcagtgtaggtgaacattgtttcaagttttgtttggaatttttgttattctggtttatgaatcaagactcattttggtttaaaaaagaaaatcaagagatcatggctgagattaaccaaaaataccatatccaaactcccaat

SEQ ID NO: 2031 - DNA, 550 bp, Centaurea maculosa
atttagccgttttcgcgctcttcgacccggccaaggcgacgtaatcagaagattagggtttctgaaacctcatatcaatggggaaaggaacagggagttttggtaagagaaggaacaaaacacacacactgtgtgtgcggtgtgggcgtcgcagcttccatctccagaaaagccgatgctctgcttgtgcttaccctgctgctcgcctcagaaaatacaactggagcgagaaggcgatccgtaggaagacaaccggaactggacgtatgaggtatctccgtcatctgcctcgaagattcaagagcaacttcagagaaggtactcaagctgctccaaggaagatcggtgcagcatcttcagcttaaattcgtgaaatcatggtcattatttaacctagaatcgggcgatttagaggataatcgaagttttgtgaaacatgattttgatgtggttaatctattgatcttcaattgtggtttccttctgtttagaaatttgtgatttttgatcatggattgaatgatatatacagttgctctgttttttttaa

SEQ ID NO: 2032 - DNA, 450 bp, Centaurea maculosa
ggataagctcgaagaaccccgatttcgtcgacggcaagcaatggggaaaggtactggaagcttcggtaagaggaggaacaaaacacacacactgtgtgtccggtgtggtcgtcggagcttccatctccagaagagccgatgctccgcctgtgcttatcctgctgctcgcgtcaggaaatataactggagcgagaaggcgatcaggaggaagacgactggaactggtcgcatgaggtatctccgtcatttgcctcgcagattcaagagcaatttcagagaaggtactcaagctgctcccaggaagatcggtgcatcagcttcgacttaaaactgttgaggaattacatccgaactaatatccggtatcaattaagcaagcatacttttatctaaggcaatcagtgtaggtgaacattgtttcaagttttgtttggtaatttttgttattct

SEQ ID NO: 2033 - DNA, 616 bp, Gossypium hirsutum
ccttacttcaacaccatatcttagggtttctcctcctctctacctccaatgggaaagggaactgggagttttggtaaacgaaggaacaagacccacacgctctgcgtcagatgtggccgccgcagcttccacctccagaagagccgttgctctgcctgtgctttccccgctgcccgtaagaggacatataactggagtgtgaaggctatccgaagaaagacaactggcactggtaggatgaggtatcttcgccacgttccacgcaggttcaagacgggtttcagggaaggtactgaagcagcaccaaggaagaaggttgcagcagcttttgcttaaaaggcaaattgtaatggtatgaggttttgttttggatgaagccatgtttatgaggaaacatttagtgatgaagagtgaaattatgttccattggatgctttagttatttagtttctatttgaatgtagctgtcttaaattttgaacaattattggagctaatgtttgacccttaatttcttcattgtctctgttttttttaacttgatcaatgtacttgtatcgtctaagatgccttaaatcaatggatcagaaacgggttcatgatttccttttagata

SEQ ID NO: 2034 - DNA, 654 bp, Gossypium hirsutum
gccgctctctttcttcttcagagccacttagggtttttcctgcgccagctccaatgggaaagggaacagggagttttggtaaaagaaggaacaagacccacactctctgcgttagatgtggccgccgtagcttccatctccagaagagccgttgctctgcctgtgctttccctgctgctcgtaagaggacatataactggagtgtgaaggcaatcagaagaaagaccactggaaccggtaggatgaggtatctgcgccatgtccctcgcaggttcaagactggtttcagagaaggtactgaagcagcaccgaggaagaaggttgcagcagcttctgcttgaggtattacgaggttgttttggatgaagcatctttttttaggaaaacttttacgagaacattactctcgaggggtgtcattacattgaatgctttagctgtttttagtttatgattatggagttgcactaaattttgaacaaggatgaatgatttagttttcctctagtttatttttgaggagttgcttcaaattttgaacgaggatggacaaggctattgttggtttacacttagttacttgatacaatttttttggatgaagttaacgtatgttcttgtttttggttataaatgatgccctaatcttgtttc

SEQ ID NO: 2035 - DNA, 597 bp, Gossypium hirsutum
acagttctagggttcttgttagcagctgcgacagaagaaatgggaaaaggaactggaagctttggaaagcgaaggaataagacccacacactttgcgttcgatgtggacgccgtagcttccatctccagaagagccgttgcggtgcttgtggctaccctgccagccgcatccgaaaatataactggagtgtgaaggctattagaagaaagacgactgggacaggccgcatgaggtacctccgtcatgtgccccgaaggttcaaaactgaatttagagaaggcactcaagcaactccaaggaagaaggcagctgttgctgcatcttaagttggttttggtgttttgtttttgagatttctgaatttacacaaactagaagcttttatgatttttatcatcattttgtacttttattatttcaacctaatatccatgaacagatagttgtgttttaccatgaatcttcacgacattttgatttctcacatttttctcttgtgagatagtgtcatagtggtatgtcatccatgatgttaaaattttggtttttgcacattttgtgtgagaacgaaccccatctaaaagtgtcttgtttac

SEQ ID NO: 2036 - DNA, 1074 bp, Gossypium raimondii
aattttagaaacagtgttggttcgtgaattctcttttgtaaaataggatatacggaaaaaataaaaccctaatgtcacctccatacaaaattgatccatcttctcttaaaaaaaatcgagccgtccaaaggctgccacgtctcaaccctgaaaaaatttaaatgaaaagaaaaaaacccaaggttgttagtttgttgaatcttggtttagtcgcccaaatataacaacccaatctcttctccgccgctctctttcttccttcaacaccatatcttagggtttctcctcctctctacctccaatgggaaagggaactgggagttttggtaaacgaaggaacaagacccacacgctctgcgtcagatgtggccgccgcagcttccacctccagaagagccgttgctctgcctgtgctttccccgctgcccgtaagaggacatataactggagtgtgaaggctatccgaagaaagacaaccggaacaggtaggatgaggtatcttcgccatgttcctcgcaggttcaagacgggtttcagggaaggtactgaagcagcaccaaggaagaaggttgcagcagcttctgcttaaaaggcaaattgtaatggtatgaggttttgttttggatgaagccatgtttatgaggaaacatttagtgatgaagagtgaaattatgttccattggatgctttagttgttatttagtttctatttgaatgtagctgtcttaaattttgaacaattattggagctaatgtttgacccttaatttcttcattgtctttttttttttaacttgatcaatgttcttgtttcgtttaagatgcccttaaatcaatggatcagaaacgggttcatgatttccttttagatataaggtaatgcaggttcggatttttaatcctttttctcatttatttttctaaatttgtataataatattctgatttgaatattatagttattgtctgcgacagatacaaatctttctttgaatttgtttactttttatgcaaataatctattaaaaatgtataacttattaaattcaaatattttattatgcaaatatttag

SEQ ID NO: 2037 - DNA, 766 bp, Gossypium raimondii
gcttccaactggtattgttagaaacctccgccgctctctttcttcttcagagccacttagggtttttcctgcgtcagctccaatgggaaagggaacagggagttttggtaaaagaaggaacaagacccacactctctgcgttagatgtggccgccgtagcttccatctccagaagagccgttgctctgcctgtgctttccctgctgctcgtaagaggacatataactggagtgtgaaggcaatcagaagaaagaccactggaaccggtaggatgaggtatctgcgccatgtccctcgcaggttcaagactggtttcagagaaggtactgaagcagcaccgaggaagaaggttgcagcagcttctgcttgaggtattacgaggttgttttggatgaagcattctttttttaggaaaacttttacgagaacattactctcgaggggtgtcattacattgaatgctttagctgtttttagtttatgattatggagttgcactaaattttgaacaaggatgaatgatttagttttcctctagtttatttttgaggagttgcttcaaattttgaacgaggatggacaaggctattgttggtttacacttagttacttgatacaattttttgggatgaagttaatgtatgttcttgtttttggttataaatgatgccctaatcttgtttcaagatagtttaaaatttaaagtcatttgtgtttcgcttattattatcaacactacttctagtcgaatattgtgttcggagaa

SEQ ID NO: 2038 - DNA, 724 bp, Gossypium raimondii
cttggttgtcgaaaatgagcaaaaccctaatttatttcatctctatataaataccttaacctacatttggtcaaaacttttctggtgtttttgcagctcgaagaacaaaagaaaatgggaaaaggaactggaagctttggaaagagaaggaacaagactcacacgctctgcgttcgatgtggtcgccgaagcttccatctacagaagagccgttgcggtgcttgtggctaccctgccagtcgcatccgaaaatataactggagtgtgaaggctattagaagaaagaccaccgggactggccgcatgaggtacctccgacgtgttccccgaaggttcaagactggctttagagaaggtactcaagcaactccaaggaagaagggagctgttgctgcttcatgagttaatttgtgatgttttcgttttgttcagagagattcctgaatttagaaacgataggtttttgggtctctttcaactgtgtgttacttttttatttttcacctaatgtctacaaacgggaagttttgttttatattatgaagtttcacgactttatgtagagcaatttacttctatccctttgtgttgtatgaaatagtgatatgcaaaccatgggtgatcttatacttgctcaacactgaggatagcgttcagccccatctacatgtcatgttttctattttctgcggttgaaatgttattccccaaagggtctattatc

SEQ ID NO: 2039 - DNA, 596 bp, Catharanthus roseus
actagtggatccaaagaattcggcacgaggctcttcttcaccaaaggaaaggcacgagggtttttgcaactcggcggaatgggtaagggaacagggagtttcggtaaaaggaggaacaagacccacacactatgtgttaggtgtgggcgtcgcagctttcatcttcagaagagccgctgctctgcttgtgcttaccctgctgcccggaagaggacatataactggagtgtgaaggcaattaggagaaagactaccggcactggacggatgaagtatctccgccacgtgccccgcagattcaagaccaacttcagagaaggtacccaagctgctccaaggaagaaggtagctgctgcatctgcttgagagagttgattctggagggtattgatgattgtagtctgcttggttatttagtattccttagttttcgaacagctgaattttttgcatcttaagggttttgtgcccattcaatcactgagtatggttaaattttgaatatgtactatttcatttggatctttaatacgaatgaatgagtggctattgctggttgaaaaaaaacctcgtgccgaatctttggatccactagt

SEQ ID NO: 2040 - DNA, 578 bp, Plantago ovata
cggccgggggatctccataaacactagactagagctctagggtttcagtagcgccatgggtaagggaacaggaagctttggtaagagaaggaacaagacgcacacactctgcgtcaggtgcggccgcagaagcttccacctccagaagagccgatgctccgcttgcgcctatcctgctgctcgcaagaggacctataactggagtgtgaaggcgatcagaagaaagacaacaggaactgggcgcatgaggtatctgcgcaatgttcccaggaggttcaagactggtttcagagaaggtactgaagctgcaccaaggaagaagtctgcagctgcatctgcataagaggcggcctatcaggaggctaatctaaattgtacttttgttattccttgaagttcactagagaccagttcaattttgagagatacttggtgattgcttttttattatatttctagctgtacttcaaatggcatttatttacattgatgaacaccccctgtttcctttcgcctttcctttacaagctttactaggctatggtgattgttctgttttaattgaatgcatttgagtt

SEQ ID NO: 2041 - DNA, 521 bp, Picea glauca
acgaaggcggtgaagagcggaggagtcggtgcgcgctgcaacaatgggcaagggaacaggaagttttggtaagaggagaaataagacccacactctttgtatccggtgtggtcgccgcagttttcatatccagaagagtagatgttcggcatgcgcctacccatcaaagcgcatccgtaaatacaactggagtgtcaaagccattcggagaaagactactggaacaggacgaatgagatacctgcgtcacatgcctcgtcgcttcaagaataatttcagggaggggactcaggcaacccccaagaagaaggctgctgctaccacattttaaatgctttaagaatggccctgaaatattttgtattgttttaaccttgtttgtgagctggcacgacttgcattattttcatatgctgtcaatgacagctttattttctttcacaactcatggttttgaagtaaactcttttccatacttttgattgatgttgtaccggatggcaaattactaatagtcattt

SEQ ID NO: 2042 - DNA, 627 bp, Picea glauca
gcggtgaagagcggaggagtcggtgcgcgctgcaacaatgggcaagggaacaggaagttttggtaagaggagaaataagacccacactctttgtatccggtgtggtcgccgcagttttcatatccagaagagtagatgttcggcatgcgcctacccatcaaagcgcatccgtaaatacaactggagtgtcaaagccattcggagaaagactactggaacaggacgaatgagatacctgcgtcacatgcctcgtcgcttcaagaataatttcagggaggggactcaggcaacccccaagaagaaggctgctgctaccacattttaaatgctttaagaatggccctgaaatattttgtagagtttttaaccttgtttgtgagctggcacgacttgcattattttcatatgctgtcattgacagctttattttctttcacaactcatggttttgaagtaaactcgtttccatacttttgattgatgttgtaccggatggcaaattactaatagtcattttgagaatttaagttaaaaaaaaaaaaaaaaaaagtaaaacgtaacttactagtacgttagtaactacctatacgttcttacgtaggaacgtactacgaaccgaaggtacca

SEQ ID NO: 2043 - DNA, 890 bp, Amorphophallus konjac
aaactagggtttcagccagggccgccgtagcgagatggggaagggcacggggagcttcgggaagcggaggaacaagacccacaccctctgcgtccggtgcggccgccgcagcttccacctccagaagagcaggtgcggcgcctgcggctacccctccagccggatccgaaaatataactggagcgtgaaggcgatccggaggaagaccaccgggacgggaaggatgaggtacctccgccatgttccccgccgcttcaagaccggctttcgcgaaggtactcaggccgctccaaggaagcagtccacagccagcgcgtgatgagtaggctaagcatactgtggtatttactgtcattttttgcttcattaatgcgatttctgggactgtatagtactatcatgatggtaatttgaacaaggatgatgtgattttctactctatggatttataacttcgtagttattttgttgccgttgatggtttacctgctctatggtatatagatcgctgaacctgcatagaataaaacaatgaaatgctacgagcggatttgggtttcgaatggaaatatgatcaggtctatcttttgtttattttttgtttaagataatcagtatttggttgtattttaagaagatttgtccacataagccgtcccccccaacttggttgaagattacaaataattggttggtgttcgctttacaagttggagggatgatggtatgttcattcacttgagtaccattacaagcatggctgagattatcctctgtactagtcaacacaatgacttgattccactgtacagactgttaggtatagtataggctttcttgtagtttggtggtactgtctgttgggtctccacgtatggtgctggtctgta

SEQ ID NO: 2044 - DNA, 469 bp, Persea americana
agctttggaaagaggaggaacaagacccacaccctctgcatccggtgcggacgccgtagcttccatctgcagaagagcagatgcgccgcttgcggttaccctgctgccaggatccgcaaatataactggagtgtgaaggcaattcgaaggaagacgacgggtactggaaggatgaggtaccttcgccacctgcctcgcaggttcaagagcaatttcagagaaggtactgaagctgctccaaggaagaaggcagctgctgcgtcattttaaatgcgtaagagagccatttagggcattatttgctactctgtttacttaaattctgttggggtttagaagtgacttggagttttggacttgttgatgaatttgatttgctggaaaatcaaatttagttaaatgggattactaattgttttagcttgtattggattttcagttgcctgagttgctttgtgttcttaaacgt

SEQ ID NO: 2045 - DNA, 428 bp, Ocimum basilicum
aacagccgagttcacgagatcgccaaattctagggtttctccacagcaatgggtaagggaactgggagctttgggaagaggaggaacaagacgcacacactgtgtgtgaggtgcggccgccgcagcttccaccttcagaagagccgctgctccgcctgtgcttacccagccgctcgcaagaggacatacaactggagtgtgaaagctatccgtagaaagacaaccggaactggacgcatgaggtatctccgtaatgtggcccgcagattcaagaccaacttcagagaaggtactgaagcagcaccaaggaagaaggcagctgttgcctctgcttgagagggcaatctgaagttttgatttcaaatttgttggtgtttatcagttgttattttgatacacagatggatcagagaccagttcatttcttt

SEQ ID NO: 2046 - DNA, 1149 bp, Theobroma cacao
cccggcgtgttggtcctaaagcaaaggtgaagaaaaaccctaatttccttcatcactatataaatatcgtaacctcttcttcgtcaaaacttttcccgaagcccctcgcagttctagggtttttgcagcagcatcaacagaagaaatgggaaaaggaactggaagctttggaaagagaaggaacaagactcacactctctgcgttcgatgtggacgccgaagcttccatctccagaagagccgttgcggtgcttgtggctaccctgctagccgcatccggaaatataattggagtgtgaaggctattagaagaaagaccaccgggactggccgcatgagatacctccgtcatgtgccccggaggttcaagactggcttcagagaaggtactcaagcaactcccaggaagaaggcagctgttgctgcctcataagttcgttgtggggcaatgctagtgcattttgttttgagatttacaaaccagaagttttctgttattatcagttgtgtgttatttttggttttctgagtaatccctgcaaacattaaattttgtttcattatgaatttaaacaatttaattttgattactgagtataatttgcacacttgtgcaatgtgtgatggtataatttatgtcatttccatcgtactctttaacacatctcgtttttttcccattgcccatttatgacatcagagggctttggattttgtattttcctttttggccaatggtagactcaagcgtcactctctttgaagaagcatcacaactctctgggttttgattctttcttttggatttggccaatggctgactcaagcagcagggtgatctcttgcctgataaatgactatcgctagtacagcccaaactcatctctccaattcagcccaaatgcagctcaagttcaacaacatatgttattgcttggcatcttgagctgagtagatttcaatagttaattatctaaaccttgatagctttggggcctttgattgcgttcctacaaatgtgtatggcataaaacgtccataacttgtatggcataaaacgtccataacttatattaaacaccttcagttgcgagataaattgttgctaatgtacatataaaaaaggtttaaaaaaaatccactatattg

SEQ ID NO: 2047 - DNA, 522 bp, Catharanthus roseus
ccaaaggaaaggaactagggtttctgcaactcggcggaatggggaagggaacagggagtttcggtaaaaggaggaacaagacccacacactatgtgttaggtgtgggcgtcgcagctttcatcttcagaagagccgctgctctgcttgtgcttaccctgctgcccggaagaggacatataactggagtgtgaaggcaattaggagaaagactaccggcactggacggatgaagtatctccgccacgtgccccgcagattcaagaccaacttcagagaaggtacccaagctgctccaaggaagaaggtagctgctgcatctacttgagagagttgattctggagggtattgatgattgtagtctgcttggttatttagtattccttagttttcgaacagctgaattttttgcattttaagggttttgtgcccattcaatcactgagtatggttaaattttgaatatgtactatttcatttggatctttaatacgaatgaatgagtggctattgctggttgaaa

SEQ ID NO: 2048 - DNA, 611 bp, Centaurea maculosa
cgggatcatcgacgacgatcagagtatttagccattttcacgcttttcgatccggccagaaggcgacttaatcagaagaattagagtttctggaacctcatagcaatggggaaaggaacaggaagttttggtaagagaaggaacaaaacacacacactgtgtgtacggtgcgggcgtcggagcttccatctccaaaaaagccgatgctctgcttgtgcttaccccgctgctcgcgtcagaaaatacaactggagtgagaaggcgatccgtaggaagacgaccggaactgggcgtatgaggtatctccgtcatctgcctcgcagattcaagagcaacttcagagaaggtactcaagctgctccaaggaagatcggtgcagcatcttcggcttaaattcgtgaaatcgtggtcattctttaacctagaattgggcaatttagaggataatcgaagttttgtgaaacatgatttgatgtggttcatcatctatcgatatcttcaattgtggttttctttctgtttagaaatttgtgatttttgatcatggattgaatgatatatacacagttgctctgttttttttaatcaagctgttcatatggttaccatag

SEQ ID NO: 2049 - DNA, 827 bp, Cephalotaxus harringtonia
attgtagggcgcctcctacagctaatagcaccgtaataatacactgtccgtaggccgcgtcacccttgtcagtaattaatgtttgaaaagtggaaccaaacaaaatcctttagggttttatgcaagagttgtccatatttagggtttgagaggggcaatatattaatttgttgattcaggaaggcgaagtgttgggtcgcatagagcagagaaggaacaacagaaacaatgggaaagggaacaggaagttttggtaagaggaggaacaagacgcacaccctttgtgtgcgctgtggccgccgcagttttcacattcagaagagtcgatgttctgcttgtgcataccctgctgcacgtattcgcaaatataactggagtgtgaaagcgattcggagaaagactacagggactggaagaatgagataccttcgtcacatgccccgtcgtttcaaaaataatttcagggagggtactcaagcaacccccaggaagaaggctgctgccacctcattttaaaattgttaggaatggatatgctgagttgttttggaactgtttttccgactttttcattgatatggtgataatatttatttttggaaaagttaacaaagctattttgagccctgagtagatggtttctaggtatattaataatttgtaatgctatttgattttgattttttttgttaagtttatttagattaccaaatatttatagcttattgactgctaatgaacctgcatgttttgaagaaatatgcttttgagcaatattgccgattcattttttcctttcatataatgattaacaaaatgttttcaag

SEQ ID NO: 2050 - DNA, 600 bp, Cirsium arvense
cgaacgacggacggccggacgtagtactacgacgacgagacgtacggcgggggccaggataagctcgaagaactccgatttcgtcgacggcaagcaatggggaaaggtactggaagcttcggtaagagaaggaacaagacacacacactgtgtgtccggtgtggtcgtcggagcttccatctccagaagagccgatgctccgcctgtgcttatcctgctgctcgcgtcaggaaatataactggagcgagaaggcgatccggaggaagacgaccggaaccggtcgcatgaggtatctccgtcatttgcctcgcagattcaagagcaatttcagagaaggtactcaagctgctcccaggaagataggtgcatctgcttcgacttaaaactctgaggaattacatccaatcaaatatccggtatcaatttttagggcaattagtgtaggtgaacattgttttgtgctattaatctggtaatctgatttaagttttgtttggaaattttgttattctgatttatgaacatgactcgttttgatttatttttttgtgatcttaaacattttgatgctcaatttggatcttggagatgatcttttt

SEQ ID NO: 2051 - DNA, 624 bp, Citrus sinensis
cttctcgtctccgccgctcgctcttcactcatcagaaggctttcctctacttcgcatacgcttcaatgggtaagggcacagggagttttggtaagaggagaaacaagacgcacactttgtgtgtgcgatgtggccgtcgcagcttccatcttcagaagagtcgttgcgctgcttgtgcttaccccgctgctcgcaagagaacgtataactggagtgtgaaggcaatccgaagaaagaccactggaaccggcaggatgaggtatctgcgccatgtccctcgcaggttcaagagcggcttcagagaaggtactcaggcagcaccaaggaagaagggagcagctgcctctgcttaaggagttgaagggtaattttgggcgtgaatcagcacctcattatagatttagtcttctttaatgtgtggagacaagattcatgggaacataattttgaaaaaggatgttatttgtttttgtgcttagttgttttcaattatgattactatgtagtctttttcaattttggacaagatgaatgagtttattgttgtttgacctcccttaattacttcatgttttgacataattttttgagtcaaaaaagggccgcggtacccaaatttcgccc

SEQ ID NO: 2052 - DNA, 759 bp, Citrus clementina
gccaaccctagaaaaaaccctcctttttaacgcaacaaagccacaatataaagcttctcgtctccgccgctcgctcttcactcatcagaaggctttcctctacttcgcatacgcttcaatgggtaagggcacagggagttttggtaagaggagaaacaagacgcacactttgtgtgtgcgatgtggccgtcgcagcttccatcttcagaagagtcgttgcgctgcttgtgcttaccccgctgctcgcaagagaacgtataactggagtgtgaaggcaatccgaagaaagaccactggaaccggcaggatgaggtatctgcgccatgtccctcgcaggttcaagagcggcttcagagaaggtactcaggcagcaccaaggaagaagggagcagctgcctctgcttaaggagttgaagggtaattttgggcgtgaatcagcacctcattatagatttagtcttctttaatgtgtggagacaagattcatgggaacataattttgaaaaaggatgttatttgtttttgtgcttagttgttttcaattatgattactatgtagtctttttcaattttggacaagatgaatgagtttattgttgtttgacctcccttaattacttcatgttttgacataattttttgagtcttgtggtttctgtgattcatcataagcatagggcaactataagtactgatgatcaactgaatcacaaatgcgaggaacttggacgtagtttattagtactgatttctcaacca

SEQ ID NO: 2053 - DNA, 631 bp, Coffea canephora
cggccggggggcttcttcttgatcgtcagaaccagagcatcctcctagggtttttggcatctcatcaccagccatgggtaagggaacagggagttttggtaaaagaagaaacaagacccacacgctctgcgtgaggtgtggccgccgcagcttccatctccagaagagccgctgtgctgcttgtgcctaccctgctgctcgcaagagaacttataactggagtgtgaaggcaatcaggagaaagactaccggaaccggacgcatgaggtatctccgccacgtcccccgccgattcaagaccaacttcagagaaggtactcaagcagctccaaggaagaaggtagcagctgcatctgcttgagaggctttggttttgaagagggatactctttttaattgtagttgctgttttgttcttcattaaagtagtatcggaacatattaaaatttttgagagcagcatttcaggggacttgtgcccttctgattgttgagcattgttactttccgttaaatgtactattttggttggatctttgatacgaatgaatgcgtcatgagtggctatggctagctggagtcccaattcttgtgtgccatttttctatgggaatgtgcatgcataatttgt

SEQ ID NO: 2054 - DNA, 535 bp, Gossypium hirsutum
gggaaagggaactgggagttttggtaaacgaaggaacaagacccacactctttgcgtgagatgcggccgccgtagcttccatctccagaagagccgttgctctgcctgtgctttccctgctgcccgtaagaggaaatataactggagtgttaaggcaatccgaagaaagaccactggaactggtaggatgaggtatcttcgccatgttcctcgtaggttcaagactggtttcagagaaggtactgaagcagcaccgaggaagaaggttgcagcagcttcggcttaagttggctatgaggttgttttgatgaatccatctattttagtaaaagttttatgggaacattacatgagaaatgtcatttattacattggatgcttttaaatatttgtagtttctattttcatgtagctgcttaggctattgttgcttgacacttaattactggatatttttgtggatgaagttaatcatgtgcttgtttcggttatgatgcccttcatcttgtttcaaattatagtcttctttattcga

SEQ ID NO: 2055 - DNA, 893 bp, Gossypium hirsutum
gccatactactttcttcctccgccgctccctttcttgttcagagcccaaagaatcaactcttggggttctcctgcgtcagctccaatgggaaagggaactgggagttttggtaaacgaaggaacaagacccacactctttgcgtgagatgcggccgccgtagcttccatctccagaagagccgttgctctgcctgtgctttccctgctgcccgtaagaggaaatataactggagtgttaaggcaatccgaagaaagaccactggaactggtaggatgaggtatcttcgccatgttcctcgtaggttcaagactggtttcagagaaggtagtgaagcagcaccgaggaagaaggttgcagcagcttcggcttaagttggctatgaggttgttttgatgaatccatctattttagtaaaagttttatgggaacattacatgagaaatgtcaattattacattggatgcttttaaatatttgtggtttctattttcatgtagctgcttaggctattgttgcttgacacttaattactggatatttttgtggatgaagttaatcatgtgcttgtttcggttatgatgcccttcatcttgtttcaaattatagtcttctttattcgagtattgttgtttgaagtattttctacatcttgtgagttacattctagaaaagtataatctttgctttcaattcttggacgcaaagaatgttttaaaaagcattggaactaaaaaatggagtctgcataataagttattgttgttatgctgaatttatcaacaatgcttgtttgttctcatcataagtaccagttgcttctattgcatgctatggggcgttcttgagtattacaaagatgagagattgtaacaggtttttttcttccttttg

SEQ ID NO: 2056 - DNA, 760 bp, Gossypium hirsutum
cccgcacagttctagggtttttgttagcagctgcgacagaagaaatgggaaaaggaactggaagctttggaaagcgaaggaataagacccacacactttgcgttcgatgtggacgccgtagcttccatctccagaagagccgttgcggtgcttgtggctaccctgccagccgcatccgaaaatataactggagtgtgaaggctattagaagaaagacgactgggacaggccgcatgaggtacctccgtcatgtgccccgaaggttcaaaactgaatttagagaaggcactcaagcaactccaaggaagaaggcagctgttgctgcatcttaagttggttttggtgttttgtttttgagatttctgaatttacacaaactagaagtttttatgatttttatcatcattttgtacttttattatttcaacctaatatccatgaacagatagttgtgttttaccatgaatcttcacgacattttgatgtctcacatttttctcttgtgagatagtgtcatagtggcatgtcatccatgatgttaaaattttggtttttgcacattttgtgtgagaacgaaccccatctaaaatgtcttgtttactatatgctgcatttgagacaattcgcaagagactttatagtgttgttggaattagatggaccaattaaatagagaatcggttagtatatcagtccagataagaggtttgagcaaagtgtttggaatcgattgactcgagaaataaaaaagtgattgaat

SEQ ID NO: 2057 - DNA, 811 bp, Gossypium hirsutum
cctatcccctgtgtgccttgcctatctcctgttgcgtgtctcagctcaatccccgcacagttctagggtttttgttagcagctccgacagaagaaatgggaaaaggaactggaagctttggaaagcgaaggaataagacccacacactttgcgttcgatgtgggcgccgtagcttccatctccagaagagccgttgcagtgcttgtggctaccctgccagccgcatccgaaaatataactggagtgtgaaggctattagaagaaagacgactgggacaggccgcatgaggtacctccgtcatctgccccgaaggttcaaaactggttttagagaaggcactcaagcaactccaaggaagaaggcagctgttgctgcatcttaagttggttttggtgttttgtttttgagatttctgaatttacacaaactaagtttttgtgatttttatcatcattttgtacttttattattacaacctaatgtccatgaacagaaagttgtgttttaccatgaatcttcacaacattttgatgtctcacttttttctcttgtgagatagtgtcatagtggcatgtcatccatgatgttaaaattttggtttttgcacattttgtgtgagaacgaaccccatctaaaatgtcttgtttactatatgctgcatttgagacaattcgcaagagactttatagtgttgttggaattagatggaccaattaaatagagaatcggttagtatatcagtccagataagaggtttgagcaaagtgtttggaatcgattgactcgagaaataaaaaagtgattgaattg

SEQ ID NO: 2058 - DNA, 567 bp, Gossypium hirsutum
gtttttgcagctcgaagaacaaagaaaatgggaaaaggaactggaagctttggaaagagaaggaacaagactcacacgctgtgcgttcgatgtggtcgccgaagcttccatctacagaagagccgttgcggtgcttgtggctaccctgccagtcgcatccgaaaatataactggagcatgaaggctattagaagaaagaccaccgggactggccgcatgaggtacctccgacatgttccccgaaggttcaagactggctttagagaaggtactcaagcaactccaaggaagaagggagcagttgctgcttcgtaagttaatttgtgatgttttcgttttgttcagagagattcctgaatttagaaacgataggtttttgggtttctttcaactgtgttactttcttatttttcaccaaatgtctacaaacgggaagttttgttttatattatgagctttcacgactttattttcattatgcataacaatttactctatccctttgcgttgtatgaaatagtgatatgcaacccatgggtgatcttatacttgctcaacactgaggat

SEQ ID NO: 2059 - DNA, 582 bp, Vigna unguiculata
attctctcaggcaactgggtttgtgctctgcggctacaatcaatggggaagggaacagggagtttcggtaagaggaggaacaagacccacaccctctgtgtcagatgtggccgtcgcagtttccacctccagaaaagtcgctgtgctgcgtgtgctttcccagcagcgcgcactagaaaatataactggagcgtcaaggccattaggagaaagaccactggaacgggaagaatgaggtatctgcgtcacgtgcctcgcagattcaagagcggcttcagagagggtaccgaagctgcacccaggaagagaggagcggctaccactgcctaagctgtcgaaggtagcaatttttctggatccatgaattaggagtttaggcttctgtgttgtgcgaaaccctgttaaacaatttttctttctgtctttttgaccttatttcatataaatggatttgtatttcaacttgagtatggtaaggagttttgaattgatagttttttttacgtctatactttaattttcaattcagacttaatttttggatttgttattgggaatgaattatttaatgttaattatgcc

SEQ ID NO: 2060 - DNA, 620 bp, Vigna unguiculata
agcaattaggtttcatataaattctctcaggcaactgggtttgtgctctgcggctacaatcaatggggaagggaacagggagtttcggtaagaggaggaacaagacccacaccctctgtgtcagatgtggccgtcgcagtttccacctccagaaaagtcgctgtgctgcgtgtgctttcccagcagcgcgcactagaaaatataactggagcgtcaaggccattaggagaaagaccactggaacgggaagaatgaggtatctgcgtcacgtgcctcgcagattcaagagcggcttcagagagggtaccgaagctgcacccaggaagagaggagcggctaccactgcctaagctgtcgaaggtagcaatttttctggatccatgaattaggagtttaggcttctgtgttgtgcgaaaccctgttaaacaatttttctttctgtctttttgaccttatttcatataaatggatttgtatttcaacttgagtatggtaaggagttttgaattgatagttttttttacgtctatactttaattttcaattcagacttaatttttggatttgttattgggaatgaattatttaatgttaattatgctgataagatagtttgcatt

SEQ ID NO: 2061 - DNA, 561 bp, Vigna unguiculata
gggggtttctgctctgctgctacaatggggaagggaacagggagtttcggtaaaaggaggaacaagacccacaccctttgtgtcagatgcggccgtcgcagcttccacctccagaagagtcgctgtgctgcgtgtgctttcccagcagcgcgcactagaaaatataactggagcgtgaaggctattaggagaaagaccactggaactggaagaatgagatacctgcgtcacgtgcctcgcagattcaagagcggcttcagagagggtaccgaggctgcacccaggaagagaggagcggctaccactgcctaagctttcgaaggtagcattttttctggatcattgaattgtaggagttaaggcttctgtgttgtgcggaaccctgtggaacattttttctttctgtcgatttgatctcatttgatatatatggattttgtatttccacctgaggatgataaggaattttgatttgatagttttttacgtctaaattttagttttcaactcaggccttatttttggtgttgtggttgttggcagtgaattataattaactag

SEQ ID NO: 2062 - DNA, 557 bp, Vigna unguiculata
caatggggaagggaacagggagtttcggtaaaaggaggaacaagacccacaccctttgtgtcagatgcggccgtcgcagcttccacctccagaagagtcgctgtgctgcgtgtgctttcccagcagcgcgcactagaaaatataactggagcgtgaaggctattaggagaaagaccactggaactggaagaatgagatacctgcgtcacgtgcctcgcagattcaagagcggcttcagagagggtaccgaggctgcacccaggaagagaggagcggctaccactgcctaagctttcgaaggtagcattttttctggatcattgaattgtaggagttaaggcttctgtgttgtgcggaaccctgtggaacattttttctttctgtcgatttgatctcatttgatatatatggattttgtatttccacctgaggatgataaggaattttgatttgatagttttttacgtttaaattttagttttcaactcaggccttatttttggtgttgtggttgttggcagtgaattataattaactagtttatgttacttacgcta

SEQ ID NO: 2063 - DNA, 589 bp, Vigna unguiculata
ggataaagagatcctccaattagggtttctgatttgctgtttcaatggggaagggaacagggagtttcggcaagaggaggaacaagacccacacgctctgtgtgaggtgtggccgtcgcagctttcaccttcagaagagtcggtgtgctgcgtgtgccttccccgctgcgcgcaccagaaagtacaactggagcgttaaggccattaggagaaagactaccggaaccggaaggatgaggtacctgcgtcacgtgcctcgcagattcaagagcggctttagagagggtaccgaggcagcaccaaggaagaggggggcggcttccactacctgagctttgaaaggaagcaatttttctgggttagtgaaattataggagttgagcgttttgtgctatttttaaagaacattttttgtttctgtcatctcaatttcatttaatatgtaatggatttttgttttatttttattccggcacttgatggatttgatagccctgtgttcacttaatcaatattgataacactttgagagataaccccttaagaaatttcatgaatttaattttaattttgtaaaaaaaaaaaaaaa

SEQ ID NO: 2064 - DNA, 575 bp, Vigna unguiculata
ggataaagagatcctccaattagggtttctgatttgctgtttcaatggggaagggaacagggagtttcggcaagaggaggaacaagacccacacgctctgtgtgaggtgtggccgtcgcagctttcaccttcagaagagtcggtgtgctgcgtgtgccttccccgctgcgcgcaccagaaagtacaactggagcgttaaggccattaggagaaagactaccggaaccggaaggatgaggtacctgcgtcacgtgcctcgcagattcaagagcggctttagagagggtaccgaggcagcaccaaggaagaggggggcggcttccactacctgagctttgaaaggaagcaatttttctgggttagtgaaattataggagttgagcgttttgtgctatttttaaagaacattttttgtttctgtcatctcaatttcatttaatatgtaatggatttttgttttatttttattccggcacttgatggatttgatagccctgtgttcacttaatcaatattgataacactttgagagataaccccttaagaaatttcatgaatttaattttaattttgta

SEQ ID NO: 2065 - DNA, 710 bp, Vigna unguiculata
cggacgcgtgggttcgcaacaattaggtttctgctctgctgctacaatcaatggggaagggaacagggagtttcggtaagaggaggaacaagacccacaccctctgtgtcagatgcggccgtcgcagcttccacctccagaagagtcgttgtgctgcgtgtgctttcccagcagcgcgcactagaaaatataactggagtgtgaaggccattaggagaaagaccactggaaccggaagaatgaggtacctgcgtcacgtgcctcgccgattcaagagcggcttcagagagggtaccgaggctgcacccaggaagagaggagcggctaccactgtctaagctttggaaggtagcaattttatttttctggatcattcaattgttggagttaatccttaccttgtggaacaatttttctttctgtcgttttgatctcatttgatatatatggatttgtatttcaacttgaggatggtatggagttttggtttgatagtgtttttacgtctattttttagttttcaactaaggccttatttttggtgttttgtggttgttggcaatgaattagaatttactagtttatggtaattgtgctaatatggtagtttggattgtggccttggcttatattttgctacattaggagaatttgagattagaatatgtcactatttgatgatttatcaaaaggttattggtttgtgatta

SEQ ID NO: 2066 - DNA, 776 bp, Cryptomeria japonica
  misc_feature (2)..(2): n is a, c, g, or t
  misc_feature (42)..(42): n is a, c, g, or t
  misc_feature (109)..(109): n is a, c, g, or t
  misc_feature (558)..(558): n is a, c, g, or t
  misc_feature (562)..(562): n is a, c, g, or t
gngggttttactcatttggcctctatgatttggtgaatctanctttaagagtttttagtctcttagggttttagtctctttggaccacggcggaggtgcaaagcgggangagcaggagcaatgggaaagggaacaggaagcttcggaaagaggaggaacaagacccacactctttgcgtgcgctgtggccgccgcagttttcacatccaaaagagtcgatgttctgcctgtgcataccctgctgcacgcattcgcaaatataactggagtgtgaaagctattcgaagaaagactacagggactggacgaatgagatatcttcgacacatgccccgacgtttcaagaataattttagggagggaactcaagcagtccccagaaagaaggttgctgctgcttcattctaaatttgtttagaatggaagtactgggatgtagatttgaatttattatgtactggatggtttttctagttattgtagaaagcctagattccagttaaaagcttgctttatgaatggaaatgcttttacaatttttttggctagtactatagnaaanactgtatggaaaagttaaaacaaagttttttcaagcattgaaatagactgcatgtatgcagtaataatttctaatgctgtttgaaattgagatttttatttctcgagttttagatcatcgaattttgtagcttttagcaacagctagtaaacctgcatgttttgaaagacgtttgagcaatattgtcagcacattttattttctatttttcctg

SEQ ID NO: 2067 - DNA, 593 bp, Cucumis sativus
atagccaaactgcatatagaattcttccgccctagggtttcttcgtcctgcatcaatgggaaagggtacgggcagttttggtaagaggaggaacaagacccatactctctgtgtgcggtgtggccgccgcagcttccatctccagaagagtcgttgtgcagcatgtgcttttcctgctgctcgcaagcgcaaatataactggagtgtgaaggcaattagaagaaagacaaccggaactggaaggatgaggtacttgcgccatgttccgcgtagattcaagagcggcttcagagagggtacggaagctgcacccaggaataaaggagctgcagcatcagcataaggttttggaagaagttcaatttaatttcagtacccacctatagttttcagtaggggttttactcatctgagaatcatttcatataattttgttttttctagtttttgacttttcatgatttagttgaacgatcgctgtttctttaaaatgtattgtttgaattttggacaaatgatgaatcagattgttcgtattctgctacttgcttcttcattcttcagtatgctctattacccaacgcccattcgtt

SEQ ID NO: 2068 - DNA, 539 bp, Cucurbita pepo
acggaagaagaatccgaaggcttcatcgtcgaatccgactaaatgggtaagggaacgggaagtttcggtaagaggaggaacaagacccacactctctgtgttaggtgtggccgccgcagcttccacctgcagaagagtcgatgctctgcctgtgcatttccagccgcccgtaagcgttcatataactggagcgtaaaggcgatccgaaggaagaccactggaactgggcggatgagatacatgcgtcatgttcctcgcagattcaagagtggtttcagagaaggtactcaagcagcaccaaggagcaaaggagcagccgcatcagcctaagacattaaaggttacttgtggcacaacttggtaccatatttatagcttctaggagaagtttgtcatttttgggaccagagtctataagaattttgttttgtgatgttaacaccttcaatactgaaacttattttatttcttactgtattgtttatggaatttttattgttgttttgtagaccactttcacctttggttaatctatgtct

SEQ ID NO: 2069 - DNA, 828 bp, Cycas rumphii
gacaagttccaaattcgaatcaacggctgaggagtcgtctgacgtatgaggtagggtttgacaacatagggctagaaacgtcgaagtctgctcttcttgctcggttccaggggaggcccgagagaacacacaatgggtaagggaacaggaagttttgggaagaggagaaacaaaacccataccttgtgcgtcaggtgtgggaggcgaagtttccacatccagaagagcaggtgctctgcttgtgcatatccagctaaacgaattcgtaaatataactggagtgtaaaagctatccggagaaagacgactggaactggacggatgagatatcttcgtcatatgcctcgtcgtttcaagaacaatttcagagaggggactcaggcaacccccaggaagaaggcagctgctgcctcattttaaatatattgaagcagtggattagacgcgttaactcgagatgttgacacttagcaatctggcacgttacgtttaagtgtctagaatattaatgcattacgctcttggattatcatggtttggaccaggttattctttttttttgaggaatcaaaggttttccagtttcgagcaattgcattacggtagaaagttttgcaaaacatttatgaaattttatttcgaggaactatattttcgctggtcagctggaaactttgcatagttgccatatagcacaatgcctctagtcttttaaatttagattgaatgtatatcgaattatacaggctggcatattttttattgggtcagctttcaaactctttacttgaatcgaaatgctagtcacatttgcctgtcaggattgac

SEQ ID NO: 2070 - DNA, 652 bp, Eucalyptus grandis
aaaacctccttcgcccgccgctcttcgccagacagattagggtttctccttcctcctcctcctcgtcggcgccatgggtaagggaacggggagcttcggtaagcgaaggaacaagacgcacacgctgtgcgtgaggtgcgggcggcgcagcttccacctccagaagagccgctgcggtgcctgcggcttcccctccgcccgcaagaggaagtataactggagtgtgaaggcaatccgaaggaagaccacaggaactggtaggatgaggtatctccgcaatgttcctcgcaggttcaagagtggtttcagagaaggtactgaagctgcaccaaggaagcatgcaggagcagctactgcttaattattgtgatcattttggggcaaaatcatgttattttgaaggatttagtcattcatatctgggcgcaggaaactttttggcttatatagttgcccctttaatttgctttgtttttgtttcatctactgtggcattgtttacaattttgaatgagcagagattaagcctactgtttttctagaactcaatttaatgtttcttcagttaggttcttattatcatattcatcttcctgtgcaaatgaataggatatcgaaatcaaaatactagtgtgacagtttaacccatgtt

SEQ ID NO: 2071 - DNA, 521 bp, Fraxinus spp
gccgctgaaactagggttttgcaacttcgcagccatggggaagggaacagggagctttggtaagaggagaaacaagacacacacgctgtgtgtgaggtgcggccgccggagcttccacatccagaagagccgctgctctgcctgtgcctatcctgctgcccgcaagaggacatacaactggagtgtgaaggccataaggagaaagacaactggaactggacgcatgaggtacctccgccacgtgccacgcagattcaagaccaacttcagagaaggcactcaagctgcacccaggaagaagggagcagctgcttctgcttgaggtcttccaggactcagatttggaggttactgtttattgtactttttattggtattttaaagcattgagagaacaattgaattttgtagaacatcatttgaagcgtttttgtcttttggatccttaattgactttaattttgttttgatacttgagcttgcattttaatattgacagacgggggctgaaattagttgtt

SEQ ID NO: 2072 - DNA, 569 bp, Heritiera littoralis
ggtccgccgctcttttgttcttctgagccgaaagcaccgcatcttagggtttctcctgcgtcagctccaatgggaaagggaacagggagttttggtaaaagaagaaacaagacccacactctctgcgtgagatgtggccgccgtagcttccatctccagaagagccgttgcgctgcctgtggcttccctgctgcgcgtaagaggacatataactggagcgtgaaggcaatcagaagaaagaccactggaaccggaaggatgaggtatctccgccatgtccctcgcaggttcaagagtggtttcagagaaggtactcaagcagcgccaaggaaaaaggttgcagcagcttctgcttaaggcgttatgaggttggttggatgaagctgtctttgttaggaaaaatttcatgggaacatatcttaaggattgtatgtttacattggatgcattagttgtttttagtttctatttttatttagttgctttaaattttgaacaagaatggatgaggctatcgatgtttgccttgaagtctttttaattgaagttaatcatgttcttgtttaaag

SEQ ID NO: 2073 - DNA, 573 bp, Actinidia deliciosa
  misc_feature (327)..(327): n is a, c, g, or t
actagggtttctgcatctgcgcagcaatgggtaaaggaacagggagcttcggtaagaggaggaacaagacccacactctctgtgtgcggtgtggccgtcgcagttttcatctccagaagagccgatgctcggcgtgtgctttccctgctgcccgcaaaaggacttataactggagtgtgaaggcgatccgaaggaagacgactggtacaggtcgaatgaggtacctccgcaacgtacctcgcagattcaagagcggcttcagagaagggaccgaagcagctccgaggaagaagggagcagcagctcctgcttgaggctatgcaggcntgtattgggcctcgacatggggtacactccattgtagtttgatttcgtgttttccattgttggaaaagagtcaattttgggaacctcgtttggaggcgggttactccaatttcaatttcaacctttgcacttttaatatgtactagttgatttgagtttttgatacgaatgatcagactattgctttgaattcccggtacccggtattaatgtgatgttgtgatttgtgttgtcaaaaaaaaaaaa

SEQ ID NO: 2074 - DNA, 506 bp, Lactuca sativa
ctacattacagccgcctcacccccttcacgtggtcgaaggatcagtgtatctagcaccttgtaacaatgggaaaaggaacagggagttttggtaaaagaaggaacaaaacacacactctatgtgtacgctgtgggcgtcgcagcttccatctccaaaagagccgatgctctgcttgtgcttaccctgctgctcgcgtcaggaaatataactggagtgtgaaggcgattcgtaggaagacaaccggaaccggacgtatgaggtatctccgtaatctgcctcgccgattcaagagcaacttcagagaaggcactcaagctgctccgaggaagattggtgctgcatcctcatcgtaaatttcaaatttagttcgtgatcaagttttgtgaaacctcattaagatgtgcttaatatattgactttcagttgtaatttttcaaatctgtttagaaatttgtgtctttaatcatgattttaatgatatacatacactcgctttgttttcgag

SEQ ID NO: 2075 - DNA, 617 bp, Medicago truncatula
ctctgattagggtttgccacctgcttcttcttcgtctacatacaacaatgggtaagggaacaggtagtttcggtaagagaaggaacaagacccacacactctgtgttaggtgtggccgtcgtagtttccatctccagaagagtcgctgctcagcatgtgcttatccagctgcacgtgtaaggaaatataactggagtgagaaggctattaggagaaagaccactggaactggtaggatgaggtacttgaggaatgtgcctcgcagattcaagagtggattcagagaaggtactgaagctgcacccaggaacaagggagcagctgcttctacctaagtcttcggaacgttgcttttttctgggctaattaatgataggagttaagatttttgtttaggggcatggatctttcaaacaatattctatctgttgttttcatttcccttctttcaatatgaatttaattatgttacaatgtcaggattgcaagacattttttttgttaaatgagaatttgagttggatatttccgattatttgttccttgtttccttcgagtattttttgtttataacacgttaattagtgaattgagttggccagtttattgtttggttg

SEQ ID NO: 2076 - DNA, 760 bp, Medicago truncatula
ctctgattagggtttgccacctgcttcttcttcgtctacatacaacaatgggtaagggaacaggtagtttcggtaagagaaggaacaagacccacacactctgtgttaggtgtggccgtcgtagtttccatctccagaagagtcgctgctcagcatgtgcttatccagctgcacgtgtaaggaaatataactggagtgagaaggctattaggagaaagaccactggaactggtaggatgaggtacttgaggaatgtgcctcgcagattcaagagtggattcagagaaggtactgaagctgcacccaggaacaagggagcagctgcttctacctaagtcttcggaacgttgcttttttctgggctaattaatgataggagttaagatttttgtttaggggcatggatctttcaaacaatattctatctgttgttttcatttcccttctttcaatatgaatttaattatgttacaatgtcaggattgcaagacattttttttgttaaatgagaatttgagttggatatttccgattatttgttccttgtttccttcgagtattttttgtttataacacgttaattagtgaattgagttggccagtttattgtttggttgagggtaaacctggtttgcacaacatttaggttattgtattgtgtatatcttgtttattgctatctgttgataacaacagaggtatatgcatgttaaatagagcaacaatattctatgaaagtcaccttgttggtggtgtcaag

SEQ ID NO: 2077 - DNA, 600 bp, Cucumis melo
atagccaaactgcagagagaattcttcctccctagggtttcttcgtcctgcatcaatgggaaagggtacgggcagtttcggtaagaggaggaacaagacccatactctctgtgtacggtgcggccgccgcagcttccatcttcagaagagtcgttgtgcagcatgtgcttttccggctgctcgcaagcgcaaatataactggagtgtgaaggcaattagaagaaagacaactggaactggaaggatgaggtacttgcgccatgttccgcgtagattcaagagcggcttcagagagggtactgaagctgcacccaggaataaaggagctgcagcatcagcgtaaggttttggaagaaagttcaatttaatttcagtacccacctatagttttcagtaggggttttactcatctgagaatcatttcatataattttgtttttctagtttttggctttttatgatttagttgaacgatcgctgtttctttaaaatgtactgtttctttaaaatgtattgtttgaattttggacaaacgacgaatcagattgttcgtattctgctacttgcttctgcattttccagtaaaaaaaaaaaaaaaaa

SEQ ID NO: 2078 - DNA, 558 bp, Momordica charantia
ggacggaagaagaatccgagcgcttcatcgtcgaattcgattaaatgggtaagggaacgggaagtttcggtaagaggaggaacaagacccacactctctgtgtgagatgtggccgccggagctttcacctgcagaagagtcgatgctccgcctgtgcattccctgccgcccgtaagcgtaaatataactggagcgtgaaggcgatccgtaggaagaccactggaactgggcggatgaggtacatgcgccatgttcctcgcagatttaagagtggtttcagagaaggcactcaagcagcaccaaggggcaaaggagcagcaacatcagcttaaaacgttgaaggttgattgtggcacaacttggtaccttatcatagtttttaggaggattatgtcatttttggacggttatctatatgaattttgtttgatgatgttattgccttcaatactgaagctcactttaattccttactattttgtttatggaatttcttatgattggattgatagcattttcactatttttttttaatctatgtcttgtttggggtctaag

SEQ ID NO: 2079 - DNA, 526 bp, Nicotiana benthamiana
  misc_feature (11)..(11): n is a, c, g, or t
  misc_feature (40)..(40): n is a, c, g, or t
  misc_feature (50)..(50): n is a, c, g, or t
  misc_feature (52)..(52): n is a, c, g, or t
  misc_feature (88)..(88): n is a, c, g, or t
  misc_feature (277)..(277): n is a, c, g, or t
  misc_feature (334)..(334): n is a, c, g, or t
  misc_feature (352)..(352): n is a, c, g, or t
  misc_feature (392)..(392): n is a, c, g, or t
gcacgaggganaagcctccaccgccgtatattattagggntcttccgccncngccgcagaaatgggaaaaggaacggggagttttggnaagaggaggaacaagacacacacactatgtgtgaggtgtgggcgtcgcagctttcacatccagaagagccgctgctccgcttgtgcctaccctgctgctcgcctcagaaaatataactggagcgtcaaggcacttagaagaaagaccactggaactggtcgcatgaggtatctccgcaatgtgccccgnaggttcaagactaacttcagagaaggcaccgaggcaactccaaggaagaagggtgcngctgtagcctcttaagtntctgaactctatttcaatctgaatattttccttagctttnggatatttgttttgagtattaacacacatttgttggtacggagctatttctattcgtcttatagttgtaatagtgattctcttttgttttatatattgagatagttattttgtgttttaaaaaaaaaaacaact

SEQ ID NO: 2080 - DNA, 597 bp, Nicotiana benthamiana
gcacgagggaggacgctagggtttctgcaactgcactgcaatgggaaagggaacaggtagtttcggtaagaggaggaacaagactcacacgctatgtgtgaggtgcggtcgccgcagtttccatctccagaagagccgttgttctgcttgtgcttatcctgctgcccgtttaaggaaatataactggagtgagaaggcactccgcaggaagacaactggtactggccgcatgaggtaccttcgcaatgttccccgcagattcaagaccggtttcagagaagggactgaagcagcaccaaggaagaaggcggcagcagcttctacttgaggtcctttgagagggttattgagggtactttttataacgttagcatcattttggtattcaagtattagagagcaaggaaattttgggaagcttattgcccattcaaagttacaagtgcttaaattttggaaatttgttgttgaaattggcattttgagactaatggatttttgtaggctgttttctacttttggttgctctgaacattctccatttgcttatgttccttgaatttgagaattgaggtcttttgagctcttaattttcca

SEQ ID NO: 2081 - DNA, 717 bp, Citrus sinensis
acaatataaagcttctcgtctccgccgctcgctcttcactcatcagaaggctttcctctacttcgcatacgcttcaatgggtaagggcacagggagttttggtaagaggagaaacaagacgcacactttgtgtgtgcgatgtggccgtcgcagcttccatcttcagaagagtcgttgcgctgcttgtgcttaccccgctgctcgcaagagaacgtataactggagtgtgaaggcaatccgaagaaagaccactggaaccggcaggatgaggtatctgcgccatgtacctcgcaggttcaagagcggcttcagagaaggtactcaggcagcaccaaggaagaagggagcagctgcctctgcttaaggagttgaagggtaattttgggcgtgaatcagcacctcattatagatttagtcttctttaatgtgtggagacaagattcatgggaacataattttgaaaaaggatgttatttgtttttgtgcttagttgttttcaattatgattactatgtagtctttttcaattttggacaagatgaatgagtttattgttgtttgacctcccttaattacttcatgttttgacataattttttgagtcttgtggtttctgtgatccatcattagcatagggcaactataagtactgatgatcaactgaatcacaaatgcgaggaacttggatgtagtttattagtactgatttctcaacca

SEQ ID NO: 2082 - DNA, 643 bp, Orobanche aegyptiaca
ctcccttctcttcaaccgcagagctcaacaaggacaaaattatctcgagggtttctgcaacttcacatcaatgggtaaaggaaccggaagctttggtaagaggagaaacaaaacacacactctgtgtgtgaggtgtggccgccgcagcttccacctccagaagagccgttgctccgcctgtgcttacccggcggctcgtaagaggacatacaactggagtgtgaaggccattcgtcgaaagacaactgggactggacgtatgaggtatctccgccatgtacccaggagattcaagaccaacttcagagaaggtactcaagctgcaccaaggaagaaggcaactgctggctctgcttaagggactaatttggatggtactattgcttgtacttttctttgccatcttattcgagaacaatttaaatatgagaacccttcttcttgtgagctacttcattagtggttaattttgttgggtgttattcgatatcattttgatacagattgatgaaagacgatttatttactttgtcgtgcatttatccgggtgtcgatcttttaccctccaatttatgcaacttcaaatgattaagtggctctgagatcgcagcaaatgcgagttttttgaaaatataaattgatt

SEQ ID NO: 2083 - DNA, 398 bp, Orobanche aegyptiaca
ggtacgctagggtttctgcaacttcactgcaatggggaagggaacaggtagtttcggtaagaggaggaacaagactcacacactatgtgtgaggtgcggtcgccgcagtttccatctccagaagagtcgttgctctgcttgtgcttatcctgctgcccgtttaaggaaatacaactggagcgagaaggcactccgcagaaagacaactggtactggccgcatgaggtacctccgcaatgttcctcgcagattcaagaccggtttcagagaagggactgaagcagcaccaaggaagaaggcggcagcagcttctacttgaggtcctttgagagggttattgaggagggtactttttataacgttagcatcattttggtattcaagtattagagagcaag

SEQ ID NO: 2084 - DNA, 465 bp, Pisum sativum
gggtaagggaactggaagttttggtaagaggaggaacaagacccacacactctgtgtgaggtgcggccgccgcagtttccaccttcagaaaagctgctgctcggcgtgtgcttaccctgctgctcgcgtcaggaaatataactggagtgttaaggcaatccgcagaaagaccactggaactggtaggatgaggtacttgcgcaatgtgcctcgccgatccaagagtggctttagagagggaactgaagctgcaccaaggaagaagggagctgtcactgcttaagcttttttgagagttgttgttttgttgggtacggagtttatagaattagtttgttttttgtgattggggcgagtatttttgaactaccatgtttacagcctcagtgtttcagtttaattttcttctatatattctgtactttcttgatttttcaatatgattatagaactatttcattgttc

SEQ ID NO: 2085 - DNA, 650 bp, Lippia dulcis
tataaaaccgcttaaaacgccgctcattttcccttgaacctcagagctcaggaaaggaggagaaatctagggtttctcaaaatccgctgcaatgggaaagggaactggaagctttggtaagaggagaaacaagacacacacgctgtgtgtgaggtgtggccgccgcagcttccacctccagaagagccgctgctccgcctgcgcgtaccctgctgcccgcaagaggacatacaactggagtgtgaaggccatccgtagaaagacaactggaacaggtcgcatgaggtatctccgcaatgtgccccgccgattcaagaccaacttcagagaaggtactcaagctgcaccaaggaagaaggcagctgctgtgtctgcttgaggggtctgatttggagggtacttgtctttgtatttctttctttgccgtcttgaaagaattagagaacaatgaattttgatgatgtcatttgaacagccttttccttttccagctacttagtagtattaatttttctggtgctatttgattgcttttaaatacggatggggtgcaagaccaccatttgcttcgttgtgcactgtcttgtggtatcaatttcttttaaattatttccatattgttcgaattgattccccttctactaggccat

SEQ ID NO: 2086 - DNA, 538 bp, Lippia dulcis
tactataatagtatatcgctactctttctcttcaacgccgacctcagcacacgcacaatctaggctttttgcagcagcgctacagcaatggggaagggaaccgggagtttcggaaagaggaggaacaagacacacacactctgtgtgaggtgcggtcgtcgcagcttccatttgcagaagagccgctgctccgcctgcgcttatcccgccgctcgcaagaggacatacaactggagtgtgaaggccatccgtagaaagaccactggaactggtcgcatgaggtacctccgcaatgtcccccgcagattcaagaccaatttcagagaaggtaccgaggctgcagcaaggaagaaggctgcagctgtctctgcttaaggtcaagggtgcatttagtcctgcttatctttgtttcagtcttagaggacagttcaatttttgggattgccatttctacagcgttctcatcaagttgttacagtttgttggtttttctcgctactattttgattcatttggatcgaagaccagttcgctataa

SEQ ID NO: 2087 - DNA, 631 bp, Cajanus cajan
acatagctccttctctgcagcattagggtttttcatctgcttcaatggggaagggaacagggagtttcggtaagagaaggaacaagactcacactctctgtgtgaggtgcggccgccgtagcttccacctccagaagagtcgctgcgctgcctgcgctttccccgctgcgcgcaagagaaaatataactggagcgtcaaggcaatccgcagaaagaccaccggaactgggaggatgaggtacttgcgtaacgtgcctcgccgattcaagagtggcttcagagaaggtactgaagctgcaccaaggaagaagggagcagctgccactgcttaaacctttgaatgattgttgtttgctgggtacggaattacaggattagattatttttgtggttttggcaattatctttgaacacttattatagcagcctcattgctactttttctctcatttaatttgtagttgctttatatttcaacaagatcattacaagacttattgattgttcagttgttctgtatgacacttatagtttatggtttaagctgttttcgattggtgaatattgaatattgaatcgttataaaccactccccctaccatacaatactaccgcaagcattcatcatagt

SEQ ID NO: 2088 - DNA, 786 bp, Cajanus cajan
aaacccatttacttcgaactcagggcaacagatataaatattaatctccacgccgtttcttcttcttcagccacatagctccttctctgcagcattagggtttttcatctgcttcaatggggaagggaacagggagtttcggtaagagaaggaacaagactcacactctctgtgtgaggtgcggccgccgtagcttccacctccagaagagtcgctgcgctgcctgcgctttccccgctgcgcgcaagagaaaatataactggagcgtcaaggcaatccgcagaaagaccaccggaactgggaggatgaggtacttgcgtaacgtgcctcgccgattcaagagtggcttcagagaaggtactgaagctgcaccaaggaagaagggagcagctgccactgcttaaacctttgaatgattgttgtttgctgggtacggaattacaggattagattatttttgtggttttggcaattatctttgaacacttattatagcagcctcattgctactttttctctcatttaatttgtagttgctttatatttcaacaagatcattacaagacttattgattgttcagttgttctgtatgacacttatagtttatggtttaagctgttttcgattggtgaatattgaatattgaattgttataaaccactccccctaccatacaatactaccgcaagcattcatcatgaattttgccatggtgataacgagagagagagccttatttgttgagggaaggtagtttaggtaacctggtttgactagtcagtcta

SEQ ID NO: 2089 - DNA, 553 bp, Plantago ovata
ctccataaacactagactagagctctagggtttcagtagcgccatgggtaagggaacaggaagctttggtaagagaaggaacaagacgcacacactctgcgtcaggtgcggccgcagaagcttccacctccagaagagccgatgctccgcttgcgcctatcctgctgctcgcaagaggacctataactggagtgtgaaggcgatcagaagaaagacaacaggaactgggcgcatgaggtatctgcgcaatgttcccaggaggttcaagactggtttcagagaaggtactgaagctgcaccaaggaagaagtctgcagctgcatctgcataagaggcggcctatcaggaggctaatctaaattgtacttttgttattccttgaagttcactagagaccagttcaattttgagagatacttggtgattgcttttttattatatttctagctgtacttcaaatggcatttatttacattgatgaacaccccctgtttcctttcgcctttcctttacaagctttactaggctatggtgattgttctgttttaattga

SEQ ID NO: 2090 - DNA, 546 bp, Solanum tuberosum
gctgaggaagacgctagggttcctgcaactgcacagcaatgggtaagggaacaggaagctttggtaagaggaggaacaagacccacacactgtgtgtgaggtgcggtcgccgcagtttccatctccagaagagccgatgttctgcttgtgcttatcctgctgctaggaagagatcatacaactggagtgtgaaggcaatccgcagaaagacaactggtacaggccgcatgaggtacctccgcaacgtccctcgcagattcaagaccaatttcagagaagggactgaagcagctccaaggaagaagggaacagcagcttctgcttgaagagagagtaattgaggagtgtacttttttaatggtagcttcattttgaaagtattttcaagtattagagggcaaagaaatttgggaaggcttatttttgttgttgatgtccagtctaaattagaagtacttaaatttttgaaatgtgttgctgaaattgacattctgatacagagttttgattttatttataagctgctttctatttttgttgctgaaa

SEQ ID NO: 2091 - DNA, 629 bp, Sciadopitys verticillata
taagcttacagggttcctacttgagtaaaaggaaagcggcggcgtggaggaggaggtttctgggcggcgtagcagcaatgggtaaaggaactggaagctttggtaagaggaggaacaagacccacacattgtgtgtcaggtgtggaagaagaagtttccacattcagaaaagcagatgttctgcttgtgcatatccatctgcacgtattcgaaaatataactggagtgtaaaggctatccgaaggaagactactggtactgggcgaatgagatatcttcgacatatgcctcgtcgtttcaagaacaatttcagagaaggcacgcaggctacacccaggaagaaggctgctgctgcttcgttttaattgtattgaagcaacagcccttggatgttaagatattgtggttcttagcaatctggccgtaatgtaatttgcaatgcactcttgaattactgtggcttatgccacttaatttgttttccttagtataccaattttatacttaattttacccggtgcgaggatgtttgacaaaattttgtaatgtatttgagatgactggtggaattaaacacatctgttccttttggaatctgaaattacgtatctataaatttagtaatctaa

SEQ ID NO: 2092 - DNA, 684 bp, Sequoia sempervirens
cttaagacaagttatagatgctagggagggttttttactcctctgcggacgacggcggaggctcagagaagcggagagagcaggagctacaccatccagaagagcaatgggcaagggaacaggaagttttggcaagaggagaaacaagacgcacactctttgtgtgcgctgcggccgtcgcagttttcacatccaaaagagtcgatgttctgcctgtgcataccctgctgcgcgcattcgcaaatataactggagtgtgaaagctattcgaaggaagactactggcactggacgaatgagatatcttcgtcacatgccccgacgcttcaagaataatttcagggaggggactcaagcaatccccaggaagaaggctgctgccacttcattctaaatttgtttggaatgaatgtgctgggatgtagtgtcgaattcattatgtactagaccttatgattgtttttcttgttattgtagaaagcctggtttccagttaaaaacgcgcttttggaaggaaatgctttcccaaaattttaaacaaaatagagaggcaggcttgtatgcagtaataaattttagtactgtttgagtttgagattttcatttcttgagttttagatggtcaaattttgtagcttttagcaacagctagtaaacttgcattttttgaagaagacttataag

SEQ ID NO: 2093 - DNA, 546 bp, Solanum phureja
atctgaggaagacgctagggtttctgcaactgcacagcaatgggtaagggaacaggaagctttggtaagaggaggaacaagacccacacactgtgtgtgaggtgcggtcgccgcagtttccatctccagaagagccgatgttctgcttgtgcttatcctgctgctaggaagagatcatacaactggagtgtgaaggcaatccgcagaaagacaactggtacaggccgcatgaggtacctccgcaacgtccctcgcagattcaagaccaatttcagagaagggactgaagcagctccaaggaagaagggaacagcagcttctgcttgaagagagagtaattgaggagggtacttttttaatggtagcttcattttgaaagtattttcaagtattagaaggcaaagaaatttgggaaagcttatttttgttgttgatgtccggtctaaattagaagtacttaaatttttgaaatgtgttgttgaaattgacattctgatacagagttttgattttatttataagctgctttctatttttgttgctgaa

SEQ ID NO: 2094 - DNA, 617 bp, Picea glauca
gggacgaaggcggtgaagagcggaggagtcggtgcgcgctgcaacaatgggcaagggaacaggaagttttggtaagaggagaaataagacccacactctttgtatccggtgtggtcgccgcagttttcatatccagaagagtagatgttcggcatgcgcctacccatcaaagcgcatccgtaaatacaactggagtgtcaaagccattcggagaaagactactggaacaggacgaatgagatacctgcgtcacatgcctcgtcgcttcaagaataatttcagggaggggactcaggcaacccccaagaagaaggctgctgctaccacattttaaatgctttaagaatggccctgaaatattttgtagagtttttaacctcgtttgtgagctggcacgacttgacttattttcatatgctgtcattgacagctttattttctttcacaactcatggttttgaagtaaactcgtttccatacttttgattgatgttgtaccggatggcaaattactaatagtcattttgagaatttaagttaaaattttcctcgtgggttggcaacatgtgcattattttcatatgttattgacagctttgctttatttaagactgatg

SEQ ID NO: 2095 - DNA, 639 bp, Picea glauca
ccccccccccccctcttctgttatttgggacgaaggcggtgaagagcggaggagtcggtgcgcgctgcaacaatgggcaagggaacaggaagttttggtaagaggagaaataagacccacactctttgtatccggtgtggtcgccgcagttttcatatccagaagagtagatgttcggcatgcgcctacccatcaaagcgcatccgtaaatacaactggagtgtcaaagccattcggagaaagactactggaacaggacgaatgagatacctgcgtcacatgcctcgtcgcttcaagaataatttcagggaggggactcaggcaacccccaagaagaaggctgctgctaccacattttaaatgctttaagaatggccctgaaatattttgtagagtttttaaccttgtttgtgagctggcacgacttgcattattttcatatgctgtcaatgacagctttattttctttcacaactcatggttttgaagtaaactcttttccatacttttgattgatgttgtaccggatggcaaattactaatagtcattttgagaatttaagttaaaattttcctcgtgggttggcaacatgtgcattattttcatatgttattgacagctttgctttatttaagact

SEQ ID NO: 2096 - DNA, 529 bp, Camellia sinensis
gggggctgctgagaactccgcagctagggtttcgccactgaagaagagatgggaaaaggaacgggaagcttcgggaagaggaggaacaagactcacacgctctgcgtcagatgtggccgccgaagctttcatctccagaagagtcgatgctctgcttgtgcctttcccgctgctcgcaaaaggacatataactggagtgtgaaggcaattcgaaggaagaccactggaactggccgtatgaggtatctccgtaatgttccccgcaggttcaagagtggcttcagagaaggtactgaagcagctccaaggaagaagggagccgccgcaacctcttaaggtttcaactatcaagggacatttcagtctatctaacttctcaattttcatcatcttgattatggcaagaacaattttcggaatttgtctactgagtgttgcttattttcagtcacaagctgttatcgtttggatggattggatggttagaactttatttgacaatggaagttgctttttatttcacaaaaag

SEQ ID NO: 2097 - DNA, 653 bp, Nicotiana tabacum
  misc_feature (26)..(26): n is a, c, g, or t
  misc_feature (610)..(610): n is a, c, g, or t
gcttctttttcgactcgcataatttntccagctttaaggttttcccacatccgctgcacaaatgggaaaaggaacaggtagttttggtaagaggaggaacaagacacacacactgtgtgtgagatgtggtcgtcgtagcttccacatccagaagagtcgttgttcagcttgtgcttaccctgctgctcgtctcagaaaatataactggagcgtcaaggcacttaggagaaagaccactggaactggccgcatgaggtacctccgcaatgtaccacgtaggtttaagaccaacttcagagaaggaaccgaggctacaccaaggaagaagggtgctgctgtagcgtcttaagtttctaaagagacagttcaactgtttcgttttgattttttgctttacattccctgatgaatcaagtcttggatatttgtacctcgagtattatctctcatttgttagtgtggagtggttcctatttaagacagagatcgaatgatgattgctttttgtcctttatatgctactagttgtttgtaataatttgaagtaaatgatgtcctctttaatcatctggatggctggtagaaactcccgttttacagacttgtaccnaagccattatgtacctaatgcttaaggtggttatgcatttttc

SEQ ID NO: 2098 - DNA, 621 bp, Nicotiana tabacum
cgaccaggaggaggacgctagggtttctgcaacttcactgcaatgggaaagggaacaggtagtttcggtaagaggaggaacaagactcacacactatgtgtgaggtgcggtcgccgcagtttccatctccagaagagtcgttgctctgcttgtgcttatcctgctgcccgtttaaggaaatacaactggagcgagaaggcactccgcagaaagacaactggtactggccgcatgaggtacctccgcaatgttcctcgcagattcaagaccggtttcagagaagggactgaagcagcaccaaggaagaaggcggcagcagcttctacttgaggtcctttgagagggttattgaggagggtactttttataacgttagcatcattttggtattcaagtattagagagcaagcaaattttgggaagcttattgcccattcaaatttacaagtgcttaaattttggaaatttgttgttgaaattggcattttgagaactaatggatttgtgtaggctgttttctacttttggttgctctgaacattctgtccatttgcttatgttccttgaatttgagtattgaggtcttttgagctcttaattttccaataaaaagaaaagcgt

SEQ ID NO: 2099 - DNA, 564 bp, Nicotiana tabacum
acataaattccataagcgttacacaagttcaactttttcccagctgaagagaagcctcccccgccgtatattattagggttcttccgcctccgccgcagaaatgggaaaaggaacggggagttttgggaagaggaggaacaagacacacacactgtgtgtgaggtgtggacgtcgcagtttccacatccagaagagccgctgctccgcttgtgcctatcctgctgctcgcctcagaaaatataactggagtgtcaaggcacttagacgaaagaccactggaactggtcgcatgaggtatctccgcaatgtgccccgcaggttcaagactaacttcagagaaggtaccgaggcaactccaaggaagaaaggtgctgctgtggcctcttaagtttcggtcttgaatctatttcaatgaatatgtgccttagcttttggatatttgttttgagtattaacatacatttgttaatacggagttatttctatttgagagatatagctgtaatagtgtttctcttttgttttatatattgagatagttgttttgtgtagcggccgcatga

SEQ ID NO: 2100 - DNA, 612 bp, Solanum lycopersicum
ataaactctcttattaacgccgaatctcatctatctgaggtagacgctagggtttctgcaactgcacagccatgggcaagggaacaggaagctttggtaagaggaggaacaagacccacacactgtgtgtgaggtgcggtcgccgcagtttccatctccagaagagtcgatgttctgcttgtgcttatcctgctgctaggaaaagatcatacaactggagtgtgaaggctatccgcagaaagacaactggtaccggccgcatgaggtacctccgcaacgtccctcgcagattcaagaccaatttcagagaagggactgaagcagctccaaggaagaagggaacagcagcttctgcttgaagagagagcaattgaggagggtacttttataatggtagcttcattttgaaagtattttcaagtattagagagcaaggaaatttgggaaagcttatttttgttgttgatgtccagtctaaattagaagtacttgaatttttgaaatgtgttgttgaaattgacattctgatacagaattttggttttatttataggctgctttctattttttgttgctgaatcttgagtttttgcgctcgtatatgctttttat

SEQ ID NO: 2101 - DNA, 516 bp, Triphysaria pusilla
aactagggtttctgcaacttcacagccatgaccaagggaacaggaagttttggtaagaggaggaacaagacacacacactgtgtgtgaggtgcggccgccgcagtttccaccttcagaagagccgatgctcggcctgcgcttaccctgctgctcgcaagaggacctataattggtccgtgaaggccattcgcagaaagacaactggaacaggacgcatgaggtacctccgtaatgttccccgcagattcaaaaccaactttagagaaggtactgtagctgcaccaaggaagaaggctgctgctgcatctgcttaagttggagtgcacacttttaattggtattttgaaagaattagtgagcaagggaattttgtgagaccattttaagttttgtttaaaatattgttgccctactttgattggcattttattacatgtctgaaagaccaattctatctctcttgctcctattatttttacatttcatttgctttagttccaaatatgaagcgatat

SEQ ID NO: 2102 - DNA, 496 bp, Utricularia gibba
gggtgtactgcgtgccaactttccaagatgggtaagggaacgggaagcttcggtaaaagaagaaacaagacgcacacattgtgtgtgaggtgcggtcgccggagtttccatcttcagaaaagccgctgcgcggcctgtgcttatccggccgctcggaagaggacttacaactggagtgttaaggccattcgcagaaagaccactggaactggccgcatgaggtatctccgccatgttcctcgaaggttcaagaccaacttcagagaaggtactcaagctgcacctaggaacaaggcggcagctgcttctgcttaaacccctgctgcgaatggctattttccaaatcccagactgctttcagaatttttttgttctgcgttatgatccatgacagtggcattaccgagaccttttgctatccattttggttcacaacgattgttttttgttctgttccccagcgcaatcactagaatcagtttgtttttcactaaag

SEQ ID NO: 2103 - DNA, 529 bp, Ambrosia trifida
ggggaaaggtacaggaagctttggtaaacgaaggaacaaaacacatacactgtgtgtccgatgtggtcgccgtagcttcccatctccagaagagccgatgctctgcttgtgcttatcctgccgctcgtgtgcggaaatataactggagcgagaaggcgatacggaggaagacgactggaactggtcgcatgaggtatcttcgtaatgtgcctcgcagattcaagaccgggttcagagaaggcactcaagctgctcctcgaaagacagctgcagctgcttcagcttaagcgtccaatcagaactgatatcccggtaccgatcaagaattatttttctttgggcatttagtgtattgaacatcatttggcacttttgattcatgacatgttttgattcagttgtttgggatattattaaacagtttaagatctttgttaattctttgagtttacacatgatctgttattaatattttattgatgcagctcaaagtaaacagtcaaatcaaacgcagagtcgcagtcggtac

SEQ ID NO: 2104 - DNA, 516 bp, Musa acuminata
ggcggctagggttttatcgagggcaactgcgatggggaaggggaccgggagctttggcaagcggcggaacaagaccacaccctctgcgtccgctgcggccgccgcagctttcacctacagaagagccgctgcggagcatgcggctatccttccagccggatccgcaaatataattggagtgtgaaggcgacccggaggaagacgacgggaactgggaggatgaggtacctccgccatgtcccacgccgcttcaagagcaacttccgcgaaggtactcaagcggctcccaggaacaaggcagtggctgcagcgtagtcataagacgtggggaagagttaattttctatttatgatattttgcttctactacaaactttagatatttgttttggatgctggaaatgaattctgtagttctattgtttatgagagatctttgaaattttgcgtttgatactcaaaaaagtttgtctgtggatttacaactttcctaatagtaatgtagttgaaatttca

SEQ ID NO: 2105 - DNA, 2312 bp, Cirsium arvense
tttggactttcagctagagtgattgattggtcatagaattgtctgttaatggctggccagaagaatgactatgagaaaagatctcattatcaacccgacttccctggaagtgaaaagagaacaaatcctggtgatgagagggagtcgcacgctattggaccagatgatacagtttaccgatacttgtgccctggtagaaaaattggaagtattattgggagaggaggagaaatcgtgaagcaattgagatcagacactcaggcaaagattagaattaatgaatccgtgcctggctgtgaggagcgcgttgtcattatctatagttcaggtgaggaaacaaatagttttggagatagcgacgatcttgtttcacctgcacaggatgctctctttaaggtgcacgataggattattgctgaagaagcacctattgatgatgaagttgatgaggttcagcaagttactgtgcgaatgcttgtgccttctgatcagattggatgtgtgattggcaaaggtgggcaagttgttcaaacgatacgtagtgaaacacgtgcccaaattcgtattctgagtagtgaacacctaccaaactgtgcattgagtactgatgagcttcttcagataagtggtgaagctacagttgttaggaatgctctctatcaattggcgtctcgccttcatgataatccatcacgatcacagcatttactcttgtcctcatccaatcttcatagagccgggggcggctacatgggtccaaactctggtgctcctcccatgggtgtagtctctttaatgggtccttacgggagctacagaaatgatgggggagattgggcagcctctgcaaaggaattctcgcttcggtttgtttgtccaactgagaatatcggagctgtgattgggaaaggtggtgtaattatcaaacaaatgaggcaagaatctggtgcatctattaaggttgatagttctgctgctgaaggagatgattgtctgataaccgtatctgcaagggaggtatttgaagagacatcaccaacaatagacgcagcaatgcgtttgcagccacgatgcagtgagaaaagtgaaaaggattctggagtttttatactcaccactcgcttgctagttccaagctcacgaataggatgcttgattggtaaaggtggttcgattatttctgagatgagaagcctaacgagagcaaacattcgtatcctaagtacggaaaatctccccaaagttgcatctgaagacgaagagatggtccagatctcgggagatcctaatgttgctagcaatgctctcttacaagtaaccacacgcttaagagcgaatgtatttgagatggaaggcactagagcagcattaccaccggctatcccttatcttcccgtggagatggctgattcatcaagatacggaaatcgtgatggtaattcccgtggacgtggacatgcttctcactccggcagatatgatccagagttgcctccgggtgacaattatggtggttcccagattcccggaagtggttatggatcatatggtgtctacccaggacgatctaccggtggcgggttatctaatccaaatcctgtttcccatgggaaacatcatggctattagttttcggattttgttgccttaagccatgaactgtgatgcctccagcctaaaccagaagagtagaagaaaaggacacaagtacattgtaattatgctttgtttcttaattaggggaaaccgtttgttagacataacttatcgtcttctttcctagctaccataatctctgaactccgcgcctggatgacattcgtacaataggaaagtatctttatttttctttgtaaattttataacataagattaatgattctagtgctcagaaataacagaattgcaattaattgcaacagtaaacaaacaaatatccaaaagttggttttctgataaccatataaaatagcagcaatacaaaagtaaacaaaattgcacttcatttctaagcgctggcaactgctcccttgctccttggggttgcttgagtaccttccctgaagttactcttgaacctgcgaggaacattacgaaggtaacgcatacggccagttccggtggtcttccttctgattgctttcacactccagttgtattttcggacgcgagcagcaggataagcacaagcagagcatcggctcttctggagatgaaagctgcgtcggccacacctcacacacagtgtgtgtgttttgttcctcctcttaccgaaacttcctgttcctttacccatctctgcagattgagaa

SEQ ID NO: 2106 - DNA, 1940 bp, Cirsium arvense
ccctaaagcttttcatcgtctaccattgttgcagagcttcaggtttaacaacacattaagtgcttctatttctgagggttgatttcttgctttataaacatcgtatgaccaactcacactaaatatggctaaacggtggataaatggagatgagactgcaaaacaaatgctgggaagggttcttaaagagagaccattgcttcttctacctcacccccttcatagaataccacttggtgtcagcaacattgttgaaatcgtaggcccatctccttctgccaaaactgagattttgctacatgtggccgttagttgtattcttcccaaaagttggaatggaattcaatatggaggcttggaacattctgtgttgttcttggacttagattgccgacttgatatctttcgcctttctcagtctctaaaactacgaatagccgaaactaataaactgcacaaaatcacaaagaaacaaaagggtgttgatctttctaaccgaatttcagaccatcaattcgagtatgatgatatggacttgtttacagagtgcatgaaacggttttcatacacccgatgttatgatagttttgagtttcttgctgctttaaaggtattacatcacaaacttgagaaagaaagaaacacgaaagatggaaatggtattcatgtccttatgatcgataacattggagcattttattggatcaatcgtggtttttcatcattgccgcaaggaaaccctaataggaaaaacctttctcttcaaagtgtgtttgaaaccgttgttcctgagattaagaaactcttggttctgcatcccatgcttgttttagctacaaaaatggttacatatcaagttaaaagttcgtattctaggtgggtttcagaagtgaatattgaaaaaggcacatatcgtgagtatatgccatcaatttggcagtcatttgttacacacagaattcttgtgagaacttcggatgacaaaagaaagattcaagatcaagtttgctatttggcagagtggttattaccggctttaaatctcacagatgagtttgttgttggagacgctggaattttgacattggtatgaggaatacttgattcaacgctaaatagggttaaaatggtcatttagtgtttaggacagacggtctgaatcatgacatttcatcatttaggattgtcaaatatataggcttttaggatgaagtatttttgaatcacacatgaaaacaaatctcaagtcctttattatagagataagattcaagaaatgtacctattatatctaattatgccaattgctgaggatattggttatgtttcgatcttatggtaagattttttttaacaaaaagtatttagcagtctggtgctcagaaataacaaaattgctataaagagcaacattgaacaaacaaaaaatccaaaggttggttttctggaaaccatataataataaaatagtagcaatacaaaaacagacaaaattgtacttcaatttctaagcgctggcaactgctcctttgctccttggggttgcttgagtcccttccctgaagttactcttgaacctgcggggaacgttacgaaggtaacgcatacggccggttccggtagtcttccttctgattgctttcacactccagttgtattttcggacgcgagctgcaggatacgcacaagcagagcatcggctcttctgcagatgaaagctgcgtcggccacacctcacacacagtgtgtgtgttttattcctcctcttaccgaaactccctgttcctttacccatctctgcagattgagaagaaacatagaattggataaaagtagcttataattgattaaaaaaattgtactagatgcaatcgaaagagaaatcttatgcagtggtgacaaccaattaaattaatttatactaaaatacagaaactagg

SEQ ID NO: 2107 - DNA, 446 bp, Cucurbita pepo
ctgcatcaatggggaaggtacgggaagttttggtaagcggaggaacaagacccatactctctgtgtgcggtgcggccgccgcagcttccatcttcagaagagtcgttgttcagcatgtgctttccctgctgctcgcaagcgcaagtataactggagtgtgaaggctattaggagaaagactactggaactggaaggatgaggtacatgcgccatgttccgcgtagattcaagagcggcttcagagagggtactgaagctgcaccagaaataaaggatctgcagcatcagcgtaaggtattggaagaagttcgacttaatttactagcacccaattaatagttttcagtagggtttttacgcatctgaggattatttcacataattttgtttccttagttttgcctttttcatgatttagttgaacgcagtttctttgaaatgtatt

SEQ ID NO: 2108 - DNA, 625 bp, Pinus pinaster
tggacggctaaaataaaggcgtcgttagggtttttagatttgataaaacccccgatcgagacctaaatttgttcttctgtttgggacgaaggctgtaaggagcggaaggctgtaaggagcggaggattcggcgtgcgctgcaacaatgggtaagggaacgggaagttttggtaagaggagaaataagacccacactctatgtatacggtgtggtcgccgcagttttcatatccagaagagtagatgttctgcatgtgcttacccatcaaagcgcatccgtaaatacaactggagtgtcaaggctattcggagaaagactactggaacaggacgaatgagatacctgcgtcacatgcctcgtcgtttcaagaataatttccgggaggggacccaggcaaccccaagaagaaggctactgcaaccacattttaaatgatttaagaatgaccctgaaatgttttgtagagcttttaaccacatttgtgagctggcacaacttgcattattttcatatgctgtcatagacagttttattttctttcacaactcatagttttcaagtaaaaactcttccatatttttgattgaggttgtatcggatgacaaattaattcaagtcattttg

SEQ ID NO: 2109 - DNA, 657 bp, Juglans hindsii x Juglans regia
  misc_feature (164)..(164): n is a, c, g, or t
  misc_feature (224)..(224): n is a, c, g, or t
  misc_feature (579)..(579): n is a, c, g, or t
  misc_feature (599)..(599): n is a, c, g, or t
gcgcggggctttacaaacccccatataagatagatatacaatcccctctccgccgctccttcatttcttaccctaaacagcacctcctctcactcggccaggttttctgcatctgtcccaatgggaaagggaacggggagcttcggaaagaggaggataagacncacaccctctgcgtgaggtgtggccgccgcagcttccatctccagaagagtcgctgcgcngcctgtgcctaccccgccgctcgtaagaggacatataactggagtgtgaaggcgatccggcggaagactactggaactggaagaatgaggtacctccgccatgttcctcgaagattcaagagcggcttcagagagggtactcaagcagcaccaaggaagaagggagcggctgctactgcttaagccgttgccagagagtgaagttgtcgtaatttggatgccaaattaaagtttgattagatgcatttttttgtgttgggacttgtttgatgaaagcaaatatttgatgggtgttataacctttttaatgattgaggtgctctgattttgattagtttgtagctttaatttgganaaagatgtgcgagcccactnttgttttcccttcaattacttaatatttcagtaaagtccgaattttgattttgtttag

SEQ ID NO: 2110 - DNA, 305 bp, Aquilegia formosa
ttgtgatttgattttgatttcagggaaaaggaactggaagtttcggtaagagaaggaacaagactcatacactatgtgtaaggtgtggtcgtcgaagctttcatcttcagaagagcagatgttctgcttgtgcttaccctgctgcccgtactcgcaaatataactggagtgtgaaggcgatccgtaggaagactactggaactggtaggatgcagtatcttcgtcatcttccccgtcgcttcaagagcaatttcagagaaggtactgtagcagctccaagaaccaagggtgctgcagctgcttaa

SEQ ID NO: 2111 - DNA, 621 bp, Amaranthus tuberculatus
agaggtctagggtttctgccgatacgcaaaatgggtaagggaacagggagtttcggtaagaggaggaacaagactcacactttatgtgtgagatgtggacgtcgtagtttccatcttcagaagagtcgttgcggtggttgtggtttcccttctgctcgcaagagaaaatacaattggagtgtgaaggcaatcaggaggaagacaaccggaacaggtaggatgaggtaccttcgcaacgttccaaggaggttcaagactggtttcagagaaggtaccgaagccgctccaaggaagcaagttgcagctgcatcttaatatagtcgcagaaatttggctgggctgatagttgtgtttgtgttattttttgaattttggatatttgttgtagaactgcagagtttgtagtaatgagatctgcacaactctgaggttttgagtcgtgttttatgttttagataattgttgacataatagtgcaatctactacattttcaaaatagttttatttatggtacttgaaagtttcttatgatcataatgtgtatgcttttagatatgaaatacccttacgactcgtttggttagtggtattaaatggtggtaatgagaatgatatatcgt

SEQ ID NO: 2112 - DNA, 511 bp, Artemisia annua
acaatgggtaaaggaacagggagttttggtaagaggaggaacaagacacacacattgtgtgtacgatgtggtcgaaggagcttccatttgcagaagagtcgatgttctgcttgtgcttatcccgctgctcgtgtcaggaaatacaactggagtgagaaggcaataaggaggaagacaactggtactggtcgcatgaggtatcttcgtaatgtgcctcgcagattcaagagcggcttcagagaaggtactcaagctgtccctagaaaggttgcagctgcttctgcttgaaactttgaggttttacatcgaacttgagggtactgattgagcgtattttggttagggctgttggtataattgaacatcagttggtgctatttcatctcgtttgaaattttgttttcgaattttgttattatgatgttgcagatcatgtctcattttgattttaaaatgatttggatgttaaccaaagttcttcttagatggtttatatgatctgttatagctt

SEQ ID NO: 2113 - DNA, 487 bp, Artemisia annua
tacttccgtcaagttcttttcaccgccaaacaatgggaaaaggaacagggagttttggtaagaggaggaacaagacacacacactgtgtgtacgatgtggtcggaggagtttccatttgcagaagagtcgatgttctgcttgtgcttatcctgctgctcgtgtcaggaaatacaactggagtgagaaggcgatcaggaggaagacaactggtactggccgcatgaggtatcttcgtaacgtgcctcgcagattcaagagcggcttcagagaaggtactcaagctgtccctagaaaggttgcagctgcttctgcttgaaacttaacttgatcttcgggtactgattgagcgtattttggttagggttgttggtataattgaacatcagttggtgctatttcatctcatttgaaagtttgtttttgaattttgttattatgatgttgcggatcatgtctcattttgattttaaaatgatttggatgtta

SEQ ID NO: 2114 - DNA, 595 bp, Cyamopsis tetragonoloba
cacgaggctccttcgctgcatcgtctagggtttcgcatctgctacaatggggaaggggacagggagctttgggaagaggaggaacaagactcatactctctgtgtgaggtgtggccgccgcagcttccacctccagaagagtcgttgcgccgcctgcgctttccccgcggctcgcaataggaaatataactggagcgtcaaggcgatccgcagaaagaccaccggaactggtaggatgaggtacttgcgtaatgtgcctcgccgattcaagagtggtttcagagaaggtactgaagctgcaccaaggaagaggggagctgctactgcgtaagcctttggaagatagttgttttctgggtacggaattataggattagattgtttttgtgattggggcaagtctctcggaacacttaattttaatagcctcattgtttctctctttttcgtttccatttaatttgtagttgtttcatatattaacaggatggttataagattttctgtttgttcaaatggattgtatggcatttagtattggttttaaatggttttcatgtgataatagacatcctctactgcgtaattctattta

SEQ ID NO: 2115 - DNA, 428 bp, Gnetum gnemon
cccagcgagagcagtgcacagagagcatcagcgagcggagaaacagcagacgctgcagcaatgggcaagggaactggaagttttggaaagagaaggaacaagacgcacactctgtgtatccgatgtggccgccgcagctttcatctgcagaagagcagatgcggtgcgtgtgcctatccggctgcacgtctgcgcaaatataactggagtgtcaaggcaattcgaaggaagacaaccggaacaggaaggatgaggtatctgcgacatttgccaaggagattcaagaacaactttagagagggaacccaggcaacatcaaagaaaagggctgctgttcaggcatagatgatttagagctagtatgattttcaagcccccttgttaaagcgggccactagttttgtttctgtcaaaattttgaaatttgg

SEQ ID NO: 2116 - DNA, 311 bp, Lotus japonicus
caaaattagggtttacgatctgctccaatgggtaagggtactggcagtttcggtaagcgtaggaacaagacccacaccctctgtgtcaggtgtggccgccgcagcttccacctccagaagagtcgctgcgccgcctgcgccttccccgctgcacgcaagaggaagtataactggagtgtgaaggccattaggagaaagaccactggcactggaagaatgaggtacttgcgtaacgtgcctcgcaggttcaagagcggtttcagagaaggtactgaagctgcacccaggaacaagggagcagctgcatctac

SEQ ID NO: 2117 - DNA, 566 bp, Silene vulgaris
aatcaagagtatctagggtttccgccattgacgtcgcaaaatgggtaaaggaacagggagtttcggaaagaggagaaacaagacgcacacattgtgtgtaagatgcggtcgtcggagttttcaccttcagaaaagccgttgttctgcttgtgcttttcctgctgctcgtaccagaaaatataattggagtgtgaaggcaatcaggaggaagacaaccggaaccgggcgtatgaggtatcttcgtaacgtaccaagaaggttcaagactggtttcagagaaggtactcaagcagccccaaggaagcaagttgcagctgcttcttaaagtttagttccttgagttttatcgaaccagtagttgctttgtgggattttctacttgaaatgtggattactcaatttgtattagtaatgagatgtttaacacagatcaggtttcccgttctcatgcttttgggtatttcttgcttgatctattatactccgcctcggtttggtttagttttaaatgttttgcgacttttgtgagtcttcagacatgaaatgatgaaccgttagatcgtcta

SEQ ID NO: 2118 - DNA, 410 bp, Flaveria ramosissima
gtttcttctcaatctgcagagatgggtaaaggaacagggagtttcggtaagaggaggaacaaaacgcacacgctgtgtgtaagatgcggcagacgcagctttcatctgcagaagagccgatgctctgcgtgtgcgtatcctgctgctcgcctcagaaaatataactggagtgaaaaggcaattagaaggaagactacaggaactggtcgtatgcgttaccttcgtaatgttccccgcaggttcaagagcaacttcagggaaggtactcaagcaacaccaaggaccaaaggagctgctgctgctgccagcacttgaagatgaactacaattttgtttggttttgtgttggtactatttatttatattgtctttttaagtaaaacttatacttgggtatttttgtttgttta

SEQ ID NO: 2119 - DNA, 486 bp, Ambrosia trifida
atcttcattccaagaaatgggtaagggtacaggaagtttcggaaagagaaggaacaagacacacacactgtgtgtgagatgtggccgccgcagctttcatctccagaagagccgttgctctgcttgtgcttatcctgctgctcgcgtcaggaaatacaactggagtgtgaaggcaatcagaaggaagacaacaggaactggtcgcatgaggtaccttcgtaatgtgcctcgcaggttcaagagtggcttcagagagggaactcaagcaaccccaaggagcaaaggaactgctgctgccagcacttaggtttgaaggaggatcttaatgtactttagcgcttctgaattatgtttgtttgcttgttattacaagtggaatcttgatgctttatttttggtatgtgatgaaacaagatactttctactccgtttatgttttatgcaccttcacatgttggtctaaaaaagaaaaaaataccgactgcg

SEQ ID NO: 2120 - DNA, 584 bp, Manihot esculenta
actgtccattctcaaaccttctgcaaataaatacctcaacctccgtcggatccagctttttccccctcaccactacatcggcggtcgctgaggctagagaagaaatggggaaaggaacaggaagctttgggaaaaggaggaataagactcacaccctctgcgttagatgtggtcgccggagcttccaccttcaaaagagccgttgtggtgcttgtgcctatcctgccagccgcgttagaaaatataactggagtgtgaaggcaattcgtagaaaaactactggaactggccgaatgaggtatctccgtcatgtcccacgcaggttcaaaaccaacttcagagaaggtacacaagcaactccaaggaacaagggagctgctgcagcctcgtcgtaagccttagaagggcaatgcaagcatgttttttattttactttttagtatttatcaatttgcaaacctggagttttggatcattgtctaatattttggatcattatctaatagacgttccttcttgtatgccgacagttttttttaaaaccttcgagagtatcaaatatttatgttatggttttgggtgct

SEQ ID NO: 2121 - DNA, 503 bp, Castanea mollissima
cctagctcggggcttctctctctgcaacaaaagaaatgggaaaaggaacagggagttttggtaagaggaggaacaagacccacacgctgtgtgtgcgatgtggacgcagaagcttccatctccagaagagtcgctgctccgcttgtgcctatccagctgcccgtgtcagaaaatataactggagtgtgaaggctatccgccgaaagacaaccggaactggccgtatgaggtatctccgtaacgtgccacgcaggttcaagactaattttagagaaggcactcaagcaacccccaggaacaagggaacagctgctgcatcctcttaaagttcataagagcaatgttattcggttttgtttgatattcttgaattctcaaacaatttttggatcattgtttaaagagagttactttttgttacgagacatgagttgtttgcaatattggagacttataattttctcggcatcattttgataatctatggtcactattttcaatac

SEQ ID NO: 2122 - DNA, 484 bp, Flaveria ramosissima
cccgttcttttttctatcctattgaagctagggttttgtttcttctcaatctgcagagatgggtaaaggaacggggagtttcggtaagaggaggaacaaaacacacacactgtgtgtaagatgcggcagacgcagctttcatctgcagaagagccgatgctctgcctgtgcgtatcctgctgctcgcctcagaaaatataactggagtgaaaaggcaatcagaaggaaaactacaggaactggtcgtatgcgttaccttcggaatgttccccgcaggttcaagggcaacttcagggaaggtactcaagcaacaccaaggaccaaaggagctgctgctgccagcacttgaaaatgaagtacaattttgcttggttttgtgttggtactacttatttatatggttttcagaaaacttatctgggattgttgtttgtttactttagtttctttccaatattttatccagttatgagcactagatatt

SEQ ID NO: 2123 - DNA, 585 bp, Linum usitatissimum
gcagaattagggtttctgagctgcgactgctgcaatgggtaagggtacagggagtttcggtaagaggaggaacaagacccacaccctctgtgtgaggtgcggccgccgcagttttcatctccagaagagtcgctgctccgcttgtgcttaccctgccgcccgcgtcaggaaatacaactggagtgagaaggctatccgccgaaagacaaccggaactggaaggatgaggtacatgcgccatatggctcgcaggttcaagagtggattcagagagggcactcaagctgcgccaaggaccaagggaactgctgcagcatcatcttaaaaagatcgtttttagggttttgctatgcttagtaaggcttctgttgagacattttgttggaacatgtttgaaaaggcaacttattcggagtttttgttgtcacgttttgtaatgctgaagtctttcatatattgtagttgttttcagtttgacaatatgcattttttataatttcttctgagcatctcctgttcttatcatgttttatccttcctcttttgctgctaagcacggtcgagctaatcataccagtaattcag

SEQ ID NO: 2124 - DNA, 558 bp, Quercus alba
tcgggggtctatattaatatcaaaactctcaaaagccacatagaaactcttccttcctcaaaaacctagctcagggcttctctctgcaacaaaagaaatgggaaaaggaacagggagttttggtaagaggaggaacaagacccacacgctgtgtgtgcgatgtgggcgcagaagcttccatctccagaagagtcgctgctccgcttgtgcctatccagctgcccgtgtcagaaaatataactggagtgtgaaggctatccgccgaaagacaaccggaactggccgtatgaggtatctccgtaacgtgccacgcaggttcaagactaattttagagaaggcacccaagcaacgcccaggaacaagggaacagccgctgcatcctcttaaagttcataagagcaatgttattcagttttgtttgatattcttgaattctcaaacaatttttggatcactgtttaaagagagttacttattgttacaagtcatgagttgtttgcgatgttggagacttataattatctcggcttgaatttgataatcaatggtcactattt

SEQ ID NO: 2125 - DNA, 611 bp, Carthamus tinctorius
ttctgagatcatcatcatcatcagacgatcagatattctgaagaattagggtttctgaaacctcatagcaatggggaaaggaacaggaagttttggtaagagaaggaacaaaactcacactctgtgtgtacggtgcgggcgccgcagcttccatctccaaaaaagtcgatgctctgcttgtgcttaccccgctgctcgcgtcagaaaatacgactggagcgtgaaggcgatccgtaggaagactaccggaaccggacgaatgaggtatctccgtcacttgcctcgcagattcaagagcaacttcagagaaggtactcaagctgctccaaggaagatcggtggtgcagcatcttcggcttagattcgtgaaatcatggtcgttttttaacctggaatcgtgcgatttagaggattaatcgaagttttgtgaaacatgatttgatgtggttaatccattgatcttcaattgtggtctccttctgtttagaaatttgtgatttttaatcatggattgaatgatatatacagttgcaagagaagttaccatttcttcctttctgggaatgattcaatctttcttgtgaatatacttcattcaaatgttttatgca

SEQ ID NO: 2126 - DNA, 700 bp, Helianthus annuus
ggaactcaagccgctcttgaacctgcgaggcacgttacgaaggtacctcatgcgaccagttcctgctgtcttttctttttccaacttgtgagatccgctagggttgtgttcttcttcattccaagaaatgggtaagggtaccggaagtttcggaaagaggaggaacaagacacacacactgtgtgtgaggtgtggccgccgcagctttcacttgcagaagagccgatgctccgcctgtgcttatcctgccgctcgcgtcaggaaatacaactggagtgtgaaggcaatcagaaggaagacaacaggaactggtcgcatgaggtaccttcgtaacgtgcctcgcaggttcaagagcggctttagagagggaactcaagcaaccccaaggagcaaaggaactgctgctgccagcacttaggtttgaaggaagattttaatgtactttagtgcttctgaattatgtttgtttggtttttatcacaagtggaatcttgatactttatttttgttatgggaggagaccatatgctttctatttgattttctgctccacatatgcattttgcacttacatatgttggtctgtttgacaagtcttctttcaacttatatgctcacatttttcaaggtaatgaaaaatgacttgtatgctcacatttttcaaggtaatgaaaaacgtgtagacgttaaaacgaaaaaa

SEQ ID NO: 2127 - DNA, 695 bp, Helianthus annuus
aacacccaaaaagaaaccctagttccaccatataacaaacaaccctaaacgtattcagctgctgtcttttctttttcaacttgtgagatccgctagggttgtgttcatcttcattccaagaaatgggtaagggtaccggaagtttcggaaagaggaggaacaagacacacacactgtgtgtgaggtgtggccgccgcagctttcacttgcagaagagccgatgctccgcctgtgcttatcctgccgctcgcgtcaggaaatacaactggagtgtgaaggcaatcagaaggaagacaacaggaactggtcgcatgaggtaccttcgtaacgtgcctcgcaggttcaagagcggctttagagagggaactcaagcaaccccaaggagcaaaggaactgctgctgccagcacttaggtttgaaggaagattttaatgtactttagtgcttctgaattatgtttgtttggtttttatcacaagtggaatcttgatactttatttttgttatgggaggagaccatatgctttctatttgattctctgctccacatatgcattttgcacttacatatgttggtctgtttgacaagtcttctttcaacttatatgctcacatttttcaaggtaatgaaaaatgacttgtatgctcacatttttcaaggtaatgaaaaacgtgtagacgttaaaacgaaaaaa

SEQ ID NO: 2128 - DNA, 342 bp, Phaseolus coccineus
tattgggatatagagatcctccaactagggtttctgattcgctgctacaatggggaaaggaacagggagtttcggtaagaggaggaacaagactcacacgctctgtgtgaggtgtggtcatcggagcttccaccttcagaagagtcggtgttctgcgtgtgctttccccgctgcgcgcacaagaaaatataactggagcgcgaaggccattaggagaaagactaccggaacaggaaggatgaggtacctgcgtcacgtgcctcgcagattcaagagtggcttcagagagggtacggaggcagcaccaaggaagaggggagcggcttccactgcctaatcttt

SEQ ID NO: 2129 - DNA, 478 bp, Centaurea maculosa
ctttcattttcttcttctctctgatctactggttttctagggttttgtttcttctcaatctgcagagatgggtaaaggaacagggagtttcggtaagaggaggaacaaaacacacacactgtgtgtgaggtgtggccgacgcagctttcatctccagaagagccgatgctctgcttgtgcttatcctgctgctcgcgtccgaaaatacaactggagtgtgaaagctatcagaaggaagaccaccggaactggccgtatgcgttaccttcgtaatgttcctcgcaggttcaagagtaacttcagggaaggcactcaagcaaccccaaggagcaagggagcagttgccagcgcttagaaatgaagtgcaattttgtttacttttgtattgctgctattttatatggttatcagaaaaccaacttttggatatttgtttgttcactgtcacttataattgcaattctgatatttttgagca

SEQ ID NO: 2130 - DNA, 449 bp, Centaurea maculosa
catcgattctctagagacatgggtaagggaacaggaagttttggaaagaggaggaacaagacacacacactgtgtgtgaggtgtggccgccgcagctttcacctccagaagagccgctgctccgcctgcgcctatcctgctgctcgcgtcaggaaatacaattggagtgtgaaggcaatcagaaggaagaccactggaactggtaggatgaggtacctccgtaacgttcctcgcaggttcaagagcaactttagagaaggtactcaagcaaccccaaggagcaaaggagccgttgccagcgcataggtttgaaggaagattttgatgtattttagtatgagctttggatttatgtttgtttgcttacgacagctggaatgctttgattttgatatggatggaatccgatactttctattttagtttgctacatctcgtaaaattatgcc

SEQ ID NO: 2131 - DNA, 824 bp, Centaurea maculosa
ctttcattttcttctctctgatctactagttttctagggttttgtttcttctcaatctgcagagatgggtaaaggaacaggaagtttcggtaagaggaggaacaaaacacacacactgtgtgtgaggtgtggccgacgcagctttcatctccagaagagtcgatgctctgcttgtgcttatccagctgctcgcgtccgaaaatacaactggagtgtgaaagctatcagaaggaagaccaccggaaccggccgtatgcgttaccttcgtaatgttccccgcaggttcaagagtaacttcagggaaggtactcaagcaaccccaaggagcaaaggagcagttgccagcgcttaaaaatgaagtgcaattttgtctacttttgtattgctgctattttatatggttatcagataaccaacttttggatatttgtttgtttactgtctctattaattgcaattctgttatttctgagcactagagtttttgatattggaatagtctggctttatataagttttcatcttttcttttttcttttttccacacataacgtatttttcatcaataaataagataaaaactgtatttacagtgttcgatttagaccacctttacttgcaattatatcatattaacttcagtttcaatggaaaaacaataatagctggatcaattaagccaatggcttttatgcactacccttgatgactccatcagcatcgttttcagtggtgatgccatcgccatcggcacctttaacatcatcgaagtagtcttctcttgcgttatcagccaacataagggaaaccaaccagaagagagc

SEQ ID NO: 2132 - DNA, 559 bp, Centaurea maculosa
ggggcggatcttcttcttcttctagtcagggtttcgattctcttaattctagagagacatgggtaagggaacagggagctttggaaagaggaggaacaagacacacacactgtgtgtgaggtgtggccgtcgcagctttcacctccagaagagccgctgctctgcctgcgcctatcctgctgctagggtcaggaaatacaattggagtgtgaaggcaatcagaaggaagactacaggaactggtaggatgaggtacctccgtaacgttcctcgcaggttcaagagcaacttcagagaaggtactcaagcaaccccaaggagcaagggagccgttgccagcgcataggtttgaaggaagattttgatgtattttagtatgagctttggatttatgtttgtttgcttacgacagctggaatgctttgattttgatatggatggaaatcgatactttctattttagtttgctacatctcgtaaaattatatgccatgcattggttttttactcttctgggatgcaattagaaaaccaatatcagatttgttaaccacagtga

SEQ ID NO: 2133 - DNA, 511 bp, Gossypium hirsutum
aaatgggaaaaggaactggaagctttggaaagagaaggaacaagactcacacgctctgcgttcgatgtggtcgccgaagcttccatctacagaagagccgttgcggtgcttgtggctaccctgccagtcgcatccgaaaatataactggagtttgaaggctattagaagaaagaccaccgggactggccgcatgaggtacctccgacgtgttccccgaaggttcaagactggctttagagaaggtactcaagcaactccaaggaagaagggagctgttgctgcttcatgagttaatttgtgatgttttgttttgttcagagagattcctgaatttagaaacaataggttttgggtctctttcaactgtgtgttactttttcatttttcacctaatgtctacaaacgggaagttttgttttaggtttatgaagtttcacgactttattttctattatgtagagcaatttacttctatccctttgtgttgtatgaatagtgatatgcaaccca

SEQ ID NO: 2134 - DNA, 1182 bp, Gossypium raimondii
gtttttttttaattttaaaatgtcacacgaacaaatttaacaaaaaatattaataatattaacaattggatttgatttttgaaatctaaaaagtaaaaggactaaatttcaaaattatgaataggatagggagctatggcatattttaaccaacaaatttctctccaagagtaattggagaataagaatttgggttgaatcatgcaactacaatccattaatttttcctacataataataataaaaagcccaaatccaaccctaaaatggaaccctaagaacccatattcagaaaatcaacatatatatttgttagattcataaacctaattttcctcaaaaacttttccctcaatccccgcacagttctagggttttgttagcagctgcgacagaagaaatgggaaaaggaactggaagctttggaaagcgaaggaataagacccacacactttgcgttcgatgtgggcgccgtagcttccatctccagaagagccgttgcggtgcttgtggctaccctgccagccgcatccgaaaatataactggagtgtgaaggctattagaagaaagacgactgggacaggccgcatgaggtacctccgtcatctgccccgaaggttcaaaactggttttagagaaggcactcaagcaactccaaggaagaaggcagctgttgctgcatcttaagttggttttggtgttttgtttttgagatttctgaatttacacaaactaaagtttttgtgatttttatcatcattttgtacttttattattacaacctaatatccatgaacagaaagttgtgttttaccatgaatcttcacaacattttgatttctcacatttttctcttgtgagatagtgtcatagtggtatgtcatccatgatgttaaaattttggtttttgcacattttgtgtgagaacgaaccccatctaaagtgtcttgtttactatatgctgcatttgagacaattcgcaagagactttagtgttgttggaattagatggaccaattaaatagagaatcggttagtatatcagtccagataagaggtttgagcaaagtgtttggaatcgattgactcgagaaataaaaaagtgattgaattgtttttataatttataatttttttcttaaattttgtgagttttaattaattatttaattattggttga

SEQ ID NO: 2135 - DNA, 540 bp, Carpinus betulus
gcctaagtagcactgcctccgactctgctggggtttctgcatctgctccaatgggaaagggaacagggagtttcggaaagaggaggaacaagacccacaccctctgcgtgaggtgtggccgccgcagcttccatctccagaagagtcgctgctccgcctgtgccttcccggctgcccgcaagaggacatataactggagtgtgaaggcgatccgaaggaagactactggaaccggaaggatgaggtacctccgccacttgcctcgcaggttcaagagcggcttcagagagggtactcaagcagcaccaaggaagaagggagcagccgccactgcttaaaagcattattgaagagtggtattgggtgtaatttgcttgccaaattacatttttggctttgagtttttatgtgttggagactggttttatgaaaaagcaatgtttgatgggtatcataacctttttaatgatttagcactttttgattccgattagtatgtagctttcattttggacaaggatggataatttcattttcgtt

SEQ ID NO: 2136 - DNA, 362 bp, Helianthus annuus
gggttttgtttcttctgaatctgcagcagagaagagatgggtaaaggaacagggagtttcggtaagaggaggaacaaaacacacacactgtgtgtaagatgtggtagacgcagctttcatttgcagaagagtaggtgctctgcgtgtgcctatcctgctgctcgtgttagaaagtataactggagtgagaaggctatcagaaggaagaccacaggtactggtcgtatgcgttaccttcgtaatgttccccgcaggttcaagagcaacttcagagaaggtactcaagcaacaccaaggaccaaaggagctgctgctagcacttaagaatgaagtacaattttgtttggctttgtgttactact

SEQ ID NO: 2137 - DNA, 519 bp, Helianthus annuus
gggttttgtttcttctgaatctgcagcagcagagaagagatgggtaaaggaacagggagtttcggtaagaggaggaacaaaacacacacactgtgtgtaagatgtggtagacgcagctttcatttgcagaagagtaggtgctctgcgtgtgcgtatcctgctgctcgtgttagaaagtataactggagtgagaaggctatcagaaggaagacgacaggtactggtcgtatgcgttaccttcgtaatgttccccgcaggttcaagagcaacttcagagaaggtactcaagcaacaccaaggaccaaaggagctgctgctagcacttaagaatgaagtacacttgttcttgtttcagaaaacctttcttggggattttgtttgtttacatttatgttcagttttttgcattttcccttctttatagactgaccataaatccaaaaacaaaaatcaaacaagtgtaaactcagtttggttttaaactgataaaatagtaaaatgtatgtcactttacaaaaa

SEQ ID NO: 2138 - DNA, 562 bp, Citrullus lanatus
ccccatagccaaactgcagatagaattcctcctccctagggtttcttcgtcctgcagcaatgggaaagggtacgggcagttttggtaagaggaggaacaagacccatactctctgtgtgaggtgtggccgccgcagcttccatctccagaagagtcgctgtgcagcctgtgctttccctgctgctcgcaagcgaaaatataactggagtgtgaaggcaattaggagaaagacaactggaactggaagaatgaggtacttgcgcaatgttccgcgtagattcaagagcggcttcagagagggtactgaagctgcacccaggaataaaggagcagcagcatcagcataagttttttggaagaagttcgacttaatttcagtacccaactatagttttcagtagggtttttactcatctgagaatcatttcatataattttgttttctagttttgccttttcatgatttagttgaacgtggtttccttaaaatgtattgtttgaattgtggacaaatgatgaatcagatttttcgtattctgctacttgtttatgcatttaagca

SEQ ID NO: 2139 - DNA, 703 bp, Abies balsamea
acctaaatttgttcttctgtaggttggggacgaaggcggtgaagagcggaggagtcggtgcacgctgcaacaatgggtaagggaacaggtagttttggtaagaggaggaacaaaacccacactctttgtatccggtgtggtcgccgtagttttcatatccagaagagtagatgttctgcatgtgcgtatccatcgaagcgcattcgcaaatacaattggagtgtcaaagctattcgaagaaagactactggaacaggacgaatgagatatcttcgtgacatgcctcgtcgttttaagaataatttcagggaggggactcaggcaactcccaagaagaaggctgctgctaccacattttaaatgtttcaggaatgtccctgatgtattttgtggggttgttaacctcatttgtgagctggcaaaacttgcactgttttcatatgctgtcatatttgtttttcacaacttgtgtttttcaatttaacacttctcctaaaattttgattaatgtagtaccggatgacaaattgaaattatttgtctattttgagtaatttaggttaaacttttctgtgggttggcaccaagtgcattatttgcatatattattgacagtttgcttaaatttttagcctgtgctttacaagaaaaattccttcacaaacttttgattggtgtgttacttgcaaactatttatgattt

SEQ ID NO: 2140 - DNA, 496 bp, Amaranthus tuberculatus
tctttctctgtttcatcctccttgctcctccatcagctgctgcaatgggtaaaggtaccggaagttttggaaagaggagaaacaagacacataccttgtgtgttagatgtggccgccgcagttttcaccttcagaagagccgatgttctgcctgtgctttccccgcggctcgtactcgcaaatataactggagtgtgaaggcaatcagaagaaagactaccggaactggccgcatgaggtaccttcgtaatgttccacgccgtttcaagaccggtttcagagaaggcactcaagctgcaccaaggaaacaaggagctgctgcatctgcttaaacaaagctttggacaggttgatttgggtacttctcgaaaattaactccatttttgcatctttcaagttttggaactagccttttgttttcttatttccttggagacattgtaatttgatgaaaatgatattattggattttcgatcactacattttagtagctt

SEQ ID NO: 2141 - DNA, 409 bp, Ambrosia trifida
gacagacagtttctagggttttgttccttctctttccaaagcttcctgttcctttacccatatctctagattatgggtaaaggaacaggaagctttggaaagagaaggaacaaaacacacacactgtgtgtaaggtgtggcagacgcagctttcatctgcagaagagccgttgctctgcttgtgcttatcctgctgctcgcctcagaaaatataactggagtgagaaggccatcagaaggaagaccacaggtactggtcgcatgcgttaccttcgcaatgttccccgcagattcaagagcaacttcagggaaggtactcaagcaacaccaaggaccaaaggagctgctgctagcacttaaaattgaaatacaattttgtttggttttgtgttggtactacttattcttg

SEQ ID NO: 2142 - DNA, 513 bp, Aquilegia formosa
ctctaaaacagcagaagaagaagcgaagaaggagggttttcagcttcggcgatgggtaaaggaacaggaagttttggtaagagaaggaacaagactcataccttatgtgttcgatgtggtagacgaagttttcatcttcagaagagtcgttgtgctgcttgtggttatcccgcaagtcgaatcagaaaatataactggagtatgaaggctattagaaggaagacaactggaactggaaggatgcagtatcttcgtaatgttcctcgcagattcaagagtaacttcagagaaggttcccaagcagctccaaggagtaagaatgcggctgcatcttcttaaagggcgaaaagagtattttgtggtactttttttgtagtttgttaacatttgtgattgtgagtcagagtttagagatttttgttgaaaacctgttgaaggattttgctgccctcatttatgaatgaatggattcttataactactaaatttaattaagtaaagtgaatttactat

SEQ ID NO: 2143 - DNA, 612 bp, Artemisia annua
tggtatcaacgcagtactccaacggggttacatatccagcagctagggtttcgctcttcatcatttcaagaaaatgggtaagggaacagggagttttggaaagaggaggaacaagacacacacactgtgtgtgcgatgtggaagaagatcctttcatttgcagaagagcagatgctctgcttgtgcttaccctgctgctcgtgtcaggaaatacaactggagtgagaaggctattcgaaggaagacaacaggaactggtaggatgaggtacatgcgtaatgttcctcgcaggttcaagagcggcttcagagagggaactcaagccaccccaaggagcaaaggagctgctgccagcacttaggtttgaaggaagacttttatgtattctagtatcagcctttaaaaaaaacatctggttggatttatgttttgtttgcttattacatgtggaatccttgatgaattatttttgatatggaagagaaagcagatactttctagcgagtttgttctcagttatgcattacgccatagttttgtcgtctatttctatagttttataatctgatatgattgattataattgaaatgaaaataatatcttttttccag

SEQ ID NO: 2144 - DNA, 581 bp, Manihot esculenta
ctctgacctagaaatacatctctcgagctagggtttctctgcatctgctgagatgggtaagggaactgggagttttggtaagagaaggaacaagacccacaccctctgcgtgaggtgtggccgacgcagcttccacctccagaagagccgttgtgcggcctgtgcttttcctgccgcccgcaagagaaaatacaactggagtgtgaaggctatccgaagaaagacaactggaactggaagaatgaggtatctccgccatgtacctcgcaggttcaagagtggtttcagagaaggcactcaagcagcacctaggaagaagggagcagcaacgtctgcttaaggcaagagatgctcattttgggcgggatttgggtatccacttatagattttgtcaacaattatgcattggaacataagaaacattgtttgatggttgttattcacttctgatgctatttagtcaattttagttttcttttctctgtatttgttttgattttgaatgaggtttttgagacaattgactattttgatttcctgatgactctcattgaagtgcataaagttcatcttttgcccc

SEQ ID NO: 2145 - DNA, 617 bp, Cedrus atlantica
gaacgaaggcggcgaggagcggagtcggcgcgcgctgcaacaatgggcaagggaacaggaagttttggtaagaggagaaacaagacccacactctttgtatccggtgtggtcgccgcagttttcatatccagaagagtagatgttctgcatgtgcttacccatcgaagcgcatccgtaaatacaactggagtgtcaaagctattcgaagaaagactactggaacaggacggatgagataccttcgtcacatgcctcgtcgttttaagaataatttcagggaggggactcaggcaacccccaagaagaaggctactgctactacattttaaatgttataagaatggccttgaaacattttgtagagttgttaacctcatttgtgagctggcacgacttgcattattttcatattatgtcataaacagctttattttctttcacaagttgagtgttttccaaactttttattgttgttacaccggatgacaaattaattagtcattttgagaattgaagttaaaattgtgttgtcacggtgcattatttacattttgacggctttgctttattttatggtctggtttacaagaaaaatgctcacttttttgtttgatag

SEQ ID NO: 2146 - DNA, 484 bp, Chelidonium majus
gtgcttctgattctgcttctacaatgggaaaaggtacaggaagtttcggtaagaggaggaacaagacccacaccctctgtgtgaggtgtggccgtcggagctaccatctccagaagagcagatgtgctgcttgtgggtaccctgctgcccgtctcaggaaatataactggagtgttaaggctttgaggaggaagaccaccggaactggaaggatgaagtacctccgcaatgttccccgcaggttcaagagtaacttcagagaaggtactcaagctgcacccaggaagattggagcagctgcatcatcttaaagagtcgaacgagatactggggagtaattttgttagtgtgttttaggttttagtcatcttgaattctgaaaaaaggatgtttgataatttgattatcaagtggtttagtagatgttttgttattttaaaatggatgaatgttttgatatcatcgacttattgcaagcattgga

SEQ ID NO: 2147 - DNA, 611 bp, Cirsium arvense
atgggtaagggaacagggagtttcggaaagaggaggaacaagacacacacactgtgtgtgaggtgtggccgccgcagctttcacctccagaagagccgctgctctgcctgcgcctatcctgctgctagagtcaggaaatacaattggagtgtgaaggcaatcagaaggaagaccactggaactggtaggatgaggtacctccgtaacgttcctcgcaggttcaagagcaacttcagagaaggtactcaagcaaccccaaggagcaaaggagccgttgccagcgcataggtttgaaggaagattttgatgtattttagtatgagctttggatttatgtttgtttgcttacgacagctggaatgctttgattttgatatggatggaaaccgatactttctattttagtttgctacatctcgtgaaattgtgccatgcattgtttttttactcttctgggatgcaattagaaaaccaaaatcagatttgttaaccataatcaaagttatggaagaaaaatctgagtttgtagtacattatgaacatccctttttgcatacatagttagtctatattacttgacacattcaaaaagaaaaaagtaccgactgccg

SEQ ID NO: 2148 - DNA, 705 bp, Cycas rumphii
  misc_feature (448)..(448): n is a, c, g, or t
  misc_feature (467)..(467): n is a, c, g, or t
  misc_feature (490)..(490): n is a, c, g, or t
  misc_feature (501)..(501): n is a, c, g, or t
  misc_feature (689)..(689): n is a, c, g, or t
tgcagagcagagaaataccgaacggcggagaggctgtctgagctgctttcaggcatcgattgatcggtcacaggggaggctcaggagaacacattcggcagcagtgtgacaatgggtaagggaacaggaagttttggtaagaggagaaacaagacccacaccttgtgcgttaggtgtgggaggcgaagtttccacatccagaagagcaggtgctctgcttgtgcatatccagctaaaaggattcgcaaatataactggagtgtaaaagctatccggagaaagacaactgggactggacggatgagatatcttcgtcatatgcctcgtcgtttcaaaaacaatttcagagaggggactcaggcagcccccaggaagaaggtggctactgcctcattttaaatatattgaagcagtggactagacatgttaacttgaggtgttgacattntcagtaatctggcaccttntatttcaagtggctaggcaactnctgcaatatgntcttgaatcatcatggtttggaccagcgtactctgtttttgtgaggaatcagaggttttccagtcttgagcaattgcattacactacaaaattttgcaaaacttttttgaaattttatttcgacgaaccaagcatattttcactggtcagctgaaactttgcataattaccatatctcataatgcttntagccttttaaattta

SEQ ID NO: 2149 - DNA, 563 bp, Cycas rumphii
ttgatcggtcacaggggaggcccgagagaacacagccatgggcaagggaacaggaagttttggtaagaggagaaacaaaacccacaccttgtgcgttaggtgtgggaggcgaagtttccatatccagaagagcaggtgctctgcttgtgcatatccagctaaacggattcgtaaatataactggagtgtaaaagctatccggagaaagacaactgggactggacggatgagatatcttcgtcatatgcctcgtcgctttaagaacaatttcagagaagggactcgggcagcccctaggaagaaggtggcctctgcctcattttaaatatatcgaagtagtggattaggcgtgttagcttgaggtgctgacatcctaagtagtctggctccttatattttaggtggctagataattggtgcaatgtgcttttgaattaccatggtttggaccggctttttctttttctgtgagggattggagattttccagatttgagcaactgcattatactatgtgctagaaagttttgcaaacatttttgaaatttcatttcaaggaacca

SEQ ID NO: 2150 - DNA, 591 bp, Cynara scolymus
  misc_feature (12)..(12): n is a, c, g, or t
gcgggggctttntcttttttctgcaatctactagttttagggttttgtttcttctcaatctgcagagatgggtaaaggaacagggagtttcggtaagaggaggaacaaaacacacacactgtgtgtgaggtgtggccggcgcagctttcatttgcagaagagccgctgctctgcttgtgcgtatcctgctgctcgcgtccgaaaatacaactggagtgtgaaagcaatcagaaggaagacaaccggaaccggccgtatgcgttaccttcgtaacgttcctcgcaggttcaagagtaacttcagggaaggcacccaagcaaccccaaggagcaaaggagcagttgccagcgcttaaaaaatgaagtacaattttgtctgttttttgtattgatactattttatatggtttccagaaaaccaatctttggattttttttgttatttctgagcactagaatgcttcatgctttatttttcaatgtgagaactgtcactttttattacttcttgcctgtcagtcgtatcgcgttttcacaggctaaaaagagaaccatggccgtgtgggaagcgaacgggccctgtgtttgtacc

SEQ ID NO: 2151 - DNA, 519 bp, Cynara scolymus
  misc_feature (38)..(38): n is a, c, g, or t
ttctagggtttcgtttctctttctttcgagacatgggnaagggaaccgggagcttcggaaagaggaggaacaagacacacacactgtgtgtgaggtgtggccgccgcagctttcacctgcagaagagccgctgctctgcctgcgcctatcctgctgctcgcgtcaggaaatacaattggagtgtgaaggcaatcagaaggaagactacaggaactggtaggatgaggtacctccgtaacgttcctcgcaggttcaagagcaactttagagaaggtactcaagcaaccccaaggagcaaaggagccgttgccagcgcataggtttgaaggaacattttgatgtattttagttgagattcggatttatgtttgtttgcttacgacaagtggaatggtttaattttgatatggatggaaaccgatactttctattttagttttgctacttttcgtgccaaacattgttttttcatatgaacatccccttggcagacatagttattcccatgccttctttttg

SEQ ID NO: 2152 - DNA, 431 bp, Taraxacum officinale
gcagggttttggtcatcttcgtttcgagacatgggtaagggaaccgggagtttcggaaagaggaggaacaagacacacacattgtgtgtgaggtgcggccgccgcagtttccaccttcaaaagagccgctgctctgcgtgcgcctatcctgctgcccgcgtcagaaagtacaactggagtgtgaaggcaatcagaaggaagactacaggaactggaaggatgaggtacctccgtaatgttccacgtaggttcaagagcaactttagagaaggtactcaagcaaccccaaggagcaagggagctgttgccagtgcttagatttaaaagaagattttaatgtattttgtttaagaaaaacaagttttggaattttaatgttttgtttgcttatgagaatttgttttgatatgagaaagaaggcagatactttc

SEQ ID NO: 2153 - DNA, 579 bp, Taraxacum officinale
cgggggttttattttttgagcctcctagttttagggttttgtttcttctcgctctgcagagatgggtaaaggaacaggaagtttcggtaagaggaggaacaagacacacacactgtgtgtgaggtgcggtcgacgcagctttcatctgcaaaagagccgctgctctgcttgtgcttatcctgctgctcgcgtcagaaaatacaactggagtgtgaaggcaatcagaaggaagaccactggaactggtcgtatgcgttaccttcgtaatgttccccgcaggttcaagagtaacttcagggaaggcactcaagcaaccccaaggagcaaaggagctgttgccaccgcttaaaacctaagtacaattttgtttgcttttctattttatagtgttttctgaaaaccagcctttggatctttgttgtttcattaataacatttctgttatctgtgagtactagtgatatgttttttctgatttttgatattgaaaagagattcttttccgttcagcttttaaaaaaaattatcctggttattttgagattgaccttcgaatataaatcatccatttttctattc

SEQ ID NO: 2154 - DNA, 567 bp, Solanum melongena
ctcccttttcgacttgcgtaattttgtagccaagacattgtcgaagcgtaaggaaaagctgcacaaatgggaaaaggaacaggaagtttcggtaagaggaggaacaagactcacacactctgtgtgagatgtggtcgtcgtagcttccatatacagaagagtcgttgttcagcttgtgcataccctgctgctcgtctcagaaaatataactggagtgtcaaggcacttagaagaaagaccactggaactggtcgcatgagatatctccgcaatgtaccccgcaggtttaagacgaacttcagagaaggtacccaagcaaccccaaggaagaagggcactgctgcggcctcttaagttggcagtttgacattgtttcattttgattttgactttccatttctcgctgatgaatcaaagttttgaatattacctttcatgttttagattggagttattgctgtttaaggtatatgtccaatgaattgctttgtgtttgataatactattcattttccactcctaatggacacttgttttttatttgagcatgatttaaaaaaagaataa

SEQ ID NO: 2155 - DNA, 990 bp, Eucalyptus grandis
atgacaaataggatggcaaaagggcccaaccattatgggccgaagccccccctcctcttcttcttctctgcagctagggtttcttctccgcctgcttcaatgggtaagggaacgggaagcttcggtaagaggaggaacaagacgcacacgctgtgcgtgcggtgcggccgccgcagcttccacctccagaagagccgttgcggtgcctgcggcttcccgtccgcccgcaagaggaagtataactggagtgtgaaggcgatccggaggaagaccaccgggaccgggaggatgaagtacctccgccacctgcctcgcaggttcaagagcggattcagagaaggtactcaagctgcgccgaggaagcaggcagctgcagcttctgcttgaggtgtcgggtgatcgtcgttcgggcgaaatttgggtacctcagccatagatttaagttgctattcgcatttggacaagttaaaattttgagaacaatcgctttgccgataaattgttgaggttatgtttttagttgttccttctgtagttggatttgagtctgaggatgggaaacttacagaaattttctatcacttcatgtccccagacggctgtgccggtatgaacatctcttattttctgcgtaggtgtgagtggttcatcttgttattgttgttgcttgctgtcctagttacatctgcagttgacatggcttcaatggggaagcaaaattacttgtttgtgatggtggtaccgtttggttgaggtgaaggagtgtgaaattacatgttttattgagtcacactggttggagctatgttgcctcttaaaggaggagatgttgcaccttcattaaatttctaccttgtatgattaagaaagttcggcagctggcttctatatttatgaattgatcgcacatgatcaaactgtctagctatgttgccatagatcttctacccgctgatccattgacatgaactctattcttgttgagtgaga

SEQ ID NO: 2156 - DNA, 605 bp, Euphorbia peplus
gtttcttcgtcctgcagcaatgggaaagggtacgggcagttttggtaagaggaggaacaagacccatactctctgtgtgaggtgtggccgccgcagcttccatctccagaagagtcgctgtgcagcctgtgctttccctgctgctcgcaagcgaaaatataactggagtgtgaaggcaattaggagaaagacaactggaactggaagaatgaggtacttgcgcaatgttccgcgtagattcaagagcggcttcagagagggtactgaagctgcacccaggaataaaggagcagcagcatcagcataagttttttggaagaagttcgacttaatttcagtacccaactatagttttcagtagggtttttactcatctgagaatcatttcatataattttgttttctagttttgccttttcatgatttagttgaacgtggtttccttaaaatgtattgtttgaattgtggacaaatgatgaatcagatttttcgtattctgctacttgtttatgcatttaagcatacgatatggttttcagtatcgaatattagaatctgttttcccacagggaatccctgcttgaaatgataaatttgcttgcact

SEQ ID NO: 2157 - DNA, 469 bp, Flaveria ramosissima
gagatccctagggttttgtatcttcatcgtctcgagagatgggcaagggaacagggagctttggaaagaggaggaacaagacacacacactgtgtgtgaggtgtggccgccgcagctttcacttgcagaagagccgatgctccgcctgtgcttatcctgctgctcgcctcaggaaatacaactggagtgtgaaggcgatcagaaggaagactaccggaactggtaggatgaggtaccttcgtaatgttccacggaggttcaagagtggtttcagagaaggaacacaagcgaccccaaggagcaaaggagccgctgccagcgcttaggtttgaaggaagattttgatgtactttagcatttcatgtttaagaaaaaaagatttgaattcatgtttgtttgcttaatcacaatcagtggaatgcttgatattttatttttgatatggagggaaagcagatactttcatttg

SEQ ID NO: 2158 - DNA, 463 bp, Flaveria ramosissima
gagatccctagggttttgtatcttcttcgtctcgagagatgggcaagggaacagggagctttggaaagaggaggaacaagacacacacactgtgtgtgaggtgtggccgccgcagcttccacctgcagaagagccgatgctccgcctgtgcttatcctgctgctcgcctcaggaaatacaactggagtgtgaaggcgatcagaaggaagactaccggaactggtaggatgaggtaccttcgtaatgtcccgcgtaggtttaagagcggttttagagaaggaacacaagcaaccccaaggagcaaaggagctgctgccagcgcttaggtttgaaggaagattttgatgtactttagcatttcatgtttaagaaaaaaggatttgaattcatgtttgtttgcttaatcactaccagtggaatgcttgatgctttatttttatatggagggaaagcagatactttc

SEQ ID NO: 2159 - DNA, 322 bp, Flaveria ramosissima
tgtttcttcatcgtctcgagagatgggcaagggaacagggagctttggaaagaggaggaacaagacacacacgctgtgtgtgaggtgtggccgccgcagctttcatctgcagaagagtagatgctcagcctgtgcttatcctgctgctcgcctcaggaaatacaactggagtgtgaaggcgatcagaaggaagactaccggaactggtaggatgaggtaccttcgtaatgttccacggaggttcaagagcggttttagagaaggaacacaagcaaccccaaggagcaaaggagctgctgccagcgcttaggtttgaaggaag

SEQ ID NO: 2160 - DNA, 816 bp, Gnetum gnemon
cgagacgagacaccgaagaaccaaatccaggagagctaggagcaggatctgctgctgcaatgggtaaaggtaccggaagttttggtaaaagaaggaacaaaacgcatacattgtgcatcagatgtgggaggcgtagctttcatctgcagaagagcagatgcggtgcctgtgcttatcctgccaagcgtattcgcaaatataactggagtgccaaggccattaggaggaagactacaggaacaggaaggatgagataccttagacatttgcccaggcgatttaagaacaacttcagagagggaactcaagcaacctccaagaaacgggcagcagttgctcagtcctaaatgatcaaatcttaattatcagtcaattgcttgcatcacggttggctgcaatgttggaaacaaaaattttgtctttttccccacggataaagattcattcaacaattgccgacaacgttcaaactttttgagtatttttaacaccacggaatatattcacgagtttcagtttactggacatattttgatttctcataagataagagttttttaatttttccaacgtttcaggaaggactactactaaaatagttaatttttgagagacaaggtaaggaattaagtttgtttacttccaaggaaaccttaaatggatgaacatgattaaaaagtgattaagaaacgcctgtataaaatctaagttgaaaaagaaataaggtttttgcacattcgtcttaatcacaggtatcattgtgagattaaaattctgaaactttctcagtaaggacggatagggaactggtagaac

SEQ ID NO: 2161 - DNA, 505 bp, Lactuca sativa
gggggtttcatattttggtgcttcctagttctagggttttgtttcttctcaatctgcggagatgggtaaaggaacagggagtttcggtaagaggaggaacaagacacacacactctgtgtgaggtgcggtcgacgcagctttcatctgcagaagagccgatgctctgcctgtgcgtatcccgctgctcgcgtcagaaaatacaactggagtgtgaaggcaatcagaaggaagaccacaggaactgggcgcatgcgttaccttcgtaatgttccccgtaggttcaagagcaacttcagggaaggcacccaagcaactccaaggagcaaaggagctgttgccaccgcttaaatttgaagtacaattttgtttgattttctactttatattgttattggaaaaccaagctttgaattattgtttttacatttataacatttttgttatttttcagtactagtaaaatgctttgtcttattcttgattttggaaagcaattaccttctt

SEQ ID NO: 2162 - DNA, 543 bp, Lactuca sativa
ggttttcaatattttggtgcttcctagttctagggttttgtttcttctcaatctgcggagatgggtaaaggaacagggagtttcggtaagaggaggaacaagacacacacactctgtgtgaggtgcggtcgacgcagctttcatctgcagaagagccgatgctctgcctgtgcgtatcccgctgctcgcgtcagaaaatacaactggagtgtgaaggcaatcagaaggaagaccacaggaactgggcgcatgcgttaccttcgtaatgttccccgtaggttcaagagcaacttcagggaaggcacccaagcaactccaaggagcaaaggagctgttgccaccgcttaaatttgaagtacaattttgtttgattttctactttatattgttattggaaaaccaagctttgaattattgtttttacatttataacatttttgttatttttcagtactagtaaaatgctttgtcttattcttgattttggaaagcaattgccttcttattgttgtttgttcagttcctactcattacttatggcct

SEQ ID NO: 2163 - DNA, 508 bp, Lactuca sativa
agatcagctaccgctagggttttggtcatcttcatttcgagacatgggtaagggaaccgggagtttcggaaagaggaggaacaagacacacacattgtgtgtgaggtgcggccgccgcagctttcaccttcaaaagagccgctgctctgcgtgtgcctatcctgctgcccgcgtcagaaaatacaactggagtgtgaaggcaatcagaaggaagacaacaggaactggaaggatgaggtaccttcgtaatgttccacgtaggttcaagagcaactttagagaagggactcaagcaaccccaaggagcaagggagctgttgccagtgcttagattcaaatgaagattttcatgtattttagtatctgaacaacaagttttggattttgatgatgtttgtttgcttatgagattttacttttgatatggaaaagaaagcagctactttctatttgattcttgcttcattgtgcctttaatctctagaatgatataactacatattgttga

SEQ ID NO: 2164 - DNA, 830 bp, Lactuca sativa
aaaaatcttattggccttttaaaccatgacaaggaaaccctagactagttccaccgcatcgtataagagccataaacgttttcagtagtcttcttttcttatttgtgagatcagctaccgctagggttttggtaatccacatttcgagacatgggtaagggaaccgggagtttcggaaagaggaggaacaagacacacacattgtgtgttaggtgcggccgccgcagctttcaccttcaaaagagccgctgttctgcgtgtgcctatcctgctgcccgcgtcagaaaatacaactggagtgtgaaggcaatcagaaggaagacaacaggaactggaaggatgaggtaccttcgtaatgttccacgtaggttcaagagcaactttagagaagggactcaagcaaccccaaggagcaagggagctgttgccagtgcttagattcaaatgaagattttcatgtattttagtatctgaacaacaagttttggattttgatgatgtttgtttgcttatgagattttacttttgatatggaaaagaaagcagctactttctattttattcttgcttcattgtgcaccctatgtttttaagcctttaatctttagaatgttataactaattattgttgaaatgctggtttatgtaatctggtttcaaattaaagtcgagagatattcacaaaagtcacaacattattacaggagatgtaggtgaaaattggcatggtttggttaaatttttacgtgtgtttgatctcattttgatgtttggttgtttgtattatatgtatgaactccttaatcagtgactttggggaagttttttcc

SEQ ID NO: 2165 - DNA, 459 bp, Lactuca sativa
gggggtttcattttttggtgcttcctagttctagggttaagtttcttctcaatctgcggagatgggtaaaggaacagggagtttcggtaagaggaggaacaagacacacacactgtgtgtgaggtgcggtcgtcgcagtttccatctgcagaagagccgatgctctgcttgtgcgtatcctgctgctcgcgtcagaaagtacaactggagtgttaaggcaataagaaggaagaccacaggaactggtcgtatgcgttaccttcgaaatgttcccagaaggttcaagagtaacttcagggaaggcactcaggcaactccaaggagcaaaggagcagttgccaccgcttaaatttgaagtacaattttgtttgcttttcttatttatattgttattggaaaaccaacctttggattattgtttttacattaataacatttttgttattttggagcactagt

SEQ ID NO: 2166 - DNA, 573 bp, Lotus japonicus
tcttccttccccaatatagctgcgcttcactctgtaaccctaatctgcagaacctgcttcaatggggaagggaacagggtccttcggtaagcgcaggaacaagacccacactctctgtgtgaggtgtggccgccgcagtttccatctccagaagagtcgctgcgccgcgtgcgctttccccgccgcacgcaagaggaaatataactggagtgtcaaagcgatccgaagaaagaccaccggaactggcaggatgaggtacttgcgtaacgtgcctcgccggttcaagagcggattcagagaagggactgaagctgcacccaggaacaagggagcagcagctactgcttaagactttcgaggatcgttgttttgctttgctgggtactgagttatagaattagacattttgtttttgctggggacaagtctcttagaacatttgttttttgcagcctcattccttcaattaacttgtacttggctttgtgtttcaacatgattataagactttttgattgcccggttggattgtatgacatttatagttttggtgttaaatggttctctttggga

SEQ ID NO: 2167 - DNA, 473 bp, Lippia dulcis
caagggaactgggagctttggaaagaggaggaacaagacacacacactgtgtgtgaggtgcggtcgccgcagcttccacctccagaagagccgctgctccgcctgtgcttatcctgctgctcgcaagaggacatacaactggagtgtgaaggccattcgccgaaagacaaccggtactgggcgcatgaggtatctccgcaatgtgccccgccgattcaagaccaacttcagagaaggtactgaagctgcaccaaggaagaaggccgttgctgcatctgcttaaaagactaatcttgagaacaaatgaattttgaaagccgtttgaaggcaattttgccaattggaattcttagtttatttctacttatgttgatgtactttgttttgaattttaatacgaaagtctgaaagaccaatcttttatgccgtttgcttcaaatattttatcttattagttgtactctttaacacct

SEQ ID NO: 2168 - DNA, 803 bp, Pinus taeda
gggggatttttgaaacaatggacgactaaaaataaaggcgtatggatttagaaacctatttgaaacaatggacgactaaaaataaaggcgtatggatttagaaacctatttgaaacaatggacgactaaaaataaaggcgtcgtagggtttttagatttgataaaacccccgatcgagacctaaacttgttcttctgtttgggacgaaggctgtgaggagcggaggattcagcgtgtgctgcaacaatgggtaagggaacgggaagttttggtaagaggagaaataagacccacactctatgtatacggtgtggtcgccgcagttttcatatccagaagagtagatgttctgcatgtgcttacccatcaaagcgcatccgtaaatacaactggagtgtcaaggctattcggagaaagactacaggaacaggacgaatgagatacctgcgtcacatgcctcgtcgtttcaagaataatttccgggagggtacccaggcaacccccaagaagaaggctactgcaaccacattttaaatgatttaagaatgaccctgaaatgttttgtagagtttttaaccacgtttgtgagctggcacaacttgcattattttcatatgctgtcatagacagttttattttctttcacaactcatagttttcaagtaaaactcttttccatatttttgattgaggttgtatcggatgacaaattaattcaagtcattttgagaatttaagttaaatgtttttacattggttgacaacatgtgcaatattttcatatttaatttagctttgcttta

SEQ ID NO: 2169 - DNA, 910 bp, Pinus taeda
tgcacacagttctcccagaaccagggagttaacgtatatgaaacagcaggaaaatcataatgacatagggtctatttaagagagaaaattaaagaaagatgagcatccaacaaatcaagccagggataagttccggagcgccggtaagcctcgttcgtcagctggtataaatatgtactccgatgacaacagtgaacagagcaaagagcccgaagaatataagtgtgtgtatcagaatcgatctgccgctagtctcgaagttaccgaagtcgatgctccgacagttgccgggaaactgaaacaagaaccccggcgacagcaagacgaacaaaattacccccacggcaaccggcccccagtccgccatgataatgacgaaggctgtgaggagcggaggattcagcgtgtgctgcaacaatgggtaagggaacgggaagttttggtaagaggagaaataagacccacactctatgtatacggtgtggtcgccgcagttttcatatccagaagagtagatgttctgcatgtgcttacccatcaaagcgcatccgtaaatacaactggagtgtcaaggctattcggagaaagactacaggaacaggacgaatgagatacctgcgtcacatgcctcgtcgtttcaagaataatttccgggaggggacccaggcaacccccaagaagaaggctactgcaaccacattttaaatgatttaagaatgaccctgaaatgttttgtagagtttttaaccacgtttgtgagctggcacaacttgcattattttcatatgctgtcatagacagttttattttctttcacaactcgtagttttcaagtaaaactcttttccatatttttgattgaggttgtatcggatgacaaattaattcaagtcattttgagaatttaagt

SEQ ID NO: 2170 - DNA, 669 bp, Podocarpus macrophillus
ggtttgtgtaaaaattagggcgagatagaaagggtttccctaagaaggccgatcttgtttttcattctacatcggtgccgccgagacgacaccagcggagcgagagcagatcgtgggtttcgtagcaggcgacaatgggtaaaggaacaggtagctttggtaagaggagaaacaagacccacacattgtgcattaggtgtggtagaagaagttttcacattcaaaagagtagatgttctgcttgtgcatacccagctaaacgcatccgcaaatacaactggagtgtaaaggcaatacgaaggaagactactgggactggacggatgagatatcttcgtcatatgcctcgtcgtttcaagaacaatttcagagaggggactcaggccacacctaggaagaaggctgcttccacccaattttaaatataaaagcagtgggctccagatatttaatcaggacattgttaccaaacaacacttgctttaaatggctatttggtgttggctgtaacgtgcaattggattgttgtggtttgtcccacagttttttaggtaaattaacctgttgttataatttccagcatcagaagttatttagcaaaattttgaaaaattttcgatattcaactgaagtaattctttatttagtgaaagttcgaaatatattttt

SEQ ID NO: 2171 - DNA, 876 bp, Populus trichocarpa
ctctctctacggcataaaattttgtccccggtgatagggtttttgctgctcaagaagaagaagaaatggggaaaggaacagggagttttggtaagagaaggaacaagacacacactctctgtgtgcgatgcggtcgccgcagctttcatctccagaaaagccgctgtagtgcttgtgcctttcctgctgcccgtgtcagaaaatataactggagtgtgaaggctatccgcagaaagaccactggaactggccgcatgaagtacctccgtcacctaccacgcaggttcaagactaactttagagaaggtactcaagctactccaaggaacaagggagctgcagcagcatagtaaggcttagaaggggaatgaaagtctgttttgtttcaatgcttttaaatttgcaaacaagaagttttgaattgttgtttaattgctgttacttattagccattgaaagatgttttcaacaatggagacctacgaatgtttaccattctagtatggttatggatggttatcaccttttcacgtattctataggtctgcccatcacttacttctttgtctacagtcgtatgatatttgatagtttgacagcaatgaaatgcatctatggtgcttaaagagcatggattggttgaatggtttttactaacaaaatccttgccaattccagccgcagtccatattgaggactgagcttactggctccaaacctgattgtgtatgtttgagaggcttgagtgcaggattttgtagtctcggtgtgctttgtgctctattacaaagcatcattttgattaaatgtctgagccttgtttatttgttattattccaagtttgaccatgttaaggaaaacaaaaattcaggctc

SEQ ID NO: 2172 - DNA, 700 bp, Primula obconica
taaagccgctcttcactttctctctctctcccccagacgacgactaggttttccgcagcagcagccaagcaatgacgaagggtacggggagtttcggaaagaggaggaacaagacgcacacgctgtgcgtgagatgcggccgccggagcttccatcttcagaagagccgctgctccgcctgtgctttccccgccgctcgcaagaggacctacaactggagcgtgaaagccatcaggaggaagacaactggaacaggtcgcatgaggtacctgcgtaatgtacctcgcagattcaagagtggcttcagagagggaactgaagcagccccacggaaaaagggagcagcagcttctgcttgagcaagttgattggttttagtgaggcttcagctgggttttacatcatagtctcatcttgcattttcaattttcagaacaaagttaaattttgcgagcttcatttgaatggatgatgttgttctatctcaatatttcagttgtactttcacttttttggtttttaatggattatgtgtttttgtacatgaattatgttgttcttgtggcgtatagtttaatgtgtcctttctgtttgttctaaatagtataaaaatagctacaatgtagcctttattaaaaccacctgcgacggtaaacacaactgactcaagacgaagtagatattctttcataactgaata

SEQ ID NO: 2173 - DNA, 622 bp, Pseudotsuga menziesii
aaggcggtgaggagcggaggagtcggcgcgatctgcaacaatgggtaagggaacaggaagttttggtaagaggagaaataagacccacactctttgtatccggtgtggtcgccgaagctttcatatccagaagagtagatgttctgcgtgtgcctacccatcaaagcgcatccgtaaatacaactggagtgtcaaagctattcggagaaagactactgggacaggacgaatgagataccttcgtgacatgcctcggcgtttcaagaataacttcagggaggggactcaggcaacccccaagaagaaggctgcggctaccacattttaaatgttttaagaatggccctgaaatattttgtagaggttttaacatcatttgtgagctggcataacttgcattattttcatacgctgttatagacagctttattttatttcccgactggtggttttcaagtaaacaattttccaaacttgcgattgatgttgtaccggatggcaagttaattagtcattttgagaattcaagttaaaattttctatttgctccaggtgcattattttcaaatgttgttgacaactttgtgttattttattccatcatttacaagaaaaacgcttt

SEQ ID NO: 2174 - DNA, 708 bp, Pseudotsuga menziesii
gtttattttggagttcttattaatgcggaaactctttcgttttatcggcatttgaaggaaggtaaaggggagccagcgtattcttacgccgtcgcgaaaatgggtaagggaacaggaagctttggtaaaaggagaaacaagacacacactctttgtatccggtgcggtcgtcgcagttttcatatccagaagagtagatgttctgcatgtgcttacccggcaaagcgcatacgcaaatacaactggagcgtcaaagctattcgaagaaagactacagggacaggaagaatgagatacattcgtcacatgccccgacgttttaagaacaacttcagggaggggacacaggcaactcccaggaagaaggcctctgctacctcgttttaaatgtattaagaatggacctgaaatattgagttgagttgttgacctcctttgtgagctgctgccttttgcattattttggaaattgttatatacagctttacttttatatttgaacttttgcatttttgaagaaaatgtctttccaaaacattgattgacgttgtactggcactgtttttggcaaagaaatcagaaagttgttttgaagattcaacaagatgtttactatgtatgttaatcatgtgtacagtttagtgctattcaactttgagagagtggattttaagttcgagatttcatgcatgctatgtacaaatttta

SEQ ID NO: 2175 - DNA, 535 bp, Rosa hybrid cultivar
gagtctaaacagctctctctcagtagcagcttagggtttctctaccgcacccatgggtaagggaactggaagtttcggtaagaggaggaacaagacccacaccctccgcgtgaggtgtggccgtcacagcttccatctccagaagagtcgctgctccgcttgtgcctacccagctgcccgcaccaggaaattcaactggagtgtgaaggccatcaggaggaagaccaccgggaccggaaggatgaggtatctgcgcaatgtcccacgcaggttcaagagcggcttcagagaaggtaccgaagctgcaccaaggaagaagggagctgcagcttctgcttaagtatgtgagagtgtcattttgggtaccggtcatagctttactagggcgctttatgattctggacaagttctttaagaacattgttattgttattatcgagggcaaaacttctattattgctttagttgctttgagttttgaacatgaaatgtaccatactagttttacttttctaattacatgatggtttgaaga

SEQ ID NO: 2176 - DNA, 550 bp, Carthamus tinctorius
  misc_feature (63)..(63): n is a, c, g, or t
tgcgggggctttactttcatttctctcggatctactagttttctagggttttgtttcttctcnatctgcagagatgggtaaaggaacaggtagtttcggtaagaggaggaacaaaacacacacactgtgtgtgaggtgtggccggcgcagctttcatctccagaagagccgctgctctgcttgtgcctatcctgctgctcgagtccgaaaatacaactggagtgtgaaggctatcagaaggaagactaccggaaccggccgtatgcgttacctccgtaatgttccccgcaggttcaagagtaacttcagggaaggcactcaagcaaccccaaggagcaaaggagcagttgccagcgcatagaaatgaagtgcaattttgtctgcttttgtactgctactattttatatggttatcagaaaaccaacttttggatatttgtttgtttactactgttgcaattaaatgcaattctgttatttctgagcactagaatcattaatgttaatgttttttatattgtaaaatgggcggcttctattacttttcgct

SEQ ID NO: 2177 - DNA, 593 bp, Senecio madagascariensis
acgcggggccagattaagctcacaaaaaaagaggcagcatctccgcagcggcaaacaatgacgaaaggtacaggaagtttcggtaagcgtaggaacaagacacacacactgtgtgttcgttgtggacgtcggagctttcatctccagaaaagtcgatgctctgcttgtgcttatcccgctgctcgtgtcaggaaatacaactggagtgagaaggcgattaggaggaagactactggtactggacgcatgaggtatatgcgtaatgttcctcgcagattcaagagcggtttcagagaaggtacccaagctgctcccaggaagatagctgcatcatcttctacttaaaatggtgaggaaaagcatggaagttgattatcgggtatcaatcaagcgtctttctgattgggcaattagtttagttgatcgtcattatgtgctgttgatcccgttatctctatctagacttgttttaaattttgttgttctgtttttaatgatcgctttacatttggatttaattgtttggaatcttagaccgatttttctctttaacattttattagctcttcattttagttttgattttgtgttaa

SEQ ID NO: 2178 - DNA, 552 bp, Silene vulgaris
ccttcattcctcatccttgacacttaaccatggggaaaggaacaggtagttttggtaaaagaaggaacaagacacacactttgtgcgtccgttgtggccgtcgcagtttccatcttcagaaatctcgttgctctgcttgtgcttttcctgctgctcgtactcgcaaatacaattggagtgtgaaagcgattaggaggaagacaacaggtactggccgtatgaggtatctccgtaatgtccctcgccgtttcaagactggtttcagagaaggcactcaagctgcaccaaggaagcaagtcgcagctgcatcagcttaaaagagaagagattttcgtgtaagagggtgttttttgtttgagtatatcagctagtaacttcatttttgcatatctcaagactcagtattcgaactagcttctgcctttttatttcagacattgaatttgaatgagaatcgtagtactatttggttcctatttccttcaaacgaatgtagtagcattgaatttaatggctatatgatgttaacgatttctgtcaggcaagtcattc

SEQ ID NO: 2179 - DNA, 540 bp, Silene vulgaris
ttggatttgaaaccctaaatcgtccattcttcgcaatccgccatgggtaaaggaacaggaagtttcggaaagagaaggaacaagactcatactctctgcgtacgatgtggtcgtcgcagtttccatcttcagaagagtcgttgttctgcttgtgcttttcccgctgctcgtactaggaagtataactggagtgtcaaggctatcaggaggaagacaactggaactggtcgtatgaggtacctccgcaatgtcccacgtcgtttcaagactggtttcagagaaggcacccaagctgcaccaaggaagcaagtggcagctgcatcttcctaaagagatctgctgtaaaaggaggttttgattttggtacatctagtgataacttaccatcgttgcatttctgaaatgtttgaactagtttatttttatttgagacattgtatttccattgcaacagtactactgctggtctctgtttttctatgaaagaatgtagtatctatagatatttagaaactaaatggtgattttgagattctataa

SEQ ID NO: 2180 - DNA, 873 bp, Glycine max
atagatagctccttcaattagggtttttgtgatctgcaagctacgatgggtaagggaacggggagtttcggtaagagaaggaacaagacccacaccctctgtgtgaggtgtggccgccgcagtttccacctccagaagagtcgttgcgccgcgtgcgctttccccgctgcgcgcaccaggaaatataactggagcgtgaaggccattaggagaaagaccaccggaactggaaggatgaggtacttgcgtaacgtgccccgtagatttaagagtggcttcagagacggtaccgaagctgcacccaggaagagaggagctgctgcctctacctaagctttgaataatagcaatttttgctgggtcagtgaattatataggatttaatgtttctatgttgatgccgagctctttggaacacgtttctttctgtcgttttaatttcatttaatatgtagtggctttgtatttcgacgtgaggattgcaaggaatttttgttttttcaacgagggtttttgacatccatattctggcttatcattctgggcatgccatttggtactgtggttcaattagataaatttagggtaagacttatttggtattagttttttttattatggtttattgggtgttagttattgtcaagaattgttgagttttcatgccttggctttagattatgttctttctaaacgtaggtattaattaactgtaatactgtacctcggtagaaacataacgctgctaatctcaagtaatagggtgtgtaatcatatttgcgtatcagggtctcactttattgtatttattggggatttatgagtgttctgatcatgtatgaaaattcttgtacttggtgtagttagtacttg

SEQ ID NO: 2181 - DNA, 1153 bp, Glycine max
cagctacatagctccatcactgcagcattagggtttatcatctgcttcaatggggaagggaacagggagcttcggtaagaggaggaacaagacccacactctctgtgtgaggtgtggccgccgcagcttccacctccagaagagtcgctgcgccgcttgtgctttccccgctgcacgcacgcggaaatataactggagcgtcaaggcaattcgcagaaagaccaccggaactggcaggatgagatacttgcgtaacgtgcctcgccgtttcaagagtggcttcagagaaggtaccgaagctgcaccaaggaagaagggagcagctaccactgcatagacctttcaaagatcgttctcgttgggtacggatttacaggaatagattgctttttgtgcttttggcaagtattttggaacacttatttttagagtctcattgcttctttatcccccatttaatttgtagttgctttatattcaacaagaccataagacttattgattgttcacttggttttatgacatttatagtttatggtttaaaacggttttcaattggtgaatattggatagagtggaagacacccctaactggatatcccacaatactatactaggcatttgtcatgaaatttgccagttttaacaagagagaaagctttaatctgctgttggaagttagttttggtaaccttgcttgcttccactctgaccgcataaacagttttgttcacttgtttcagtgtgtacccgaaaaacacaaatttttctgataatgtgcctgaaatcaaagttagtttctaggtttcttttataatgtataacttgcataatacacggatatgctggatgtctgattgattagtgtcgttaaattaagtggcaattatgtctttggagaacattggtgtcctattctgctagagcaatattttaattttgatgtcttcatcttaagaggccatgtttcactagtatactaatctgcctatactaagagcttttgtaatttggatttgttttgccccctacctttgtaaaacaaatgctcctgcttttaataactgaggttcaaaagtttgggtagggatgaatttccatatattcatgattagctgctatagttagatcagtatgcagtgttccaaaatga

SEQ ID NO: 2182 - DNA, 669 bp, Glycine max
aaacccctgtcatattgaacccagggcaacagatatataaatacaaatcgccacgccgctacgtcttcttcagccatttagctccatagctgcagcattagggtttttcatctgcttcaatggggaagggaacagggagttttggtaagagaaggaacaagactcacactctctgtgtgaggtgtggccgccgcagcttccatctccagaagagtcgttgcgccgcttgtgctttccccgccgcacgcactaggaaatataactggagcgtcaaggcaatccgcagaaagaccaccggaactggcaggatgaggtacttgcgtaacgtgcctcgccgattcaagagtggcttcagagaaggtaccgaagctgcacctaggaagaagggagcagctaccactgcataaacctgtcaaagatcgttgtttgctgggtacggacttacaagaatagattgcttttttgtgcttatggcaagtattttggaacaattatttttagagtctgattgctactttgtccttcatttaatttgtagttgctttatatttcaacaagatcataagacttattgattattcagtcggctatgttacatttatagtttgtggtttaagcagttttcaattagtgaatactggatagaatgaaagacatccctacctggct

SEQ ID NO: 2183 - DNA, 490 bp, Euphorbia esula
ctgcagcaatgggaaagggtacgggcagttttggtaagaggaggaacaagacccatactctctgtgtgaggtgtggccgccgcagcttccatctccagaagagtcgctgtgcagcctgtgctttccctgctgctcgcaagcgaaaatataactggagtgtgaaggcaattaggagaaagacaactggaactggaagaatgaggtacttgcgcaatgttccgcgtagattcaagagcggcttcagagagggtactgaagctgcacccaggaataaaggagcagcagcatcagcataagttttttggaagaagttcgacttaatttcagtacccaactatagttttcagtagggtttttactcatctgagaatcatttcatataattttgttttctagttttgccttttcatgatttagttgaacgtggtttccttaaaatgtattgtttgaattgtggacaaatgatgaatcagatttttcgtattctgct

SEQ ID NO: 2184 - DNA, 468 bp, Helianthus annuus
ggggttttgtttcttctgaatctgcagcagagaagagatgggtaaaggaacagggagttttggtaagaggaggaacaaaacacacacactgtgtgtaagatgtggtagacgcagctttcatttgcagaagagtaggtgctctgcgtgtgcgtatcctgctgctcgtgttagaaagtataactggagtgagaaggctatccgaaggaagaccacaggtactggtcgtatgcgttaccttcgtaatgttccccgcaggttcaagagcaacttcagggaaggtactcaagcaacaccaaggaccaaaggagctgctgctagcacttgagaatgatagtacaattttgtttggttttgtgttactactacttgttcttggggattttgtttgtttactgattcttgtttttaaagttttgcatgtttttgagcactagaaagctattcatttgaagtacatctttgcatttt

SEQ ID NO: 2185 - DNA, 458 bp, Helianthus annuus
gggttttgtttcttctgaatctgcagcagagaagagatgggtaaaggaacagggagttttggtaagaggaggaacaaaacacacacactgtgtgtaagatgtggtagacgcagctttcatttgcagaagagtaggtgctctgcgtgtgcgtatcctgctgctcgtgttagaaagtataactggagtgagaaggctatccgaaggaagaccacaggtactggtcgtatgcgttaccttcgtaatgttccccgcaggttcaagagcaacttcagggaaggtactcaagcaacaccaaggaccaaaggagctgctgctagcacttgagaatgatagtacaattttgtttggttttgtgttactactacttgttcttggggattttgtttgtttactgattcttgtttttaaagttttgcctgtttttgagcactagaaagctattcatttgtgttcagttt

SEQ ID NO: 2186 - DNA, 457 bp, Helianthus annuus
agggttttgtttcttctgaatctgcagcagagaagagatgggtaaaggaacaggaagttttggtaagaggaggaacaaaacacacacactgtgtgtaagatgtggtagacgcagctttcatttgcagaaaagtaggtgctctgcgtgtgcgtatcctgctgctcgtgttagaaagtataactggagtgagaaggctatccgaaggaagaccacaggtactggtcgtatgcgttaccttcgtaatgttccccgcaggttcaagagcaacttcagggaaggtactcaagcaacaccaaggaccaaaggagctgctgctagcacttaagaatgaactacaattttgtttggtcttgtttcagaaaatctttcttggggattttgtttgtttactgattcttgtttttaaagttttgcctgtttttaactgaacacaaatgaatagctttagatcggaaga

SEQ ID NO: 2187 - DNA, 544 bp, Helianthus annuus
gggttttgtttcttctgaatctgcagcagagaagagatgggtaaaggaacaggaagttttggtaagaggaggaacaaaacacacacactgtgtgtaagatgtggtagacgcagctttcatttgcagaaaagtaggtgctctgcgtgtgcgtatcctgctgctcgtgttagaaagtataactggagtgagaaggctatccgaaggaagaccacaggtactggtcgtatgcgttaccttcgtaatgttccccgcaggttcaagagcaacttcagggaaggtactcaagcaacaccaaggaccaaaggagctgctgctagcacttaagaatgaactacaattttgtttggtcttgtttcagaaaatctttcttggggattttgtttgtttactgattcttgtttttaaagttttgcctgtttttgagcactagaaagctattcatttgtgttcagttttttgcaaaaaaaaaaatttaattctttttttcccccctttcttttacctgaactccccccctgtaatcttatcccttttgggttaccct

SEQ ID NO: 2188 - DNA, 326 bp, Helianthus annuus
ggatttgtttcagacatgggtaagggaaccgggagtttcggaaagaggaggaacaagacacacacattgtgtgtgaggtgcggccgccgcagtttccaccttcaaaagagccgctgctctgcgtgcgcctatcctgctgcccgcgtcagaaagtacaactggagtgtgaaggcaatcagaaggaagactacaggaactggaaggatgaggtacctccgtaatgttccacgtaggttcaagagcaactttagagaaggtactcaagcaaccccaaggagcaagggagctgttgccagtgcttagatttaaaagaagattttaatgta

SEQ ID NO: 2189 - DNA, 705 bp, Taxus baccata
gtaaggtaaataacaaacgacaagaagtaacgtcgggggtttgggcgaggcggaggcgcaggcgcagaaacagaagcagacgtaaagaagtgaagttttgatcagccagagcagagcagatcagcaatgggaaagggaacaggaagtttcggtaagaggaggaacaagacgcatactctttgcgtgcgttgtggccgacgtagctttcacattcagaagagtcggtgttctgcctgcgcgtaccctgccgcccgtattcgcaaatataactggagtgtgaaagctattcggagaaagactacagggactggacgaatgagataccttcgtcacatgccccgtcgtttcaagaataatttcagggagggtactcaaccaacccccaggaagaaggctgctgccacctccttttaatttgttaggaatggatgtgatgagttcttttggatggaactgctttccatctttttcgattgatattgtgataagactttttttttaaaagttatcaaaattatttagagctctgaaatagatggtttctgagtacgttaatgatttctcataccttttaattttgagatgctaatcctgcatgttttgaaaaaaagaacgttttgaacaattttgtcaaaagtatgttttattttccttaaaagttatgaaccaaaatgttttcaaggagtaaaacagtactttctattt

SEQ ID NO: 2190 - DNA, 586 bp, Nicotiana tabacum
cggggggagtcgatcaggaggaggacgctagggtttctgcaactgcactgcaatggggaagggaacagggagtttcggtaagaggaggaacaagactcacacactatgtgtgaggtgcggtcgccgcagtttccatctccagaagagccgttgttctgcttgtgcttatcctgctgcccgtttgaggaaatataactggagcgagaaggcactccgcagaaagacaactggtactggacgcatgaggtaccttcgcaatgttcctcgcagattcaagaccggtttcagagaagggactgaagctgcaccaaggaagaaggctgcagcagtttctgcttgaggccctttgagagggttattgagggagggtactttttataacattagcatcattttggttattttctggatttgatgcccaatcaaagttagaagtgcttaaattttggaaatgtgttgttgaaattggcattttggcattaagggattttataggccgttttcaatttttggttgctccgaagtctgaactccctttccatgtcttaagtttttttgaatttgaagtttgaggttttgtttacct

SEQ ID NO: 2191 - DNA, 486 bp, Nicotiana tabacum
  misc_feature (44)..(44): n is a, c, g, or t
ccgccgtatattattagggttcttccgctccgccgcagaaatgngaaaaggaacggggagttttgggaagaggaggaacaagacacacacactatgtgtgaggtgtgggcgtcgcagtttccacatccagaagagccgctgctccgcttgtgcttaccctgctgctcgcctcagaaaatataactggagcgtcaaggcacttagaagaaagaccactggaactggtcgcatgaggtatctccgcaatgtgccccgcaggttcaagactaacttcagagaaggtaccgaggcaactccaaggaagaagggtgctgctgtagcctcttaagtctctgaactctatttcaatctgaatattttccttagtattgggatatttgttttgagtattaacacacatttgttagtacggagctatttctattcgagatatagttgtaatactgattctcttttgttttatatattgagatagttattttgtgt

SEQ ID NO: 2192 - DNA, 551 bp, Triphysaria pusilla
agctcaggaagaaaatagctctttagagtgtatctgcagctccacagcaatgaccaagggaacaggaagcttcggtaagaggagaaacaaaacacacactctgtgtgtgaggtgtggccgccgcagcttccacctccagaagagccgatgctccgcctgtgcttatccggcggctcgcaagaggacatataactggtctgtgaaggctatccgtagaaagactaccggaaccggacgtatgaggtatcttcgtaatgtgccccgcagattcaagaccaactttagagaaggtactcaagctgcaccaaggaagaaggctgtagctgcttcagcttaaggttctttgttttggagggtaattttgattgtattttttgttgctgccatctgggaattgttagagaacacaatcgaagtgtgggaacatgctttttaccccatgagctacctaatcagtttatttatttttcttgtgttttcgatatcgttttgatacatatggatgatagaccttttattgctttgaagtttgtccaatttctgcagcactc

SEQ ID NO: 2193 - DNA, 566 bp, Triphysaria pusilla
acgccgctctcattttctcaacctcgagagagctcagcagaagaactagggtgtctgcaactccacagccatgaccaagggaacaggaagtttcggtaagaggaggaacaagacacacacactgtgtgtcaggtgcggccgccgcagtttccaccttcagaagagccgatgctcagcctgcgcttaccctgctgctcgcaagaggacctataactggagtgtgaaggctattcgcagaaagactactggaactggacgcatgaggtacctccgcaatgtgcccaaaagattcaagacaaacttcagagaaggtacccaagctgccccaaggaagaaggctgctgctgcatctgcttaagttggttttaatttgggttctacttttcaattgatattttgaaagaattagtgaacaaaagaattttgggaaaccatttgagttttgtttcaaatattgttggattactttgtttgacattttattacatgtttgaaagactaatgctatttttctcttgtggcctctgttattttcatgttatagttgctaaaaaaaaaaaaaaaac

SEQ ID NO: 2194 - DNA, 490 bp, Valeriana officinalis
tgagttccgccgaagaacaccaaaaatggggaaagcaggcaaaggaacgggaagtttcggtaagagaaggaacaaaacacacacactctgtgtcagatgtggtcgccggagtttccatctccagaagagccgatgctctgcttgtgcttttccggcagctcgggtgaggaaatacaactggagtgagaaggccattaggaggaagacgactggaactggtcgtatgaggcatcttcgccatcttcctcgccgcttcaagagtaacttcagagaaggcactcaagctgctcccaggaacaaatctgcatctgctgcgtctgcttaagaggtgatcttgatattctgcttcttattatcagctttccttttaaattttgaaactctggtgatacttttgatgctttttttatttgtcgtttgaggatattgtagcttgattttgctcgttggttttttaatatgtattatggattttggtacttaaaaacgt

SEQ ID NO: 2195 - DNA, 629 bp, Fagopyrum esculentum
aacttcaaggcgtttaaccatctaaagcctctgaagaatttagaagaaccgagctgcaagtgcaacaatggggaagggaacaggcagttttggtaagaggaggaacaagacgcacacgctttgcgtccgttgtggacgccggagtttccaccttcaaaagagccgttgctctgcttgcgcctaccctgccgctcgtctcaggaagtataactggagtgtcaaagcaatcagaagaaagactactggaactggacggatgaggtatctccgcaatgttccaaggcgattcaagactggttttagagaaggaactcaagcaactccaaggaagcaagtggcagcctcatcttaaagattttaaggcgacattttgtgtaatccattcagtttttgttaccttttcttgaacattgctaaatcaattttcagatattctattagggttttttatcccaaagttttattggcagtgagatgttattaaagataccttatcgtggtatgccattgacttgatgaagtttgttgttttggatcttactatattgttagcctgctattatttcataacatttcttagtaggtgataggcattacagagaaatcgttgcttcatttgattacaatag

SEQ ID NO: 2196 - DNA, 594 bp, Fraxinus spp
tgggaaagggaacaggaagttttggtaagcgaaggaacaaaactcacacactgtgtgtgagatgcggccgccgtagcttccacatccagaagagccgttgctcggcctgtgcttaccccgccgcacgcgtaaggaaatataactggagtgtcaaggctatacgaagaaagaccactggaactggtcgaatgagatatctccgtcatgtagctgttaggttcaagagtaacttcagagaaggcactcaagcacctccaagaaagaagggtgctgctgcctcataaggttttgaaggaaatcccgagtattttagcaccaatgtatctttaattttgtgagagaatcgagttttggtttattcagagtgttgtttatcaaccagtgatgatattttggtaatcagtatgtttttgggtgatggttgatgtctcaatgcaatcacaaattgattacagcggaaaatatttgtgcttactaatggataatcaagagttgatatttacataaatttcactctgcttgtatactctttattctacataatcaatttagttattgccaaatgctataggagataattcaatcaatttcatc

SEQ ID NO: 2197 - DNA, 610 bp, Silene vulgaris
acacaatcacaagctagggtttccgccattgacgacgcaaaatgggaaaaggaacaggaagtttcggaaagaggagaaacaagacacatacattgtgtgttcgatgtggtcgaagaagtttccatcttcaaaagagccgttgctccgcttgtgctttccccgctgctcgtacccgaaagtataactggagtgtcaaggcaatcaggaggaagacaaccggaactggtcgtatgaggtatctgcgcaatgtcccgagaaggttcaagactggtttcagagaaggcactcaagcagccccaaggaagcaagttgcagctacctcttaagtttatttctccgtgttttgcttgtttagcgactgcttttatgagaattcctgtattgaggtgactaaaggttattttggtttattgttggaacattggtggaatttgtactttttgtagtagtaatcagatgagtagcgctttaggtccttcatacggagtattacctttcctcgcttttaacccgtttttattaaacagccggaggaacaggaacacaaaaaggataacgcaaggtcacacgccaatgtctagttggtggtggaaaaccgaatgacacaatc

SEQ ID NO: 2198 - DNA, 471 bp, Ambrosia trifida
ggggaaaggtacaggaagacttcggtaaaagaagaaacaaaacacacacactgtgtgttcgctgtggtcgccgtagcttccatctacagaagagccgatgctctgcttgtgcttatcctgctgctcgtgtacggaaatataattggagtgagaaggcgatcaggaggaagacgactggaactggtcgcatgaggtatcttcgtaatgtgcctcgtagattcaagagcggtttcagagaaggcactcaagctgctcctcgaaagaaagctgcagctgattcagcttaagcgtccgatcagaactgatatactggtaccgattaagcatatttttcggttttccttggagcatttagtgtattgaacatcatttggcaattctatacggccatcatttggatacttctgatttatgacatgttttgattcggttgtttgggatattaaacattttaagctctttgttggttac

SEQ ID NO: 2199 - DNA, 515 bp, Artemisia annua
acaatgggaaaaggaacagggagtttggtaagaggaggaacaagacacacacactgtgtgtacgatgtggtcggaggagtttccatttgcagaagagtcgatgttctgcttgtgcttatccagctgctcgtgtcaggaaatacaactggagtgagaaggcaatcaggaggaagacaaccggtactggtcgcatgaggtatcttcgtaacgtgcctcgcagattcaagagcggcttcagagaaggtactcaagctgtccctagaaaggttgcagctgcttctgcttgaaactttgaggatttacatcaaacttgatcttcgggtactgattgagcgtattttggttagggctgttggtataattgaacatcagttggtgctatttcatctcatttgaaattttgtttttgaattttgttattatgattttgcggatcatgtctcattttgattttaaaatgatttggatgttaaccaatgttgctcttagatgtttcatatgatctgttatagcta

SEQ ID NO: 2200 - DNA, 304 bp, Manihot esculenta
aaatgatgaaaattgcagggtaagggaacagggagttttggtaagaggaggaacaagacccacaccctttgtgtcaggtgtggccgccggagcttccacctccagaagagccgttgtgctgcctgtgctttccctgctgctcgcaagaggaagtataattggagtgtgaaggccattagaagaaagacaactggaactggaagaatgagatacctgcgtcatgtacctcgcaggttcaagagtggtttcagagaaggcactcaagcagcaccaaggaagaagggagctgcaacatctgcttaag

SEQ ID NO: 2201 - DNA, 432 bp, Flaveria ramosissima
gagatccctagggttttgtttcttcatcgtctcgagagatgggcaagggaacagggagctttggaaagaggaggaacaagacacacaccctgtgtgtgaggtgtggccgccgcagcttccacctgcagaagagccgatgctccgcctgtgcttatcctgctgctcgcctcaggaaatcaactggagcgtgaaggcgatcagaaggaagactactggaactggtaggatgaggtaccttcgtaatgtccctcgtaggttcaagagcggtttcagagaaggaacacaagcaaccctaggagcaaaggagctgctgccagcgcttaggtttgaaggaaagatttcgatgtactttagcatttgatgtttaagaaaaaaagatttagaattcatgtttgtttgcttaatcactacttgatgctattatttttatat

SEQ ID NO: 2202 - DNA, 551 bp, Panax ginseng
ggggcccgacagtcgaagctagggttagggtttgatatacatttcgcgaaatggggaaagctgggaaaggaacaggaagcttcgggaagaggaggaacaaaacacacactgtgtgtgagatgcggccgccggagcttccacctccagaagagtcgctgctctgcttgcgcctttccggccgcccgtgttcgcaaatataactggagcgtgaaagctatccgaaggaagaccactggaactggtcgtatgaggtaccttcgtcatgttccacgcaggttcaagagtaacttcagagaaggtactcaagctactccaagaaacaagggagctgcagcaacagcttaaatttcaaaaggacaattgtagtctgaaaaatgactacagacattttgtttgtttggtgttacctgatattaattaaggcctttgcttattggaattttgaaggttatttctgtactttgaggatagaatatagtacttattattcctacttctttgctcagctgtatgacttattggttacaagtaatgtgtctgtaagctggggg

SEQ ID NO: 2203 - DNA, 675 bp, Podocarpus macrophillus
agggttttgggttctgagagagccaaatccttaggacgaggaggaagaagcagaggagggaggtgttgcaggtgcaccattatcagctacaacaatggggaaggggacggggagtttggtaagaggagaaacaaaacccatactctctgcatacgctgcggtcggcggagttttcacctccaaaagagccgatgctctgcctgtgcttatcctgccaagcgcattcgcaaatataactggagtgccaaagctattcggagaaagactacagggactggaaggatgagatatcttcgtcacatgccacgtcgattcaagaataatttcagagagggtactcaagcaacccctaggaagaaggttgctaccgcttcatcttaaatctattagaatgagttctaaactgagattcctctatgggtatgaggttaattttgcatttttataaatgttgttacagaccgctatgctctaattttgaaaacttgttttcggcattttgcaaaaaaagattttttgatgaatcaattaaatgacttctatgtgtatttcatctcttatttgtaatgttacattttaacaagttaaaagattttaaacactgaagtttgtatcaaattctaataaacctgcatatgttgaagaaaatagtttccctaagattgagcaatgttg

SEQ ID NO: 2204 - DNA, 408 bp, Tabernaemontana elegans
agggtttcctcttctcttcgcaaatgggtaaaggaacaggaagtttcggtaagaggcgaaacaagactcacacactctgtgtgagatgcggtcgccgtagcttccatctccagaagagtcgctgcggctcctgtggctatcctgctgctcgcctccggaaatataattggagtgtcaaggcaatcagaagaaagaccactggaactggtcgtatgcgttaccttcgtcatgttgcagttagattcaaagggtaacttcagagagggtactgaagcagcaccaaggagaagggagttactgcagcttcattataatatcaaagacagtttttgttttaattattagttgttttgttattttgtgcaaaactgttaattagctaccttgctcatatgaatagtagaagaa

SEQ ID NO: 2205 - DNA, 306 bp, Tragopogon dubius
cggccagcataagctcgaagaagcaggatctcggcaacggcaagcaatggggaaaggtacagggagtttcggtaagagaaggaacaagacacacacactgtgtgtccgttgtggtcgtcggagcttccatcttcagaagagtcgatgctccgcttgtgcttatcctgccgctcgcgtcaggaaatataactggagtgtgaaggcgatccgtaggaagacgactggaactggtcgcatgaggtatctccgtcatcttcctcgcagattcaagagcaaaacttcagagaagggacccaagctgctcct

SEQ ID NO: 2206 - DNA, 455 bp, Tragopogon dubius
attttcagttttttgaagactagcagttctagggttttgtttcttctcgatctgcagagatgggtaaaggaacagggagtttcggtaagaggaggaacaagacacacacactgtgtgtgaggtgcggccgacgcagcttccatctgcagaagagccgctgctctgcctgcgcatatcctgctgctcgcgtcagaaaatataactggagtgagaaggcaatcagaggaagacgactggaacagggcgtatgcgttacatgcgcaatgttccccgcaggttcaagagtaacttcagggaaggtacccaagcaacaccaaggagcaaaggagctgttgccagtgcctaaaaacagtacaatttgttgctgttttattcgttctgggaaaaccgatctttggatttttgtttgtttattaataccatttttgttatttcggtgtagtagaattcttaat

SEQ ID NO: 2207 - DNA, 512 bp, Valeriana officinalis
gtttcatcacaagaacagcaatgggtaaggcaggtaagggaacaggaagtttcggtaagaggaggaacaaaactcacgttctctgtgtgagatgtggccgccgcagtttccatctccagaagagcagatgctctgcttgtgctttccctgctgctcgcgtcaggaaatacaactggagtgaaaaggcaatcagaaggaagacaactggtactggccgcatgaggtatcttcgccatcttcctcgccgattcaagagcaatttcagagaaggtactcaagctgcaccgaggaacaaagcagctgctgcatctacttaaggtgatgatctagaggtgttgaaggtcatagaatcaaaagtctgtttttgtatgtaccaaacatttggtaacattactttatgcattttattatcttgtatggattttagtttgatttctttgagttggttttgtttacttgagaattttgcaatatgcttgagagtctttgtatctgatattctgattatttag

SEQ ID NO: 2208 - DNA, 542 bp, Antirrhinum majus
  misc_feature (541)..(541): n is a, c, g, or t
aagagctgaaccagtaatctagggtttcggcaacttcactgcaatggggaagggaacagggagttttggtaagaggaggaacagacaccacactgtgtgtgaggtgcggtcgccggagttttcatctccagaagagccgttgctcagcttgtgcttatcctgctgctcgcaagaggacctataactggagtgtgaaggctattcgccgaaagacaacaggaactggacgcatgaggtacatgcgccatgttacccgcagattcaagaccggctttagagaaggtactcaagctgcaccaaggaaggtagcagctgcttctgcttaagggcgttattttgagggtactcttacttgtactttccatggctttttgaaagacatcgcgagcaattgaattttggttttttgaaggacattgtggcctgacagatactttgtagtttgatataagctttgtgtctctgtttctactggctttgtaaaacaaccgttcttagtattgtctttctggtttattaaaattgcttatgtctttagtcnc

SEQ ID NO: 2209 - DNA, 574 bp, Panax ginseng
ggctgcaggaattcgaattctccggagctagggttttaggtttcgtcacagaatgggaaaagctgggaaaggaacaggaagctttggtaagaggaggaacaaaacacacacactgtgtgtgagatgcggccgccgcagcttccacctccagaagagtcgttgctctgcttgcgcctttcctgcagctcgtgttcgcaaatataactggagtgtgaaggccatccgaaggaagaccaccggaacaggtcgtatgaggtacctccgtcatgttccgcgcaggttcaagtccaacttcagagaaggtactcaagcaactccaagaagcaagggagctgctgcagcatcataaggttccaatgggcaattgtagtctgaaagatgagtttaggcatttttatttgttgggtgtttctttgttttggaatcttgaatcttattacttactgtattttgaggatggaatttagtcttgtattatttttacttatttgctttctctctagagttttatcatctgtgcaccagtttgactgaataatgagttaaagtcttaaagagttggacacccttgttc

SEQ ID NO: 2210 - DNA, 563 bp, Malus domestica
aaatttcccgcaactcctctgaaatctagggtttctctctgcagccaacgaaatgggcaagggaacaggaagtttcggaaagaggaggaacaagacgcacacactctgtgtgcggtgcggccgccgcagttttcaccttcagaagagccgctgctccgcctgcgcctaccctgctgcccgcctcaggaaatacaactggagtgagaaggcgctgcgccgaaagacgacgggaaccgggcggatgaggtacctgaggaatgtgccgaggaggttcaagagcggcttcctggaaggtactcaagctgctccgaggagaaagggtgctgctgctgcttcctcataagttttcaaagcccactgaactcaaactctgttttgttttcgatttggtttttgttttgcttgtcttgatagttttgaattttcacttgaacaagttttggatcattgtttaacggatgttaattgcttattatgttattagaggagttggttatggtttagactgtctccatttgcagctgcattttgatataaatgaaaattactctcaattacaatta

SEQ ID NO: 2211 - DNA, 500 bp, Flaveria ramosissima
acccttcgtttttcatcgtattgaagctagggttttgtttcttctcaatctgcagagatgggtaaaggtacagggagtttcggtaagaggaggaacaaaacacacacactgtgtgtgagatgcggcagacgcagctttcatctgcagaagagccgatgctctgcctgtgcgtatcctgctgctcgcctcagaaaatataactggagtgaaaaggcaatcagaaggaagactacaggaactggtcgtatgcgctaccttcgtaatgttccacacaggttcaagagcaacttcagggaaggtactcaagcaacaccaaggaccaaaggaactgctgctgccagcacttgaaaatgaaatacaattttgtttggttttgtgttggtactacttatttatatgcttttcagagaacttatctgggatttttgtttgtctactttagcttgcttctaacattttatccagttatgagcactaaaatgctatttattgttgctcat

SEQ ID NO: 2212 - DNA, 605 bp, Linum usitatissimum
gagagcaccaactccagaattagggtttctaagctgcgtctgctgcaatgggtaagggtacagcgagtttcggtaagaggaggaacaagacccatactctctgtgtgaggtgcggccgccgcagttttcatctccagaagagtcgctgctccgcttgtgcttaccctgccgctcgcgtcaggaaatacaactggagtgagaaggctattcgccgaaagacaaccggaactggacgaatgaggtacatgcgacatatggctcgcaggttcaagagtggattcagagagggtactcaagctgcgccaaggaccaagggaactgctgcagcatcatcttaaaaagatcgcttttagggttttgctagtaaggtttctgttgagataattttttggaacatgtttgaaaaggcaacttattcggagttttcgttgctacattttggaatactgaaatcagttgttttcagtttgacaatatgcatttttgatgatttcttcttagcatctcaagctccttaccccttaaacatgttttattattcgacgtttgctcctgagcccggtcgagctgttcatcatatcaataactcagattaatcagatctt

SEQ ID NO: 2213 - DNA, 673 bp, Carica papaya
ctagtagggtttcctcgtcgacagcagaaatggggaaaggaacagggagctttggtaagaggagaaacaagacccatactctctgcgttcgatgcggtcgccgaagctttcatctccagaagagccgctgtgccgcttgtggctttcccgccagtcgcacccgtaaatataactggagtgtgaaggctattcggcgaaagaccaccggaactgggcgcatgaggtacctccgccatttgccgcgcaggttcaagagtaacttcagagaaggaactgaagctactccaaggaacaagggagcagctgcaggctctgcataagatctggaagatttgaacgagcgtctggtttatattctcaagcgattttagatcattttttaatctcattttggagagttgcagacttataattggtcaattttgatcttatggtacttattattagttgaaaacatatgtgaattgtaggagatcctctcccagaaatttgatagagttattctgaatgatctggttacaaggtaatattgtggaatcaaaagttattcagtcattgctttttaacattttatgctttctcctcttagattctggaagaatctggttttatgatgttaaaaaaccggcacaagtggtggcaagcttaatttcatcccttagtcttattatta

SEQ ID NO: 2214 - DNA, 532 bp, Populus trichocarpa
aaattccttcctctgccgtcagcctaaactttcctccccagtgatagggtttttgcagccgaagaagaagaagaaatggggaaaggaacagggagttttggtaagagaagaaacaagactcacaccctctgtgtgcgatgcggccgccgcagctttcatctccagaaaagccgttgcagtgcttgtgcttttcctgctgcccgtgtcagaaaatataactggagtgagaaggctattcgcagaaagaccactggaactggccgaatgaagtacctccgtcacctgccacgcaggttcaagactaactttagagaaggtactcaagcagctccaaggaacaagggagctgcagcagcttcatcgtaagtgttagaagggcgatgaaagtgtgttttatttcaatgtttttgaatttgcaaacaagaagttttgaattgttgttacttgttagacactgaattgttttcaacaatggagagttacaaatgtttatccttctgtcatggtaatgaatggtgatcaccttttatta

SEQ ID NO: 2215 - DNA, 544 bp, Prunus persica
aaatttcccgcaacaactccgaatctagggtttctctctgcaactgaagttatgggcaaaggaacaggcagcttcggaaagagaaggaacaagacccacactctgtgtgtgcgatgcggacgcagaagcttccatctccaaaagagtcgttgctcagcttgtgcttaccccgctgcccgccttagaaaatacaattggagtgagaaggcgctgcgcagaaagacaaccggaactgggcgtatgaggtaccttcgcaatgttccaaggaggttcaagagcaacttcacagaaggcacacaagctgctccaaggcgcaagggaactgctgctgctgcttcataagatttcagagcccgcccacccagcatttgcgttatgatttttattttcgttttgttgtcttgatagtcttgaattttcactcaaacaagttttggatcgttataatgtcaattgctccttatgttgttgaagagttagttttgataaacccaatgcttcgttttgatactgaatggaaattactttggtaaatctacctctt

SEQ ID NO: 2216 - DNA, 456 bp, Centaurea maculosa
gatcctctagggtttagtttttctactttcaagagatgggcaagggaaccgggagctttggaaagaggaggaacaagacacacacactgtgtgtgaggtgtggccgccgcagcttccacttgcagaagagccgatgctctgcttgtgcttatcctgctgcccgcgtcaggaagtacaactggagtgaaaaggcaatcagaaggaagactacaggaactggtaggatgaggtaccttcgtaatgttcctcgtaggttcaagagtggtttcagagaaggaactcaagcaaccccaaggagcaaaggagctgctgccagcacttaggtttgaaggaagattttgatatatttgatgtttaagaaaacaagattttgatatatgtttgtttacctaatcagtacaattgcaatgcttgatgcttttgttttgatatttgagaaaaagcagatactttcta

SEQ ID NO: 2217 - DNA, 458 bp, Centaurea maculosa
ggggaaaggaacaggaagttttggtaagagaaggaacaaacaacacacactgtgtgtacggtgcgggcgtcgcagcttccatctccagaagagccgatgctctgcttgtgcttaccctgctgctcgcgtcagaaaatacaactggagcgagaaggcaatccgtaggaagacaacaggaactggacgtatgaggtatctccgtcatctgcctcgcagattcaagagcaacttcagagaaggtactcaagctgctccaaggaagatcggtgcagcatcttcagcttaaattcgtgaaatcatataacctagaattgggcgatttagaggataatcgaagttttgtgaaacatgattttgatgtggttaatctattgatcttcaattgtggtttccttctgtttagaaatttgtgatttttaatcatggattgaatgatatatatacagttgctctgtttt

SEQ ID NO: 2218 - DNA, 495 bp, Gossypium hirsutum
aaaggaactggaagctttggaaagagaaggaacaagactcacacgctgtgcgttcgatgtggtcgccgaagcttccatctacagaagagccgttgcggtgcttgtggctaccctgccagtcgcatccgaaaatataactggagcatgaaggctattagaagaaagaccaccgggactggccgcatgaggtacctccgacatgttccccgaaggttcaagactggctttagagaaggtactcaagcaactccaaggaagaagggagcagttgctgcttcgtaagttaatttgtgatgttttcgttttgttcagagagattcctgaatttagaaacgataggtttttgggtttctttcaactgtgttactttcttatttttcaccaaatgtctacaaacgggaagttttgttttatattatgagctttcacgactttattttcattatgcataacaatttacttctatccctttgcgttgtatgaaatagtgatatg

SEQ ID NO: 2219 - DNA, 551 bp, Helianthus annuus
cgcactccctctatccatcttctccactctctttcttaacaacgacacccctccttttctactcctatctttctcaacataaaactcaggccggctctgtgagttccgctagggtttagtttaaagggatgggcaagggaaccgggagctttggaaagaggaggaacaagacacacacactgtgtgtgaggtgcggccgccgcagcttccacttgcagaagagccgatgctctgcctgtgcttatcctgctgctcgcgtcaggaagtacaactggagtgagaaggcaatcagaaggaagactacaggaactggtaggatgaggtaccttcgtaatgttcctcgtaggttcaagagtggtttcagagaaggaactcaagcaaccccaaggagcaaaggagctgctgccagcacttaggtttgaaggaagattttgatgtatttgatgtttaagaaaacaagattttgatatatgtttgtttgcctaatcagtacaagtgcaatgcttgatgtttttgttttgatatttgagaaaaagcagatactttctatt

SEQ ID NO: 2220 - DNA, 528 bp, Ambrosia trifida
caagagatgggcaagggaacaggaagctttggaaagaggaggaacaagacacacacactgtgtgtgaggtgtggccgccgcagtttccatctccagaagagccgttgctctgcttgtgcttatcctgctgctcgcgtcaggaaatacaactggagtgagaaggcgatcagaaggaagactacaggaactggtaggatgaggtacctccgtaacgttccccgtaggttcaagagtggttttagagaaggaacccaagcaaccccaaggagcaaaggagctgctgccagcgcttaggtttgaaggaagattttgatgtatttgatgtttaagaaaaccaagattttgatttatgtttgtttgcttaactagtacaagtgaaatacttgatgtttttgttttgatattggagggaaagcagatactttctattgagttttattgatccgtttatgcgtttcgtacttaaatttgccagtctaattttatggtgcaaaagtcattaagcagataaaataatattgcatctag

SEQ ID NO: 2221 - DNA, 442 bp, Bruguiera gymnorhiza
aaatgtgaaaaactctccaaagccactcacaacccaagccctcctctgcatcagctgcaatgggaaagggaacagggagttttggaaagaggaggaacaagacccacacactctgtgttaggtgtggccgccgtagcttccacctccagaagagccgctgcgctgcctgtgccttccccgccgcccgcaagaggacttataactggagtgtgaaggcaatccggaggaagacaacaggaactggaaggatgaggtatctccgcaatgttcctcgcaggttcaagagtggtttcagagaagggactgaagcagcaccaaggaagaagggggttgcagcaactgcataaggttagatgatcagttggggcaagtgtgcgcatttatagatttagtttgaaatcatgtattcaaacaaatttctgcaagtggtgactatttactc

SEQ ID NO: 2222 - DNA, 338 bp, Bruguiera gymnorhiza
ggaaccctctaaatctccggaaaaaggctaagggcttctctgcatcaacttccatgggaaaaggaacagggagttttggaaaaaggaggaacaagacacatacactctgtgtcaggtgtggccgacgcagcttccacctccagaagagccgctgcgccgcctgtgcctttccggccgcccgcaagaggaaatataactggagtgtgaaggcaattcggaggaagacaactggaactggaaggatgaggtatctccgcaatgtccctcgcaggttcaagagtggtttcagagaaggtactcaagcagcaccaaggaagaagggagtggcagcaacagct

SEQ ID NO: 2223 - DNA, 535 bp, Cichorium intybus
cgctagggttttggtcatcttcatttcgagacatgggtaagggaaccgggagtttcggaaagaggaggaacaagacacacacattgtgtgtgaggtgcggccgccgcagctttcacttgcagaagagtcgctgctctgcatgtgcctatcctgctgcccgcgtcaagaaatacaactggagtgtgaaggcgatcagaaggaagacaacaggaactggtaggatgaggtacctacgtaatgttccacgaaggttcaagagcaactttagagaaggaactcaagcaaccccaaggagcaagggagctgttgccagcgcttaaatttaaaggaagtatttcatgtattttagtttgggtgttgaagaaaaacaagttttggattattatgtttgttttgcttatgagaatttatttttgatatgggaaagaaagcagatactttctataaaaaaaaaataaatgccgtctcggccctgtcgactcctgacttgagccagcttattgctggagttccttttccaaaattccgcattgac

SEQ ID NO: 2224 - DNA, 657 bp, Cucumis sativus
tctctttggacggtacaggaatccaaaggtttcatcctccaattcgattaaatgggtaagggaacgggaagtttcggtaaaaggaggaacaagacccacactctctgtgttaggtgtggccgtcgtagcttccatctccagaagagtcgatgctccgcctgtgcatttccagctgctcgtaagcgtacatataactggagcgtcaaggcgatccgaaggaagaccactggaactgggcggatgagatatttgcgccatgttcctcgcagattcaagagtggtttcagagaaggtactgaagcagcgccaaggagcaaaggagcctcatcatcagcctaagacattgaaggttaattgtggcacaacttggtaccttatatagcttctaggaggattttatcatttttgggactagagtttataagaattttgtttgatgatgttattgcctgcaatactgaagcttgtttttatttcttactcttttgtttatggaatttctgataattgttttcagaccactttcacctttggttaatctatgtcttgagttatatacttctaagttccaaccatgttagaaggtattgctggtagatattgttactctgaatgccagggtggaaactattagtgagaaatttgcgtgttgagatc

SEQ ID NO: 2225 - DNA, 651 bp, Euonymus alatus
gggggcctgcttttcaagcctcagatcgtcttcctattccagagctagggtttctcagcaacagtcgcaccaatgggtaagggaactgggagtttcggtaaaaggaggaacaagacccacacactctgcgtcaggtgtggccggcgcagcttccatcttcagaagagccgatgctctgcctgtgctttccctgccgcccgcaagaggacatacaactggagtgtgaaggcaatccgcaggaagacaactggaactggtaggatgaggtatctccgtcatctccctcgccgctttaagagtggtttcagagaaggtactcaagctgcaccaaggaataggggagcagctgcaactgcttaagcctttaatcatgcatttgggcaaactttggacagtcaattatatcattaattggcttttatttatgggaaaattttgtggagacattgtttggaagtttcaacttttaatgttttttcagtcttattgtagttttcttgatatgaagttgctttcaattttggagtggatgatgaaactctctttggcttgatttctgatggaagtaaattattttatgtttttgatcttcaacgcttggcaggacagatatggaattcttcattagaaagattaagtaaaaatttctgg

SEQ ID NO: 2226 - DNA, 675 bp, Euonymus alatus
acctcgttctctcataaccctaagccatatatctccgccgctagtgcctgcttatcaagccttagatcgtcttcctattccacagctagggtttctctgcaacagtcgcaccaatgggaaagggaactgggagtttcggtaaaaggaggaacaagacccacacactctgcgtcaggtgtggccgtcgcagcttccatcttcagaagagccgatgctctgcctgtgctttccctgccgcccgcaagaggacatacaactggagtgtgaaagcaatccgcaggaagacaactggaactggtaggatgaggtatctccgtcatctccctcgccgctttaagagtggtttcagagaaggtactcaagctgcaccaaggaataggggagcagctgcaactgcttaagcctttaatcttgcatttgggaaaactttggacagtcaattatatcattaattggcttttatttgtgggaaaattttgtggagacattgtttggaagtttcaacttttaatgttttttcagtcttaattgtagttttcttgatatgaagttgctttcaattttggagtggatgatgaaactctctttggtttgatttctgatggaagtcaattattttatgtttttgatcttcaacgcttggcaggtcagatatggaattcttcattagaaaga

SEQ ID NO: 2227 - DNA, 663 bp, Euonymus alatus
gcccactcaaaaccctagctatatattccctctcccgactctatttaagccacaaatcgtctactcctccacagctagggtttctctgcagaagtcgcgccaatgggtaagggaactgggagtttcggtaagaggaggaacaagacacacaccctttgcgttagatgtggccgccgcagctttcatcttcagaagagccgctgctccgcctgtgctttccccgctgcccgcaagaggacatacaactggagtgtgaaggcgatccgcaggaagacaactggaactggtaggatgaggtatctacgtcatctccctcgccgcttcaagagtggtttcagagaaggtactcaagcagctccaaggaacaagggagcagctgcaactgcttaagcctttgatcaggcatttcggctaaatttgtgtcgtcaattatatttttaatcttcttcctttatttcctgaaaaattttgtggagacattgttcggaagttgttcaacttttttaatgcttttcagtaatattgtactatccttgaatatgaagttgctttcaatgttggagtggatgaaactattttggtttattttctgttggaattcaattatttcagcaggaaagatgtatggaattcctgatcttaatgatttggtgataaattgtg

SEQ ID NO: 2228 - DNA, 594 bp, Euonymus alatus
agccacaaatcgtctactcctccacagctagggtttctctgcagaagtcgcgccaatgggtaagggaactgggagtttcggtaagaggaggaacaagacacacaccctctgcgttagatgtggccgccgcagctttcatcttcagaagagccgctgctccgcctgtgctttccccgctgcccgcaagaggacatacaactggagtgtgaaggcgatccgcaggaagacaactggaactggtaggatgaggtatctacgtcatctccctcgccgcttcaagagtggtttcagagaaggtactcaagcagctccaaggaacaagggagcagctgcaactgcttaagcctttgatcaggcatttcggctaaatttgtgtcgtcaattatattttaaatcttcttcctttatttcctgaaaaattttgtggagacattgttcggaagttgttcaacttttaatgcttttcagtaatattgtactaaccttgaatatgaagttgctttcaatgttggagtggatgaaactattttggtttaatttctgttggaattcaattatttcagcaggaaaggtgtatggatggaattcctgttc

SEQ ID NO: 2229 - DNA, 588 bp, Flaveria ramosissima
cttctctaatctgtgagatcctctaggggttttggggtttgtttatcttcattccgagagatgggtaagggtactgggagtttcggaaagaggaggaacaagacacacacactgtgtgtgaggtgtggtcgccggagctttcacctgcagaagagccgatgctccgcctgcgcctaccctgccgcccgcctcagaaaatacaactggagtgagaaggcaattagaaggaagacaacaggaaccggaagaatgaggtaccttcgtaatgtgcctcgcaggttcaagagcggtttcagagaaggaactcaagcaaccccaaggagcaagggagctgctgccagcacttaggtttgaatgaagattttaatgtattttaattttggcatctgtttttgagaaaaacagctttgggtttatgtttgtttgattattagtacaagtggaatatttgatgctttatttttattttggagggaaagcagataccttctattgagtttttttgcttcgtttgctcatttttttgcttcattcacatgttatgtcccgaaatctgtttatctgttacaaagttatctttcaacattt

SEQ ID NO: 2230 - DNA, 445 bp, Flaveria ramosissima
gagtagttgtgtttttcttctcttcaatctgcagaaatgggtaaaggaacaggtagcttcggtaagaggaggaacaaaacacacacgctgtgtgtaaggtgtggaagacgaagctttcatctgcagaagagccgatgctctgcttgtgcttatcccgccgctcgcctcagaaaatacaactggagtgtgaaggcaataagaaggaagactactggaacgggtcgtatgcgttacttgcgtaacgttcctcgtagattcaagagcaacttcagggaaggaactcaagcaacaccgaggaccaaaggagctgtttctagcacttaaagaagtaccagcttttgattgttttgtattttatatggttttcaaaaaccaatcctgggatatatgtttattcacttgtttcatgttatgacattttgttatttatgagcatttaaatgtt

SEQ ID NO: 2231 - DNA, 465 bp, Flaveria ramosissima
tttgtttttcttcattccgagagatgggtaagggtaccggaagtttcggaaagaggaggaacaagacacacacactgtgtgtcaggtgtggtcgccggagctttcacctgcagaagagccgatgctccgcctgcgcctaccctgccgctcgcctcagaaaatacaactggagtgagaaggcaattagaaggaagaccacaggaaccggaagaatgaggtaccttcgtaatgtgcctcgcaggttcaagagcggcttcagagaaggaactcaagcaaccccaaggagcaagggagctgctgccagcacttaggtttgaatgaagattttaatgtattttaattttggcatctgtttttgagagaaacagctttgggtttatgtttgtttgattattagtacaagtggagtctttgatgctttatttttattttggagggaaagcagatactttctattgagttttt

SEQ ID NO: 2232 - DNA, 455 bp, Flaveria ramosissima
aagctgagagtagttgtgtttttcttctcgtcaatctgcagaaatgggtaaaggaacaggtagtttcggtaagaggaggaacaaaacacacacgttgtgtgtaaggtgtggacgacgaagctttcatctgcagaagagccgatgctctgcttgtgcttatcccgcagctcgcctcagaaaatacaactggagtgtgaaggcaatcagaaggaagactacaggaacgggtcgtatgcgttatttgcgtaacgttcctcgtagattcaagagcaacttcagggaaggaactcaagcaacaccgaggaccaaaggagctgtttccagcacttaaagaagtaccagcctttggttgtttttgtattttatatggttttcaaaaaaaccatcttggatttttgttattcacttgtttcttgttataacattttttgttatttatgagtcattaaaatgtt

SEQ ID NO: 2233 - DNA, 539 bp, Actinidia deliciosa
aaaaccagggtttcttcagctgcgataccaatggggaagggaacagggagcttcggtaagagaaggaacaagactcacaccctatgtgtgaggtgtggccgccgtagctttcatctccagaagagccgatgctccgcttgcgcttttcccgccgcccgtaaaagaacatataactggagtgtgaaggcgatccgaaggaagacgactgggacaggtcgtatgaggtacctccgcaacgtgcctcgcagattcaagagtggtttcagagaaggtacccaagcagctccgaggaaaattggatcggcagctcctgcttgaaatggtggtatgctttaagtgagcgggatttttggatactgaattactagtttcatttggttttttcgagtgttggaacatagttaatttttgggaacattatttggatagtgtattccaaattagtacttagtttccgattttgttcttctgatatgtagttgatttgagtttgtgatacagatggataagtctatttctttgaatccccattatcttca

SEQ ID NO: 2234 - DNA, 737 bp, Cucumis melo
cctgattcttcttcctctttggacagtagaggaatccaaaggcttcatcctccaattcgattaaatgggtaagggaacgggaagtttcggtaaacggaggaacaagacccacaccctctgtgttaggtgtggccgtcgtagcttccatctccagaagagtcgatgctccgcttgtgcatttccagctgcccgtaagcgtacatataactggagcgtcaaggcgatccgaaggaagaccactggaactgggcggatgagatatttgcgccatgttcctcgcagattcaagagtggtttcagagaaggtactgaagcagcgccaaggagcaaaggagcctcatcatcagcctaaagacattgaaggttaattgtggcacaacttggtacctttctaggttctaggaggattttatcatttttgagactagagtttataagaattttgtttgatgatgttattgccttcaatactgaagcttgtttttatttcttactctttcgtttattgaatttctgatcgttgtttttagaccactgtcacctcttgttaatctatgtcttgagttatatacttctaagttccaaccattttaggaggtttttgctggtagatactgttactctgaatgccagggtagaatctattagcgagaaatttgtgtgttgggatcgtgtgttgatgtttgacagtttgagtttcttattttgggtcgcagcctcaaaaaaaaaaaaaaaaa

SEQ ID NO: 2235 - DNA, 638 bp, Capsicum annuum
gcgcttttctatccaagagcatcttcgaagcttaagggaaaagctgcacaaatgggaaaaggaacaggaagtttcggtaagaggaggaataagactcatacactgtgtgttagatgtggtcgtcgtagcttccatatccagaagagtcgttgttctgcttgtgcttaccctgctgctcgtcttagaaaatataactggagcgtcaaggcacttagaagaaagaccactggaactggtcgtatgaggtatctccgcaatgtgccccgcaggtttaagacgaacttcagagaaggaaccgaggcaactccaaggaagaagggcactgctgcaccctcttaaatttctaaagaagcagtttgacattgtttcattttgattttgccttccattttgttgatgaatcaaagtttgaatattacctctcatttgttatgttggagatattgttgtttaagatatttgtcctatggattgctttgcctttgatgtagtattcgtttcccactcctcttagcctaatcatttaaaggctaatgatatacttttagttgtggtaggtaggacttcgaatgttgcaaattcatcctataacactgctgctgaactcggaacatttgcattgaaatgagtttgggaat

SEQ ID NO: 2236 - DNA, 646 bp, Capsicum annuum
ctagttctctccttttctatccaagagcatcttcgaagcttaagggaaaagctgcacaaatgggaaaaggaacaggaagtttcggcaagaggaggaataagactcatacactgtgtgttagatgtggtcgtcgtagcttccatatccagaagagtcgttgttctgcttgtgcttaccctgctgctcgtcttagaaaatataactggagcgtcaaggcacttagaagaaagaccactggaactggtcgtatgaggtatctccgcaatgtgccccgcaggtttaagacgaacttcagagaaggaaccgaggcaactccaaggaagaagggcactgctgcaccctcttaaatttctaaagaagcagtttgacattgtttcattttgattttgccttccattttgttgatgaatcaaagtttgaatattacctctcatttgttatgttggagatattgttgtttaagatatttgtcctatggattgctttgcctttgatgtagtattcgtttcccactcctcttagcctaatcatttaaaggctaatgatatacttttagttgtggtaggtaggacttcgaatgttgcaaattcatcctataacactgctgctgaactcggaacatttgcattgaaatgagtttgggaat

SEQ ID NO: 2237 - DNA, 625 bp, Lippia dulcis
tcagagacatggggaagggaacggggagtttaggaaggaggagaaacaagacccacacactgtgtgtgaggtgcggccgccgcagtttccatctccagaagagccgctgctcagcctgtgcctacccggccgcccggaagaggacatacaactggagtgtgaaggctattcgccgaaagaccactggtaccggacgcatgaggtatcttcgtaatgtgccccgcagattcaagaccaactttagagaaggtactcaagctgcaccgaggaaaaaggcagccgctgtctctgcttaagggcctaaacttcgagggtactcttgattgaggttttccattggtatctttaaagaagtggagagcaattaagttttggaaacggtgtttgaagggcatttttcgcccaatttaatacttagttttgattctaatttttgttgctgtatttggattttggcactttaatacggatgtctggatgacaactattatttcccttgtgcactttctttctgagttattaaaacacttgattttatgttaccaacatattccgtgcgacttgaatggggttacatttgttgtatattaagcagtgcaactgtttatatggttccaaaaaaaag

SEQ ID NO: 2238 - DNA, 557 bp, Cajanus cajan
acggggagttttggtaagagaaggaataagacacacaccctgtgtgtgaggtgtggccgccgcagcttccacctccagaagagtcgctgctccgcgtgcgctttccccgccgcgcgcaagaggaaatataactggagcgtgaaggccattaggagaaagaccactgggactggaaggatgaggtacttgcgtcacgtgcctcgcagattcaagagcggcttcagagagggtaccgaagctgcaccaaggaagagaggagcagctgccagtgcctaagctgggtcagtgagttaattataggagttgaggtttctatgttggggccaagctctatggggtatttttctttctgtcgtttttgtttttatttaatatgtagttgctttgtgtttcgacatgaggattgtaaggaattttgatttttcaatgagagtttttgacatccatattttggcgtatcaattttagcttgagttttggtatcgtggtgcataatgaactagtaattagctgggtttgtcttgcatgatcgtttacattttggtctagtttctgtg

SEQ ID NO: 2239 - DNA, 922 bp, Populus trichocarpa
atcctctctttaatacccaaaaaaaaaaacaaaaaaaaaaggagctcttctagggtttctctgcatctgttgctgcaatggggaagggaacagggagttttggtaagaggaggaacaagacccacaccctctgtgttaggtgtggccgacgtagcttccatctccagaagagccgttgctctgcctgtgctttccctgctgcccgcaagaggaaatacaactggagtgaaaaggcaatccggagaaagacaactggaactggaaggatgaggtatctccgcaatgtccctcgcaggttcaagagtggtttcagagaaggcactcaagcagagccaaggaagaagggtgcagcagcatctgcttaagctgtgagtctttttgggtgtcatctgggcacccagttatagatttacatgcaaattatgtattggggagttttgtgagaacattgttaatgggtacgattcacctttttgatactatttagttaaatttacatttcctaattatgtagttggtttgattttgaatgaggatgctgggactattattcaattttcatcgagtttttgactaaagtttaaaacataattcaatgtgtggatggtgatctcaagcagaagtgatattccccgtcaaagccagcacaggttatattactaagatagggtgggttgccagtttatactaggcagattctgaggacacccgtagcagtaaaaccgcctgaatataaacgtgcacagcagttgttctaagcaggtctactggtaaacgccaatgctattgtgtactctgccatatttgacatggcttcaaatgtggtacaccgactctctagtacaagattggatggcacttttttctcgaataagtggcagggccatcatctacatgggtagaataagtagcaggggaattt

SEQ ID NO: 2240 - DNA, 487 bp, Silene vulgaris
cttccacaactccatcatcatcctcaacattcagccatgacgaaaggaacaggaagttttggaaagagaaggaacaagacacacaccctctgtgtccgttgtggtcgtcgcagtttccatcttcagaaatctcgttgttctgcttgtgctttccctgctgcccgtactcgcaaatacaactggagtgttaaggcaatcaggaggaagactactggaacaggtcgtatgaggtacctccgtaatgtccctcgccgtttcaagactggtttcagagaaggcactcaagctgcaccaaggaagcaagtagcagctgcatcatcttaaaagaggtttgctgtattaggacggttaattttggtacttcaagtagtagctgcctttttgttcatctgaactgttgtgactatctcctactttcatgttattttcaagacattgtattttgatggaaaggatttttgctccggtgtttccggtttcattcaca

SEQ ID NO: 2241 - DNA, 578 bp, Silene vulgaris
cttccacaactccatcatcatcctcgacattccgccatgacgaaaggaacaggaagttttggaaagagaaggaacaagacacatactctatgtgtccgatgtggtcgtcgcagtttccatctccagaaatcccgttgttctgcttgtgctttccctgctgcccgtactcgcaaatacaactggagtgttaaggcaatcaggaggaagactactggaacaggtcgtatgaggtacctccgtaatgtccctcgccgtttcaagactggcttcagagaaggcactcaagctgcaccaaggaagcaagtagcagctgcatcatcttaaaagaggtttgctgtattaggacgattaattttggtacttcaagtattagccacctttttgttcatctgaactgtttggactagctcctactttcgttttattttcaagacattgtattttgatggaaaggatttttgctccgttgtttccggtttcattcacaaaatgtagtactccatcctattttccggaattgcaacttttgctttttggcatggatattgtgggatttaggtggttggagactcacccag

SEQ ID NO: 2242 - DNA, 469 bp, Helianthus annuus
gggcaggcgttgtgagatccgctagggtttagtttttctactttcaagagatgggcaagggaaccggtagctttggaaagaggaggaacaagacacacacactgtgtgtgaggtgcggccgccgtagttttcacctgcagaagagccgatgctctgcctgtgcttatcctgctgctcgcgtcaggaagtacaactggagtgagaaggcaatcagaaggaagactacaggaactggtaggatgaggtaccttcgtaatgttcctcgtaggtttaagagtggtttcagagaaggaactcaagcaaccccaaggagcaaaggagctgctgccagcacttaggtttgaaggaagattttgatgtatttgatgtttaagaaaacaagattttgatatatgtttgtttgcctaatcagtacaagtgcaatgcttgatgcttttgttttgatgatatttgagaaaaagcagatact

SEQ ID NO: 2243 - DNA, 471 bp, Helianthus annuus
aggcgttgtgagatccgctagggtttagtttttctactttcaagagatgggcaagggaaccggtagctttggaaagaggaggaacaagacacacacactgtgtgtgaggtgcggccgccgtagttttcacctgcagaagagccgatgctctgcctgtgcttatcctgctgctcgcgtcaggaagtacaactggagtgagaaggcaatcagaaggaagactacaggaactggtaggatgaggtaccttcgtaatgttcctcgtaggtttaagagtggtttcagagaaggaactcaagcaaccccaaggagcaaaggagctgctgccagcacttaggtttgaaggaagattttgatgtatttgatgtttaagaaaacaagattttgatatatgtttgtttgcctaatcagtacaagtgcaatgcttgatgcttttgttttgatgatatttgagaaaaagcagatactttctat

SEQ ID NO: 2244 - DNA, 657 bp, Camellia sinensis
ccctaaacctctcaactcacttgcattcaccatatatattgtatcttctcctccaaaacagctctcacaggtctagggtttcttgcagctgcgcaacaatggggaagggaacagggagttttggtaagagaaggaacaagacccacaccctctgtgtgaggtgtggccgccgcagctttcatctccagaagagccgatgctctgcttgtgctttccctgctgcccgtaagaggacatataactggagtgtgaaagcgatccgaaggaagacgactgggacaggtcgtatgaggtacctccgcaacgtacctcgcagattcaagagtggtttcagagaagggactgaagcagctccgaggaagaaaggatcggcacctcctgcttgaggcagtggatgacaaggcttttagtgggcatgattttgatggggtacatgcattatagtttcatttggtgtgttcaagtgttggaacagacaaatttttgggaacatcatttgtttggtgttactccaattcaatattgagcttgtgcttttgttcttttgataaactgttgattttgagttttagatacagattgatgattattgttttgaatccccattttgtcgagtctatagatattatgattttgatgataatcagttttatttgc

SEQ ID NO: 2245 - DNA, 628 bp, Tripterygium wilfordii
cgctactgcgcgttagtcttctttgttcgtagcctcaaatcgtctactccaccgcagctagggtttctctgcagaagtcgcggcaatgggtaagggaacggggagtttcggtaagaggaggaacaagacccacaccctctgtgttaggtgtggccgccgtagctttcatcttcagaagagccgctgctccgcctgtgctttcccggccgcccgcaagaggacatacaactggagtgtgaaggcgatccgcaggaagacaactggaactggtaggatgaggtatctccgtcatctccctcgccgcttcaagagtggtttcagagaaggtactcaagcagctccaaggaacaagggagcagctgcaactgcttaagcctttgatcaggcatttccgttaaaaattatatttttaattggcatctatttccttgaaaaatatttgtggagacattgttgcggaagttgttcaacttttaatgctttttagtcttattgtacttttcttgaatatgaggcgctttcaattttgggatgaaactatttttggtttgatgtctgatggaattcaattgtctcagcaggaaagatgtatggtattactaaccttaacgatttggtgataaattgt

SEQ ID NO: 2246 - DNA, 565 bp, Tripterygium wilfordii
aaccctagccatatatctcctctcgttacgccgcttgcaagtcttaaatcgccttcctcctccacagctagggtttctctgcagcagtcgcagcaatgggtaagggaactgggagtttcggtaagaggaggaacaagacccacacactctgcgttaggtgtggccgccgcagcttccatcttcagaagagtcgctgctccgcctgtgctttccccgccgcccgcaagaggacatacaactggagtgtgaaagcgatccgtaggaagacaactggaactggtaggatgaggtatctacgtcatctccctcgccgctttaagagtggtttcagagaaggcactcaagctgcaccaaggaataagggagcagctgctactgcttaagcctataatcatgcatgtgggcaaactttggggagtcaatttcatgattaattgttgtttattttgtgggaaaattttgtggagacattgtttggaggtttcaacttttaatgctttttagtattattgtagtttccttgatatgaagttactttcaattttggagtggatgatgaaactct

SEQ ID NO: 2247 - DNA, 1122 bp, Gossypium raimondii
attgcgcgtaatagctattacgccccctctgcgcggattagggattccacttgcttttcatcttttcttttccattttttgccctcatcaagcttccgagtctcccatgtttcccttccagggaaagggaacagggagttttggtaaaagaaggaacaagacccacactctctgcgttaggtgtggccgccgtagcttccatctccagaagagccgttgctctgcctgtgctttccctgctgctcgtaagaggacatataactggagtgtgaaggcaatcagaagaaagaccactggaaccggtaaaatgaggtatttgcgccatgtccctcgcaggttcaagactggttttagagaaggtactgaagcagcaccgaggaagaaggttgtagcagcttctgcttgaggtattacaagatctgcaaattgcgcgagggtttgggcatagcaaccaataatgctgctgaatatcgtgccataattttaaggttacaggcttgatggcttcttcgttctctatgactttcaaatggttgctttttgcaaaatgttgattggagagaaaggttggctctgcaatctatcaaaaaccttttcactaaggaggttgttgatgttgtaactacaagcacgactgatttggggccactaaatcttgattcctttagaaaaggcaatttgtctgcgtcatggaaagttgttggggtagagacttcggttcaggataatgctatttcaaagtcaaaccaaaaggctacagacttgaaacaagaaacatctcaggataaagaggaaaagtttctagatgatgatcattcacatgatacacctgctaaaatacttcgaaggcaacttagagataatagacgtgagaagcgggccactgaattggtgaaacaagatgagaaagttaccgtgaaacttgaaaatgctgccattgaacaatccaaagctgtagactctgctgttttgggcaaatacaatctattttgtactttatataattgctttttgatttgttgtcttgcatgaagtgatctactacaccttcaatggagagaatatttgctttttgattaaattgtaaagtttggatattgactaattttaatttatcaaatt

SEQ ID NO: 2248 - DNA, 432 bp, Picea glauca
gaaggcggtgaagagcggaggagtcggtgcgcgctgcaacaatgggcaagggaacaggaagttttggtaagaggagaaataagacccacactctttgtatccggtgtggtcgccgcagttttcatatccagaagagtagatgttcggcatgcgcctacccatcaaagcgcatccgtaaatacaactggagtgtcaaagccattcggagaaagactactggaacaggacgaatgagatacctgcgtcacatgcctcgtcgcttcaagaataatttcagggagggactcaggcaacccccagaagaaggctgctgctaccacatttaaatgctttaagaatggccctgaaatatttgtagagtttttaacctcgtttgtgagctggcacgacttgacttattttcatatgctgtcattgacagctttatttctt

SEQ ID NO: 2249 - DNA, 524 bp, Antirrhinum majus
aagggaacggggagttttggtaagaggaggaacaagaccacacactgtgtgtgaggtgcggtcgccgcagttttcacctccagaagagccgctgttccgcctgtgcttatcctgctgctcgcaagaggacttacaactggagcgtaaaggctatccgaagaaagaccaccggaactggacgcatgaggtacatgcgcaatgtgccacgcagattcaagaccaacttcagagaaggtactcaagctgcaccaagggtgaagtcagcagctgcttctgcttaggattctgatttggagggtgctcgtcactgtacttttcaatactaatcttaaagcattattggattttggaaatttatcctcagagattgatttaaattttgtttcgcatacttaattgtcatttcatatggtcggattaaagactgttatcagcttaattgtttctgttcattcatctgtttacgaatgctttagttctttgatggtggtgttgttcttgtgttcggttggtaaaggtttaac

SEQ ID NO: 2250 - DNA, 632 bp, Gossypium hirsutum
gtttttgcagctcgaagaacaaaagaaatgggaaaggaactggaagctttggaaagagaaggaacaagactcacacgctctgcgttcgatgtggtcgccgaagcttccatctacagaagagccgttgcggtgcttgtggctaccctgccagtcgcatccgaaaatataactggagtgtgaaggctattagaagaaagaccaccgggactggccgcatgaggtacctccgacgtgttccccgaaggttcaagactggctttagagaaggtactcaagcaactccaaggaagaagggagctgttgctgcttcatgagttaatttgtgatgttttgttttgttcagagagattcctgaatttagaaacaataggttttgggtctctttcaactgtgtgttactttttcatttttcacctaatgtctacaaacgggaagttttgttttatattatgaagtttcacgactatgtagagcaatttacttctatccctttgtgttgtatgaaatagtgatatgcaaaccatgggtgatcttatacttgctcaacactgaggatagcggtcatccccatctacatgccatgttttctattttctgcagttgaaatgttatttcccaaagggtctattatc

SEQ ID NO: 2251 - DNA, 441 bp, Flaveria ramosissima
gagtcgtgtttttcttctcgtcaatcggcagagatgggtaaaggaacaggcagttttggtaagaggaggaacaaaacacacacgctgtgtgtaaggtgtggacgacgtagctttcatctccagaagagccgctgctctgcttgtgcttatcctgccgctcgcctcagaaaatcaactggagcgtgaaggcaatcagaaggaagactacaggaacgggtgtatgcgttacttgcgtaatgttcctcgtaggttcaagagcaacttcagggaaggaactcaagcaacaccgaggaccaaaggagcggcttccagcactttaacgagttaccagcattttcggtgttttttgattttatatggttttcagtaaaaccatcatgggactttgttattctactgtttgctttatttatcatttttttagtaattttatgtaagact

SEQ ID NO: 2252 - DNA, 353 bp, Olea europaea
gacgataattcagcagcaactttgaacctatatctccaatttgctcatgggaaagggaacagggagtttggtaagcgaaggaacaaaactcacactctgtgtgtgagatgcggtcgccgcagcttccacatccagaagagtcgttgctccgcctgtgcttaccccgccgcacgcttaaggaaatataactggagcgtcaaggcgatacgaagaaagaccactggaactggtcgtatgaggtatctccgtcatgtagctgttaggttcaagagtaactttagagaaggtactcaagcacctccaagaaagaagggcacagctgcagcatagtaaggttttgaaggaaatcctga

SEQ ID NO: 2253 - DNA, 539 bp, Petunia hybrida
aacccaagctcccagtgtttctgcagctgcagcataatggttaagggaacaggtagttttggtaaaaggagggaactatacacacacactatgtgtgagctgtgggcggcgcagtttccatttacagaaaagtcgttgctctgcttgtgcttatcctgctgcccgtaaaagatcatataattggagtgtgaaggcgatacgtagaaagacgacgggaacaggtcgtatgaggtatcttcgtaatgtacctcgtagattcaagactaatttcagagaaggttgcgaagcagctccaagaaagaaggcagcagcttctgcttaagttctttgagaaagttacttggaggctgatacttttagtggtagattcattttgctatttttaagtgttagagagaaagtaaaattttgtcgaaccttctgggtttaatgcccaatggaagtttgatgtgcgtaaaactaaaatgtatttcatttaggcatttttatgaagaggattttatacattgttgtcacctattgggtgatctgagttaaaa

SEQ ID NO: 2254 - DNA, 537 bp, Pinus taeda
gcggaggattcagcgtgtgctgcaacaatgggtaagggaacgggaagtttggtaagaggagaataagacccacactctatgtatacggtgtggtcgccgcagttttcatatccagaagagtagatgttctgcatgtgcttacccatcaaagcgcatccgtaaatacaactggagtgtcaaggctattcggagaaagactacaggaacaggacgaatgagatacctgcgtcacatgcctcgtcgtttcaagaataatttccgggaggggacccaggcaacccccaagaagaaggctactgcaaccacattttaaatgatttaagaatgacccaggacgcgaatctcatggctatgtatagaaagatctataaaggcgacttcaagtgcccgccgtggttttcgccttccgttgtgaagatcgtttcaaagctcctggatcctaaccctcggacaagaatcgggatccccaggctcatggagatcccctggttcaggaaaggcttcaaggcaggccggccggtttcccgtgacgatgta

SEQ ID NO: 2255 - DNA, 411 bp, Scabiosa columbaria
ttttcctcttcaactagggtttctgtgaacgccgctacgagcaacaatgggcaaggcaggtaagggaactggaagtttcggtaagaggaggaacaaaactcacactctctgtgtgcgatgtggccgtcgcagtttccatctccagaagagccgatgctccgcttgtgctttccccgccgctcgcgtcaggaaatacaactggagtgctaaagctattagaaggaagacaactggaactggccgtatgaggtatcttcgccatctccctcgccgattcaagagcaacttcagagaaggtactcaagcgccaccaaggaacaaggctgctgttgcatctgcttgaggttattagactgttcttcctcatagagttgttttgttattctaaatgtgtaccaaacctttggtaac

SEQ ID NO: 2256 - DNA, 353 bp, Scabiosa columbaria
actttcctcatattttacctgcaattagggtttctgtaaacgaccacaaacaatgggtaaagccggtaagggaacaggaagtttcggtaagaggaggaacaagactcatactctctgtgtgaggtgtggccgtcgcagtttccatttgcagaagagccgatgctccgcttgtgctttccccgccgctcgcgtcaggaaatataactggagtgcaaaggctattagaaggaagacaacaggaactggccgtatgaggtatcttcgccatcttcctcgccgattcaagagcaacttcagagaaggtactcaagctccaccgaggaacaaggttgctgctgcatctacttgaggtt

SEQ ID NO: 2257 - DNA, 374 bp, Vinca minor
acaaatggtaaaggtacagaagtttcggtagaggcggaacaagactcacacgctttgtgtgagatgcggtcgccgtagcttccatctccagaagagtcgctgtagcgcctgcgcttaccccgctgctcgcgtccgcaaatataattggagtgtcaaggcaatcagaagaaagaccactggaactggtcgtatgaggtatctccgtcatgttccaactagattcaagaccaacttcagagagggcacagaagcagcaccaaggaagaagggagctgtttcagcttcatcttaatatatcagaatcaattttgattttgtttcagttacgggtttttctggaagttaattagtcatttacgcaaaactgtgaatta

SEQ ID NO: 2258 - DNA, 241 bp, Hordeum vulgare
aagggtaccggcagcttcggcaagcgccggaacaagacccacacgctctgcatccgctgcggccgccgcagcttccacctccagaagagcacctgctcctcttgcggctaccccgccgcccgcatccgcaagtgtaagtggagtgtgaaggccatcaggcgcaagaccaccggcactggaaggatgaggtacatgcgccacgtgcctcgcaggttcaagagcaacttcagagaaggtaacc

SEQ ID NO: 2259 - DNA, 319 bp, Eschscholzia californica
gcttccaagctagggttttgaaatctccaactgcaacaatgggaaaaggaacaggaagtttcggtaagagaagaaacaagacccataccctctgtgtgaggtgtggtcgtcgaagttaccatcttcagaaaagcagatgcgccgcctgtggttatcccgctgctcgcctcaggaaatataactggagtgtgaaagctttgaggcgaaagacaaccggaactggtaggatgcagtacctccgtaatgttcctcgcagattcaagagtggcttcagagaaggtactcaagctgcaccaaggaaagttggagcatctgcatc

SEQ ID NO: 2260 - DNA, 512 bp, Fagopyrum esculentum
atataactttaaggcgtttaaccatctaaagcctctgaagaatttagaggaaccgagctgcaagtgcaacaatggggaagggaacaggcagttttggtaagaggaggaacaagacgcacacgctttgcgtgcgttgtggacgccggagtttccaccttcaaaagagccgttgctctgcttgcgcctaccctgccgctcgtctcaggaagtataactggagtgtcaaagcaatcagaagaaagactacgggaactggacggatgaggtatctccgcaatgttccaaggcgattcaagactggttttagagaaggaactcaagcaactcccaggaagcaagtgacagcctcatcttaaagattttaaggcgacattttgtgtaatccattcagtttttgttaccttctcttgaacattgctaaatcaagtttcagatattctattagagttttttattcccaaagtttcattgtagtcagatgttcaagataatccttattgtggtatgtcatt

SEQ ID NO: 2261 - DNA, 683 bp, Tropaeolum majus
cggccgggggagaagcccaaaccagtaggtttcaaagttatatagagaaaccctagttagactttactatataaaaccctcacttctccttctccaccttttcttcgatagaatttgtcttagggttctgcatcaacaaaaatgggtaaaggaacaggtagttttggtaagaggaggaacaagacccacaccttgtgtgtgcgatgcggtcgtcgaagcttccatctccagaagagtcgctgctctgcttgtgccttccctgccgctcgcgtccgtaaatataactggagtgagaaggctatccgcaggaagacaacaggaacaggtcgcatgaagtacctacgcaatgtgccccgcaggttcaagaccaatttcagagaaggtacccaagcaaaaccaaggaacaaaggagcagctgctgcctcgtcttaacttcttaatgggcattgatcatttttgatttaatattatcttttattccgaaatttcgctgaagaatttttgttatttccatatgcaaaaatttgtattaatcattccagatttataaaatttcacttaattatgacattctttttcgtttctacatgatttccacagtagaagatgaggtaaatgttaagagtagaaaattattatgctagaaaatatgttttcttgatttgatattcttaattcgtcgg

SEQ ID NO: 2262 - DNA, 564 bp, Tropaeolum majus
acgataatttcctcaaaacctcacttcagatcctagggttcctgcaacaacacctaaacagtaatgggaaaaggaaccggcagctttggtaagaggagaaacaagacacataccctttgtgtccgatgtggtcgccgaagcttccacctgcagaagagtcgttgctcagcttgtgcattccccgccgcccgcgttcgcaaatataactggagtgagaaggcaattcgcagaaagaccactggaacaggacgtatgaggtaccttcgcaatgttcctcgtaggttcaaaactaacttcagagaaggcactcaagcaactccaaggaagaaaggagccgctgctgtttctgcataagtgatctagtttgtattcattttggtgttcttatatttggaatcaaattttggatcattgtttaaggattactatttactcatatcgaagacatgttcaatgttttgatagctatataaacttttacaaagttattatcttaaaagcttgtttttttttcgttcttgattttgatcaaatgtgcatgcatttcgctgcctaccttggttt

SEQ ID NO: 2263 - DNA, 483 bp, Malus domestica
ctgaaatctagggtttttctctgcaaccaacgaaatgggcaaaggaacaggaagtttcggaaagaggaggaacaagacccacactctctgtgtgcggtgcggccgccgcagcttccacctccagaagagccgctgctccgcctgcgcctaccctgctgcccgtctcagaaaatataactggagtgagaaggcgctgcgccgaaagactaccggaactgggcggatgaggtacctgaggaatgtgccgaggaggttcaagagcggcttccttgaaggtacacaggctgctccaaggagcaagggatctgctgccgcttcctcataagttttcagagcccactgaactcaaacctgtttggatttcgttttgaattttgtttagttgtcttgatagtactgaatttcacttgaattttgtttagactgtctcggttcgcagctgcattttgatatgaatggaaatgactctcagttacaattaca

SEQ ID NO: 2264 - DNA, 504 bp, Unknown
  Sequence found in Organisms: Euphorbia peplus, Euphorbia esula
  misc_feature (48)..(48): n is a, c, g, or t
  misc_feature (159)..(159): n is a, c, g, or t
  misc_feature (162)..(162): n is a, c, g, or t
  misc_feature (236)..(236): n is a, c, g, or t
  misc_feature (305)..(305): n is a, c, g, or t
  misc_feature (438)..(438): n is a, c, g, or t
  misc_feature (458)..(458): n is a, c, g, or t
  misc_feature (483)..(483): n is a, c, g, or t
ggcacgaggattttagcgccgtccagtcctagttctcgtcggagtcangacttctgtgcatcgtcaacaatgggtaagggaaccggaagttttggtaagaggaggaacaagacccacaccctttgcgtcaggtgtggccgccgtagcttccatctccanaanagccgttgctccgcctgtgcttttcccgctgcccgcgtcaggaagtacaattggagtgaaaaggccatccgganaaagacaactggaactggaaggatgaggtatatgccccatgttcctcgcaggttcaagagtggcttcanagaaggcacccaagcaacacctaggcaaaagggagcagctgcagcgtccgcttaagttgaaagaggcatctccagcataagtttttagacagcaagttattaaattttttgttgagacaaattttaaaagaanattgtttgctgaatgtactnggcataatagctatttagttaattngagtgtttctttgatgtgttg

SEQ ID NO: 2265 - DNA, 547 bp, Tropaeolum majus
cggccggggggatagaatttgtcttagggttctgcatcaacaaaaatgggtaaaggaacaggtagttttggtaagaggaggaacaagacccacaccttgtgtgtgcgatgcggtcgtcgaagcttccatctccagaagagtcgctgctctgcttgtgccttccctgccgctcgcgtccgtaaatataactggagtgagaaggctatccgcaggaagacaacaggaacaggtcgcatgaagtacctacgcaatgtgccccgcaggttcaagaccaatttcagagaaggtacccaagcaaaaccaaggaacaaaggagcagctgctgcctcgtcttaacttcttaatgggcattgatcatttttgatttaatattatcttttattccgaaatttcgctgaagaatttttgttatttccatatgcaaaaatttgtattaatcattccagatttataaaatttcacttaattatgacattctttttcgtttctacatgatttccacagtagaagatgaggtaaatgttaagagtagaaaattattatgctg

SEQ ID NO: 2266 - DNA, 564 bp, Tropaeolum majus
cggccggggacttcagatcctagggttcctgcaacaacacctaaacagtaatgggaaaaggaaccggcagctttggtaagaggagaaacaagacacataccctttgtgtccgatgtggtcgccgaagcttccacctgcagaagagtcgttgctcagcttgtgcattccccgccgcccgcgttcgcaaatataactggagtgagaaggcaattcgcagaaagaccactggaacaggacgtatgaggtaccttcgcaatgttcctcgtaggttcaaaactaacttcagagaaggcactcaagcaactccaaggaagaaaggagccgctgctgtttctgcataagtgatctagtttgtattcattttggtgttcttatatttggaatcaaattttggatcattgtttaaggattactatttactcatatcgaagacatgttcaatgttttgatagctatataaacttttacaaagttattatcttaaaagctgtttttttttcgttttcttgattttgatcgaatgtgcatgcatttcgctgccgaaaaaaaaaaaaaaaaaggccg

SEQ ID NO: 2267 - DNA, 394 bp, Thalictrum flavum
tgcaaacaacaaacaacaatggggaaaaggaactggaagttttggtaagaggaggaacaagactcatacactatgtgtgaggtgtggtcgtcgaagttttcatcttcagaagagtagatgttctgcttgtgcttaccctgctgcccgaactcgcaaatataactggagtgtgaaggcgatccgtaggaagactactggaactggtaggatgcagtatatgcgtcatcttccccgtcgcttcaagagcaatttcagagaaggtactgtagcagctccaagaaccaagggtgctgcagctgcttaaatttgaagaagataggaattgcaagcagggatagtagtttggtttggttactgccatttgttaaattttagaaaactttttgaactatta

SEQ ID NO: 2268 - DNA, 705 bp, Vaccinium corymbosum
tctccagtagctcggaagactagggtttctgcagctgcggaacaatggggaagggaacagggagtttcggtaagaggaggaacaagactcacacactctgtgtgaggtgcggccgccgcagttttcatctccagaagagccgatgttccgcttgtgcattccccgctgcccgtaagaggaaatataactggagtgtgaaggcgatccgtaggaagacaactgggacgggtcgtatgaggtacttgcgcaatgtacctcgcagatttaagagtggcttcattgaaggggcccaggcagctccgaggaagaagggagctgcaccagctgtttgaggtagtggaaggttgtagtgatcgatattttgggttccgaattatatttcttttggcattttcaaaccgcattaactttttgggaatatcatgtggacagtgttactccaatttatgcttagtttgtgcttgtgttattccgattgtagttgatttaagtttttgatccgggtggttgggtcagtggttttgaatctccattgtcgcgaggcattaatgagacagaatgttttctattgtcgttgaggtggcacttataaatctaaggatttagatgctgagatcagttttttcgggaatttaagtgcttagaatctagttgactggaagatgtatgagtgcccgtcatttgaatccatggatcttgctctgt

SEQ ID NO: 2269 - DNA, 613 bp, Vaccinium corymbosum
tcttctccagtagctccgaagactagggtttctgcagctgcggaacaatggggaagggaacagggagtttcggtaagaggaggaacaagactcacacactctgtgtgaggtgcggccgccgcagttttcatctccagaagagtcgatgttccgcttgtgcattccccgctgcccgtaagaggaaatataactggagtgtgaaggccatccgtaggaagacaactgggacaggtcgtatgaggtacttgcgcaatgtacctcgcagatttaagagtggcttcattgaaggggcccaggcagctccgaggaagaagggagctgcaccagctgtttgaggcagtggaaggttgtagtgatcgatattttgggttccgaattatatttcttttggcattttcaaacagcattaactttttgggaatatcatatggacagtgttactccaatttatgcttagtttgtgcttgtgttattcctattgtagttgatttaagattttgatccgggtggttgggtcagtggttttgaatctccattgtcgcgaggcattaatgagacagaatgttttcttttgtcgttgaggtggcacttataaatctaaggatttagatgc

SEQ ID NO: 2270 - DNA, 551 bp, Eschscholzia californica
caaaagcttccaagctagggttttgaatctccaactgcaacaatgggaaaaggaacaggaagtttcggtaagagaagaaacaagacccataccctctgtgtgaggtgtggtcgtcgaagttaccatcttcagaaaagcagatgcgccgcctgtggttatcccgctgctcgcctcaggaaatataactggagtgtgaaagctttaaggcgaaagacaaccggaactggtaggatgcagtacctccgcaatgttcctcgcagattcaagagtggcttcagagaaggtactcaagctgcaccaaggaaagttggagcatctgcatctacttaagagaagttgaaggagatatcgaaaaagtaatactttttattaagtagtttgctttagtcttttgttatcatcactatcttggaaaagaatgcttgatgatttgtttaacaagttttgcattagttgtgttgttactttgagaatcgagatggattatttgatgaatactttaatttcttttgctttacatgaagtattggattattgattaacgaaaaaaa

SEQ ID NO: 2271 - DNA, 556 bp, Eschscholzia californica
cgggtaagagcttcgagtcctagtaggttttgattgtatccaactgcagaaatgggaaaaggaacaggaagtttcggtaagaggaggaacaagactcacactctctgcgtgaggtgtggacgtcggagctaccatcttcaaaagagtagatgtgccgcttgtggttatccagctgctcgtcttaggaaatataactggagtgagaaggcgttgaggagaaagaccacaggaactggtaggatgaggtacttgagaaatgttcctcgaagattcaagagtggattcagagaaggtactcaagctacaccaaggaaagctggagcagctgcttctgcttaagaatctggcaagtaattttgttagttatctcgaatttcgttgagaagatgtttgatatttgcttaaaagatgttggcgttagatgttttcttagattgatattgttgaatcgaagagtattttgactttctccttgcattgtttgaaaaattggatttagggttttgatatggatgtttgatcttatattttatggtatataagtgattgctttgaa

SEQ ID NO: 2272 - DNA, 503 bp, Eschscholzia californica
tccaagctagggtttgaaaatctccaactgcagcaatgggaaaaggaacaggaagtttcggtaagagaagaaacaagacccataccctctgtgtgaggtgtggtcgtcgtagttaccatcttcagaaaagcagatgcgccgcctgtggttatcccgctgctcgcctcaggaaatataactggagtgtgaaagctttaaggcgaaagacaaccggaactggtaggatgcagtacctccgtaatgttcctcgcagattcaagagtggcttcagagaaggtactcaagctgcaccaaggaaagttggagcatctgcatctacttaagagaagttgaaggagatatcgaaaaagtaatactttttattaagtagtttgctttagtcttttgttatcatgaatttggttaacaagttttgcattagttgtgttgttattttgagaatcgagatggattatttgatgaacacttcaatttgttttgctttacttgaagtattggatttt

SEQ ID NO: 2273 - DNA, 506 bp, Eschscholzia californica
ttgattgtatcctagaaatgggaaaaggaacaggaagtttcggtaagaggaggaacaagactcacactctctgcgtgaggtgtggacgtcggagctaccatcttcaaaagagtagatgtgccgcttgtggttatccagctgctcgccttaggaaatataactggagtgagaaggcgttgaggagaaagaccactggaactggtaggatgaggtacttgagaaatgttcctcgaagattcaagagtggattcagagaaggtactcaagctacaccaaggaaagctggagcagctgcttctgcttaagaatctggcaagtaattttgtagttatctcgaatttcgttgagaagatgtttgatatttgcttaaaagatgttggagttagatattttcttagtttgatattgttgaatcgaagagtactttgactttcccttgcattgtttgaaaaattggatttagggttttgatatggatgtttgatcttacattttatggtatataa

SEQ ID NO: 2274 - DNA, 611 bp, Tropaeolum majus
ccgcttatctctctctagaacccaaaaatatcacttcctgaccgcttagggcttctcctgcatcggctacaatgggtaagggaacaggtagtttcggtaagaggaggaacaagacccataccctctgtgtgaggtgtggtcgtcgtagcttccatctccagaagagtcgttgctctgcatgtgctttcccagctgcacgcaagaggacatataactggagtgagaaggcaatccgaagaaagactactggaacaggtaggatgaggtatcttcgcaatgtgcctcgcaggttcaagactggtttcagagaaggtactcaagctgccccaaggaagaaggctgttgctgcatctacttaagcccatataaaatctactaccttttggactttagttgtggaacggagtttttactttgcttcattgtttttcttttagatttttgttctgtttagaatttcacatggctttgatctctgacatttgtcttttatgtattttctttagttttgatcgagatctttaagttttacaattgttgttacaactttgttttttatgctttgattgaaattaactaatcttgtttgtcttcaatgctataggtgttta

SEQ ID NO: 2275 - DNA, 662 bp, Rosa hybrid cultivar
cttctccgtcagttttcccccacactcacacacccatccagatttagggtttctgcagcagccaaacaacgaaatgggaaaaggaaccggtagctttggcaagcgccgcaacaagacccacactctctgtgtccgatgtggacgccggagcttccacctccagaagtctcgctgctccgcctgtgcttaccccgccgctcgcctcagaaaatataactggagcgagaaggctctgcgcagaaagaccaccggaaccgggcgcatgaggtaccttcgccatgtgccgaggaggttcaagagcggcttccttgaaggtacacaagctaagccaaggagcaagggaactgctactgcctagatttgagaggaagtagaatccaagtttgatttgttttattttcgattcggtagtttctggattttgtgaaatcaattttggatcattgttgttgaatgattaagacaagctttgtttatgtgctagagagttattatgaatgcgaagtactcttaccgttttatctatattgttgatcaatgatttagattttctggtatgcgtatgtagttaacaaaccttaggctttattcagtatatgaatgcttataaagtctaattaaaacaggtgcggcctattcattttgctaaaaaaaaaaaaact

SEQ ID NO: 2276 - DNA, 452 bp, Arnica chamissonis
gggtaagggaaccgggagtttcggaaagaggaggaacaagacacacacactgtgtgttcggtgtggccgccgcagctttcacctgcagaagagccgatgctccgcctgcgcctatcccgccgcccgcgtcaggaaatacaattggagtgagaaggcaatcagaaggaagactactggaactggtcgaatgaggtacctccgtaacgtgcctcgtaggttcaagagcggctttagagaaggtactcaagcaaccccaaggagcaaaggagctgctgccagcacttaggtttgaaggaagattttaatgtattttagtgcttttgatttatgcctgtttgcttggactttgatgctttgtttttggtatgtgagcgaaagcagatactttctgttgaattctttttccatttatgcgcaatgcgtacctaaatttgtaacgtctctttaaggag

SEQ ID NO: 2277 - DNA, 444 bp, Arnica chamissonis
tgtttttctttgtttcgagagatgggcaagggaaccgggagcttcggaaagaggaggaacaagacacacacactgtgtgtgaggtgtggccgccgcagcttccacctgcagaagagccgctgctctgcctgcgcatatcctgctgctcgcgtcaggaaatacaactggagtgagaaggcgatcagaaggaagactacaggaactggtcggatgaggtaccttcgtaatgttccccgtaggttcaagagtggatttagagaaggaactcaagcaaccccaaggagcaaaggagcagttgccagcgcctaggtttgaaaggagaggtttgatgtattttattatttgatgttgaaaaaagagattttgatttatgtttgtttgcttgtttttacaagtggaataagtactagaatagacttaataggaacctgaatttagactaag

SEQ ID NO: 2278 - DNA, 517 bp, Cleome spinosa
cttcttcttttctgaagccggaatctagggttttttcttgcgctcgcctccgctgcaatgggtaagggaacgggaagtttcggaaagaggaggaacaagacccacactctctgtgtgaggtgtggacgccgcagcttccacatccagaagagtcgctgctctgcttgtgccttccccgctgctcgcaagaggacctacaactggagcgtgaaggccatccggaggaagacaactggtaccggaagaatgaggtatcttcgccatgtccctcgcaggttcaaaaccggattcagagaaggtactgaggcaaagccgaggaacaaggcagcagcctcgtcggcttaagtcaatttaagcattcacagggagagtaatttttgtagttttggtttctcttctgcttgagactattcatgtttgttcttgtgtcttctatttgaaaaagtattggacagagatggaaatgctgcttacattttgaaaccctttattgattatttgtgttttgacaagaaac

SEQ ID NO: 2279 - DNA, 292 bp, Cleome spinosa
agggcgtcggctgcaatgggtaaaggaacgggaagctttggaaagaggaggaacaagactcacactctctgtgtgaggtgtggacgccgcagctttcacattcagaagagccgctgctctgcttgcgccttccccgccgctcgcaagaggacgtacaactggagtgtgaaggccatcaggaggaagacgactggcacaggaagaatgaggtatctccgccatgttcctcgcaggttcaagaccggtttcagagaaggcaccgaagccaagccaaggaacaagtcagcaacct

SEQ ID NO: 2280 - DNA, 682 bp, Gossypium hirsutum
gggaaagggaacagggagttttggtaaaagaaggaacaagacccacactctctgcgttaggtgtggccgccgtagcttccatctccagaagagccgttgctctgcctgtgctttccctgctgctcgtaagaggacatataactggagtgtgaaggcaatcagaagaaagaccactggaaccggtaaaatgaggtatctgcgccatgtccctcgcaggttcaagactggtttcagagaaggtactgaagcagcaccgaggaagaaggttgtagcagcttctgcttgaggtattacaaggttgttttggatgaagccttctttttttaggaaaacttttacgagaacatttttcttgaggggtgtcattacattgaatgctttagctgtttttagtttatgattatggagttgcattaaattttgaacaaggatgaatgctttagtttttctctagtttatttttgaggagttgcttcaaattttgaacgaggatggacaaggctattgttggttgacacttagttacttgatacatttttttgggatgaagttaatgtatgttcttgtttttggttagaaatgatgccctaatattgtttcaagatagtttaaaatttaaagtcatttgtgtttcgcttattattatcaacactacttctagtcgaatattgtgttcggagaa

SEQ ID NO: 2281 - DNA, 590 bp, Distylium racemosum
cggagaagagatcggagcagcggagccgaggaggaagccgtaacaggcaacaataacaatgggtaaaggaacaggcagctttggtaagaggagaaacaagacccacacattgtgtgtgaggtgtggaagaagaagttttcacattcaaaagagcagatgttctgcttgtgcttatccggctaaacgcattcgcaaatataactggagtgcaaaggcaattcgaaggaagacaactgggactgggagaatgagatatcttcgtcacatgcctcgtcgattcaagaacaatttcagggaggggactcaggctacacccaggaagaaggctgcttccacatcattttaattttgttaaagaactaggctgtagatgttaggattgtcattttgttagcaatatggcaccctgctggaagtggccacgtggtgcctggttgcaatgtgtaccggagctactgtggcttatggcaacttgcgttgttttcgtaactgaagttatgtttactgaaattttgaaattttttgagcttgaactctttgtttctgcggtattttttttaatgggtacatctacatttcttgtagaatta

SEQ ID NO: 2282 - DNA, 588 bp, Distylium racemosum
accctgtatgttttggaaaggaagaggaggacgaagcgactggccgttgcagaggtgatagcgaggtgctgcagcagcaacaacaatggggaagggaacgggtagtttcggaaagaggaggaacaagacgcacactctttgcgtccgttgtggtcgccgcagttttcacatccagaagagtcgatgctctgcctgtgcttaccctgccaagcgcattcgcaaatataactggagtgccaaagctattcggagaaagactacagggactggaaggatgagataccttcgtcacatgccccgtcgattcaagaataatttccgagaggggactcaagcaaccccgaggaataaggctgttgctgcctcatcttaaatctagtaatgggtatgttgagttggaattataaattccactatggtttggtacattttgcattgtttttctgtttcacaaccgttaccaatttttggaacttgattttataagaaaatacttctccaccttttggttgatattgtaataacatttttttcccaaaatagtgaacaaatttattatgatgactcaactagataacttctatgtct

SEQ ID NO: 2283 - DNA, 460 bp, Flaveria ramosissima
cttcctgaagctgagagtagttgtgtttttcttctcgtcaatctgcagaaatgggtaaaggaacaggtagtttcggtaagaggaggaacaaaacacacacgctgtgtgtaaggtgtggacgacgaagctttcatctgcagaagagccgatgctctgcttgtgcttatcccgccgctcgcctcagaaaatacaactggagtgtgaaggcaatcagaaggaagactacaggaacaggtcgtatgcgttacttgcgtaacgttcctcgtagattcaagagcaacttcagggaaggaactcaagcaacaccgaggaccaaaggaactgtttccagcacttaaagaagcaccagcttttggttgtttttgtatttatatggtttcaaaaaaccaatcttgggatatatgtttattctactgtttcttgttatgactattctttgttatttatgagcattaaaatg

SEQ ID NO: 2284 - DNA, 521 bp, Actinidia deliciosa
gtccttgagatcgttttcctgcgaagctagggtttttctgccaaagagatgggaaaaggaacaggaagcttcgggaagaggaggaacaagactcacacgctgtgtgtgagatgtggccgccggagcttccacctccagaagagccgatgctccgcctgtgccttccccgccgcccgcaagaggacatataactggagtgtgaaagccattcgacggaagaccactggaactggacgaatgaggtatctccgccacattccccgcaggttcaagagtggcttcatagaaggtactcaagcagctccgaggaagaagggggctgccccaatttcttaaagttccaaaacattctgccgatctcagtttccattctcttgaactttgtaagaactaaattttggggtttgaatacttattattgcttattatcagtcacaagctgttgttattttggataaattgaatgatttgtgttttattttggaaatagaagttggttacttattatctttgaaaaaaaa

SEQ ID NO: 2285 - DNA, 581 bp, Tropaeolum majus
cggccattacggccggggagaacccaaaaatatcacttcctgaccgcttagggcttctcctgcatcggctacaatgggtaagggaacaggtagtttcggtaagaggaggaacaagacccataccctctgtgtgaggtgtggtcgtcgtagcttccatctccagaagagtcgttgctctgcatgtgctttcccagctgcacgcaagaggacatataactggagtgagaaggcaatccgaagaaagactactggaacaggtaggatgaggtatcttcgcaatgtgcctcgcaggttcaagactggtttcagagaaggtactcaagctgccccaaggaagaaggctgttgctgcatctacttaagcccatataaaatctactaccttttggactttagttgtggaacggagtttttactttgcttcattgttttcttttagatttttgttctgtttagaatttcacatggctttgatctctgacatttgtcttttatgtattttctttagttttgatcgagatctttaagttttacaattgttgttacaactttgttttttatgctttgattgaaattaactaa

SEQ ID NO: 2286 - DNA, 465 bp, Nicotiana benthamiana
  misc_feature (253)..(253): n is a, c, g, or t
  misc_feature (295)..(295): n is a, c, g, or t
  misc_feature (330)..(330): n is a, c, g, or t
  misc_feature (375)..(375): n is a, c, g, or t
  misc_feature (382)..(382): n is a, c, g, or t
  misc_feature (404)..(404): n is a, c, g, or t
  misc_feature (446)..(446): n is a, c, g, or t
  misc_feature (455)..(455): n is a, c, g, or t
gtaaggttttcccacatccgctgcacaaatgggaaaaggaacaggtagttttggtaagaggaggaacaagacacacacactgtgtgtgagatgtggtcgtcgcagcttccacatccagaagagtcgttgttcagcttgtgcttaccctgctgctcgtctcagaaaatataactggagcgtcaaggcacttaggagaaagaccactggaactggccgcatgaggtacctccgcaatgtaccacgtaggtttaanaccaacttcagagaaggaaccgaggctactccaaggaagaanggtgctgctgtaacctcttaaagtttttaaattancagttcaactgtttcgttttgatattttgctttacattcctgatnaatggantcttggatatttgacctctgantattatctctcatttgtaatgtggaagtggttcctatttaanacagatccnaaaaaaaaaa

SEQ ID NO: 2287 - DNA, 898 bp, Populus trichocarpa
gacccaaattctcagtagcccaaaaaataaaaaccaaaaaaaggagctcttctaggtgtttctttgcatctgtgctgccatggggaagggaacagggagttttggtaagaggaggaacaagacccacaccctctgtgttaggtgtggccgccgtagcttccacctccagaagagccgttgctccgcctgtgctttccctgctgcccgcaagaggaaatacaactggagtgagaaggcaatcaggaggaagacaactggaactggaaggatgaggtatctccgcaatgttcctcgcaggttcaagagtggtttcagagaaggcactcaagcagaaccaaggaagaagggcacagcggcatctgcttaagccgtgagtcatttttgagcgtgttatctgggtaccctcttgtagatttacttgcaacttatgcattggggagttttgttagaacgtcgttcaatgggtgctattcaccttttttatgctatttagataattttacatttcctaattatgtagttggtttgattctgaaagaggatgttgcgactgttattcgatttgctctatgtttttgaggaagtttttgaaaatttctggcctggtaactgctattgactactgactgagaccccatggtgctgtgaaatcagaaaatccatagcaagatatagttggtgtaccttacaattcgttataaaatttattgcaatctgttggtccgagcaagtatatcccctggccaaagattggatgatgttgagtaaacttcatcttcagtaatgtattcaaatatataaacgctatgtgatgaatatgtaatgggatgagatgatttattacctttcctttatttgggtgcaaatctattagtaatgtaatgaaggaggttttgca

SEQ ID NO: 2288 - DNA, 611 bp, Fragaria vesca
agttttcccgcacacacacaccaccagatttagggtttccgcagccaaacaacgaaatgggaaaaggaactggtagtttcggcaagcgccgcaacaagacccacactctctgtgtccgatgtggacgccggagcttccatctccagaagtctcgctgctccgcctgtgcttaccccgccgctcgcctcagaaaatataactggagtgagaaggctctgcgcagaaagacgaccggaaccgggcgcatgaggtaccttcgccatgtgccgaggaggttcaagagcggcttccttgaaggtacacaggctaagccgaggagcaagggaactgctactgcttagatttgagaggaggaatccaagtttgatttgttttgtttttttcgctttcggtagttctggattttgtggaatcgattttggatcgttgttgtttgaatgattaagacaaggttttgtttatgtgctagagagtttatcatgaatgccaagtactctaccgttttatctatattgttatgctagaattatataatgtggattagctgtttctagtattcatgtagttaatacaatatttgaatgcaaaccaaggatagttggacatgtgct

SEQ ID NO: 2289 - DNA, 568 bp, Triphysaria pusilla
aacgaaataccgcaattagtcacggagatataaagctctccacgacgccgcttctctatctttgaactcagagctcgctcgggatttatcatttctctagggtttctgcagtttcacagcaatgaccaagggaacaggaagctttggtaagagaagaaacaagacacacactctgtgtgtgaggtgtggccgccgcagcttccaccttcagaagagccgctgctccgcctgtgcttacccggccgctcgcaagaggacatacaactggagcgtgaaggctatccgtagaaagaccaccggaaccggacgtatgaggtatctccgcaatgtgccccgcagattcaagaccaacttcagagaaggtactcaagctgcaccaaggagcaagtcggttgctgcttctgcttaaggatctttgatttggagggtacttttgattgtactgttatttttttgccatcttaaaattgttagagaacatttgaaatgtgggaacatgctatctttaatgatgaagaccatttattgttttgatgtgcttctatatggatgtctactttctttccct

SEQ ID NO: 2290 - DNA, 743 bp, Gossypium hirsutum
ttcagagcccaaagaatcaactcttggggttctcctgcgtcagctccaatgggaaagggaactgggagttttggtaaacgaaggaacaagacccacactctttgcgtgagatgcggccgccgtagcttccatctccagaagagccgttgctctgcctgtgctttccctgctgcccgtaagaggaaatataactggagtgttaaggcaatccgaagaaagaccactggaactggtaggatgaggtatcttcgccatgttccttgtaggttcaagaccggtttcagagaaggtactgaagcagcaccatataattggcaatagaatttgaaagaaaaataagttatagaagtcctctaacgtagaaataacgaagcaattcacataacaaatagcagacaacatcacatttcatatgcaaataaatccaaacccacacactagacatcctcctcatcctcccgatacatcttcatcatctcagcacagccaacttcagccttgtcaaccatgaagccccatgctattggcataacgggtggtggatgaaatgccattggagttggtcaagataacacgggcacgttcacgaccggggggacattgtggcacatccaagctgggggctcttcacagaactgcatcacagatctgatccaagtgatccttcggatacacgaatctggtattttccggttttgtcggtattatccctccttctcgaaacaactccgccggtcttcctg

SEQ ID NO: 2291 - DNA, 1252 bp, Eragrostis curvula
  misc_feature (522)..(522): n is a, c, g, or t
  misc_feature (526)..(526): n is a, c, g, or t
  misc_feature (530)..(531): n is a, c, g, or t
  misc_feature (537)..(537): n is a, c, g, or t
  misc_feature (542)..(542): n is a, c, g, or t
  misc_feature (553)..(553): n is a, c, g, or t
  misc_feature (555)..(555): n is a, c, g, or t
  misc_feature (559)..(559): n is a, c, g, or t
  misc_feature (576)..(576): n is a, c, g, or t
  misc_feature (581)..(581): n is a, c, g, or t
  misc_feature (600)..(600): n is a, c, g, or t
  misc_feature (608)..(608): n is a, c, g, or t
  misc_feature (611)..(611): n is a, c, g, or t
  misc_feature (617)..(617): n is a, c, g, or t
  misc_feature (623)..(623): n is a, c, g, or t
  misc_feature (625)..(625): n is a, c, g, or t
  misc_feature (651)..(651): n is a, c, g, or t
ctccgcagcgccgagacagacgcacacgctctgcatccgttgcggccgccgcagcttccacctccagaagggcacctgctcctcttgcggctaccccgccgcccgcatccgcaagtacaactggagtgtgaaggccatcaggcgcaagaccactggaactggaaggatgaggtacatgcgacatgtgcctaagcgctttaagagcaacttcagagaaggtactgaggctgccccaaagaagagagctgctgccaactaagtctggagttttcttcgagaagctcaagctagaattttgagaacattttgcttggattgtactttctaaagtatcagaatactatgaagcattgtgctttgatgtgtttaagtgatcttgacttgtttggctctcctgggtcagcgcgttattctcctgttgttttgcattggcgtattatggtaacgtttgtactcctaagttattctcctgggtcagtgcgttattctccaaaaaaaaaaaaaaaaaaaaaaaaaaaaaantccncggnnttaaanccccngtttaatcaantncccncgcccccctggggggcnggaancatgcaaccccggccccanttcccccnaangggggncaaatnanatttccggggccgtcttttaaaaaanttgccggacgtcgttctgttgtcttcgactctggttcttctacttttctcttttccccccttcgctgtgtagtccccaatatttcccagaatgaccatccaaataaccatactacatcgtcatagaaatacccgtattaagaaaacaggccaatcagaagtgtctaactctccttccctactgcaaggaatttgagaaagcttacatgcgagagaccccactcttgacaatgatttctgtaagtttacaaaaaaaaattcagtactaagcacacaaacaatgcctacgcaaccggatttcccaactctatattaaccaccatcatatgttgttgccgctagatttacattgtgggtatagacatatgagtcttaaagtaactaatgaaaacaaaataaaaaaaaatataccttataaacccaaaaactaatacacctcattgatatatgtaattataactctacttactcaattcatattaaacttacacttcaattccgtaatcaaacctatcaaaaccaaatctgtacaacctagtcggttcatataatttactaaaccaacttttatcatatatgtaaagtatctcgatattgtctta

SEQ ID NO: 2292 - DNA, 606 bp, Carica papaya
gggaaagggaacagggagtttcggtaagaggaggaacaagactcacactctctgcgtgaggtgtggccgccgcagtttccatctccagaaaagtcgctgcgctgcttgtgcgttcccagctgcccgcaagaggaaatataactggagtgtcaaggcaatccgaaggaagactactggaactggtagaatgaggtatctccgacatcttcctcgcaggtttaagagtggcttcagagaaggcgctcaagcgacaccaaggaaagcagctgcagcatcaagttaagtggtcagaggttcataatgggcataatttgtagttttaaattgaattctatgtgcttgagacagttttttccatgggaaagttttgaaggattttcattatgttttcatgctccattgatttttagtttcacttactaagtagatactttaattttgggccacatggatgatgccattgttgtttgttgatccgttggttccttgtgctttaatgagactagatgtgtttcttcttctcgatgagatggatttattatttttaataagggagtactagcagtgacaacagatcttctaagatatattcataatggttttttt

SEQ ID NO: 2293 - DNA, 447 bp, Arnica chamissonis
ctcttctcaatctgcagagatgggtaaaggaacagggagtttcggtaagaggaggaacaaaacacacacactgtgtgtaaggtgtggacgacgcagctttcatctgcagaagagccgctgctctgcttgtgcgtatcctgctgctcgcgtcagaaaatacaactggagtgaaaaggcaatcagaaggaagactactggaacgggtcgtatcgcgttacctgcgtaatgttccccgcaggttcaagagcaacttcagggaaggcactcaagcaacaccaaggaccaaaggagctgtttccagcacttagaaatgaagaacaattttgggttgtttttgtattcatatggttttcagtaaaccaatcttgggatttatgtttttgttatttatgagcactagaatgttgaaaaaaatatatgggaaagagtcacatctctattcattag

SEQ ID NO: 2294 - DNA, 701 bp, Sarracenia psittacina
aaagtcgccttttatcttcttcctcaagagctgagaagattagggtttccgcagccgcgaatcaatggggaagggtacggggagcttcggtaagagaaggaataagactcacactctctgtgtgaggtgtggtcgccgcagttttcatctgcagaagagccgatgcgccgcctgtgcttaccccgcagctcgtaaaaggaatataactggagcgagaaggcgattcgaaggaagacaactgggacaggtcgtatgaggtacctacggaacgtgcctcgcagattcaagactggattcagagaaggaacccaagcagctccgaggaagaccaccgcagcagcttctgcttgagttggtggaaggcttcaagggacgtcgtttggtgtactgaactatagtttcgtttggcgttttcaaatgttgggatcgagtttgtttttaggaacttcatttgggtagtgtttctctgattgaatacttgatttgcactttttgttatcttgatatgcagttacttttgaattttttgatacggatggacgagtctattgttttgattccccattcttcaggctttaatttagatattgagaggcatcaaaaaataaatcggtattatgagttttgttttctcattgtggtgccatttgaaaatatgaaggatttaaaaagatcaaagaaaagcagtttcattcaccatc

SEQ ID NO: 2295 - DNA, 1576 bp, Thalictrum flavum
ttacagtgaacaattcaatgatagcaattgactacaccaggagttttataacaatcatttttgaattgggattttgctgaagttattgctctttattaagcataacatgcatattttcttccatccatcttgccatatttgcagccctcatcgtcagtacctgtggcactcaaggagacatccttattttaaggtcattagcccgcgtgcctcctcccaagtgtctgcctccccatccaactcgaacagattattgcactcccagatgccggagaacagcatgaacatatcaggttcctcattagcatcatcaatttgtaatcgttatcggttcttaccccaattaccattctctcaagtattctacattcaaaggagcagcccaggagatggggttgtttcaaaggaacactctcattgtcaacaccatgcgtgaatgctacgaaacaaagatgtcgtagaagctttggatagaactctacaagatttgtttgattgtgatttgtcgtttggtggaaatattattctcttgggcgaagattttaggtctatattactgaagaactgctggctttcgctcaccgaaattggtcaccatttttcccttcagagtttacctcctcctttttgggggtctactccaagtgcaaccctttgtttgtgttggtgcagagttctttcaggaagctgacttcctaatttaaaggtgcttgccctgaaactgctctacccaggcaatgaaagatgcaacaaattatgtgcttcgcccaaatccttcaatacatacatgtagctcaatggttggctcccctgcttggttgaattaacccaaatattgaactgcaatgggattttcgtggtccacatcatatattctcaagttctatcttagtacctggatctcttgcaaccaatgcagcttcactaatttgtgtttttctccattaccggttcgtgcgtagcaccgacactaaacgctagttacagtttagttggagcaatcgattagtagtgcaagactgtgtggccgaaaagcccaaagtggtaggtgtataacactctgaaagcccagcccaataataaatgggccgattcatcactcggacgatttgtcaatcactctgtctgtccctagataaacataacccttcacatcttctacatcaaggcgaagcgaagaggggtttcagcttcggcgatggaacaggaagtttcggtaagagaaggaacaagactcatactttgtgtgttcgatgtggacgtcgaagtttccatcttcagaagagtcgttgtgctgcttgcggttatcccgcaagtcgaatcagaaaatataactggagtatgaaggctattagaaggaagacaactggaactggaaggatgcagtatcttcgtaatgttcctcgcagattcaagagtaacttcagagaaggtactcaagcagctccaaggagtaagaatgctgctggatctgcttaaagtgttaaatgagcattttgcggcactatttttgtagttcgttaaaatttgtgattgtgagttagtatttagcattttttgttcaaaaccagttgaa

SEQ ID NO: 2296 - DNA, 440 bp, Fraxinus spp
gtatataataattacccaataattcagcagcaactttgaacctctatcttcgattcgctcatgggaaagggaacggggagtttggtaagcgaaggaacaaaactcacactctgtgtgtgagatgcggtcgccgcagcttccacatccagaagagtcgttgctcagcctgtgcttaccccgccgcacgcgtaaggaaatataactggagtgtcaaggcgatacgaagaaagaccactggaactggtcgtatgaggtatctccgtcatgtagctgttaggttcaagagtaacttcagagaaggtactcaagcacctccaagaaagaaaggcgctgctgcagcatcgtaaggtcttgaaggaaatcctgaatcttctaatatcaatatctttaattttgcgagagaaaatcgagttttggtttattcagtgttggttatcgac

SEQ ID NO: 2297 - DNA, 344 bp, Gerbera hybrid cultivar
gttttactccattttcagactgggtaaaggaacaggagcttcggtaagaggaggaacaagacacacacactgtgtgtaaggtgcggccgtcgcagctttcatttgcagaagagccgatgctctgcttgtgcttatccggctgcacgcgtcaggaaatacaattggagcgagaaagcaatcagaaggaagactacaggaactggtcgcatgaggtaccttcgtaatgttcctcgcaggttcaagagcaactttagagaagggactcaagcaaccccaaggagtaaaggagcggttgcgagcgcttaggtttgaaggaagattttgatgtattttggtatcaactg

SEQ ID NO: 2298 - DNA, 579 bp, Vaccinium corymbosum
tcctgctgcgcaccaatggggaaggggaacagggagttttggtaagaggaggaacaagacccacaccctttgtgtgagatgtggccgccgcagcttccatctccagaagagccgatgctctgcttgtgctttccctgctgcccgcaagaggaaatataactggagtgtgaaggcgatccggaggaagacaaccgggactggtcgtatgaggtacctccgcaacgtgcctcgcagattcaagagtggtttcagagaagggactgaagcagctccaaggaagaaggcagcagcagctactgcttaagccattgaaggcttgtatcgggcgtgatttagggtactgaattgtggtttcattttcaagtgtaggaactgagttcactttgggaacctcatttggaggctgttgctccaatttgatatctgttttaagatttttggtcttttaatctgtagtttattcgagtttttgatacaaatcagacttgctttgaattcccagtatcctgagtctaatgagatattacgatttgcatggtatgattgaggtgcaagatagattatctacttttgatactt

SEQ ID NO: 2299 - DNA, 523 bp, Eschscholzia californica
caagctaggtttgaaaatctcaactgcagcaatgggaaaaggaacaggaagtttcggtaagagaagaaacaagacccataccctctgtgtgaggtgtggtcgtcgaagttaccatcttcaaaaaagcagatgcgccgcctgtgggtatcccgctgctcgcctcaggaaatataactggagtttgaaagctttgaggcgaaagacaaccggaactggtaggatgcagtaccttcgtaatgttcctcgcagattcaagagtgggttcagagaaggtactcaagctgcaccaaggaaagttggagcatctgcatctacttaagagaagttgaaggagatatcgaaaaagtaatactttttattaagtagtttgctttagtcttttgttatcatgaatttgtttaacaagttttgcattagttgtgttgttattttgagaatcgagacggattatttgatgaacacttcaatttgttttgctgtacttgaagtattggtattcttgtatgtatggtatctaatgagt

SEQ ID NO: 2300 - DNA, 668 bp, Carpinus betulus
ttccttctgcaactaaagaaatgggaaaaggaacagggagctttgggaagaggaggaacaagacccacacgctatgtgtgcgatgcggacgcagaagcttccacctccagaagagtcgctgctccgcctgtgcctttcctgctagccgcgtcagaaaatataactggagtgagaaggccattcgcagaaagacaactggaactggccgaatgaggtacctccgtcacctgcctcgcaggttcaagactaactttagagaaggtactcaagcaactccaaggaacaagggaacatctgcagccccttgaagtttggaagggcatgctgttctgttttttttaaaaaaataaatatatattataatccggaattctcaaatcaaattttgaatcattgtatgagtgttactttaatttattatcttcgagttatctctgccaaaattttgataatcagtagtaatttctttgaactaagtctctcttgtgtgtttatgaataggtttccgatgttgagaaaattgtgcctgatgtgattaatttcatgtctgctgcttaataattttagtttcagctttatgaattagaaaaaaaaaaaaaaaaaaaaaacaaaaaaaaaaaaaaaaagtaaaaaaactaactagacgttgtataaccacctacgctact

SEQ ID NO: 2301 - DNA, 526 bp, Arabidopsis lyrata
acctaccgtcgtcacttccttctcctgaagccggaaaccttaaggtttttatctggaaaaaaaaactcgcattcgcttcaatgggtaagggaacgggaagtttcggaaagagaagaaacaagagtcacactctctgtgtcagatgtggccgtcgcagtttccacatccagaagagtcgttgctctgcttgtgcttatcccgcagctcgcaagaggacttacaactggagtgtgaaggcaatccgtagaaagactactggaactggaaggatgaggtatctccgcaatgttcctcgcaggttcaagactggtttcagagaaggtaccgaagccaagccaaggaacaaggcagcagcttcatcagcttaaactggtttttgagcatcaagggagagagagctctgagtttgtttgttcacaagattattatttttaagtacctgattatgacttcctctttgtgtgctctttacttttataaagttttggacttggatgatatttcaatttgcaagtcttttttctct

SEQ ID NO: 2302 - DNA, 522 bp, Arabidopsis lyrata
taaaagttgagcatcttcttctctgaagccgtatcctagggttttcttgcacgcaattcgctccaatgggaaagggaacaggaagtttcggtaagaggaggaacaagagtcacacactctgtgtgagatgtggtcgtcgtagtttccacatccagaagagtcgttgctctgcttgtgcttacccagctgctcgcaagaggacttacaactggagtgtgaaggccatcaggaggaagactaccggtaccggaaggatgaggtatctccgtaatgttccccgtcggttcaagactggtttcagagaaggtactgaagccaagccaagaaacaaggcagcagcttcatcagcttaaagagccagttcgagcaatctctcaggaaggactaagacttagcacttttcgcacttatctagttgaagattacttttcatgtggatctaatacattaaatgttttgtttctttttcgtcagtcacttataaagttttgaacttggcttaaatatcatcttacatttgca

SEQ ID NO: 2303 - DNA, 532 bp, Brassica oleracea
  misc_feature (13)..(13): n is a, c, g, or t
  misc_feature (28)..(28): n is a, c, g, or t
  misc_feature (459)..(461): n is a, c, g, or t
gtccgccaccttnttcagataaattggnagttattaaaattgaagggtcttcttctgcttccttttgaagctgaatccttaggacacgcaactcgctccaatgacaaagggaacagggagtttcggaaagaggaggaacaagagtcacactctgtgtgtaagatgcggtcgtcgtagctttcacatccagaagagtcgctgctccgcctgcgcgtaccctgccgctcgcaagaggacctataactggagtgtgaaggcgatcaggaggaagactacaggaaccggtaggatgagatatctcaaaaatgtcccccgccgcttcaagacttgtttcagagaaggtactgaagccaaaccaaggaacaagggagcagcagcagcttcatcatcctaagaaaaatgagtccattccgtctaaagcgcaacaaggagtaaagcctacctttgtatctcattatnnntagttcagtagttgtgataacaatatgttacgttttattgtgtctgcctataaagttttgagcgttcagtc

SEQ ID NO: 2304 - DNA, 577 bp, Cleome gynandra
tgaagccggaatctagggtttttacttggtctcgcgtcctctgcaatgggtaagggaacgggaagtttcggaaagaggagaaacaagacccacactctgtgtgtgaggtgtggacgccgcagcttccacatccagaagagtcgctgctctgcttgcgccttccccgctgctcgcaagaggacctacaactggagtgtgaaggccatcaggaggaagaccacaggcaccggaagaatgaggtatctccgtaatgttcctcgcaggttcaaaaccggattcagagaaggtactgaggcgaagccgaggaacaaggcagcagcctcatcagcctaagccattttaagctttcacagggaagagtaatttttgtagtgttggttcccttttgctcgatactatgcatgaggagctgatgaagcatctcttatgtttttcttttgttctccacttaaaaagttttggactgagatccaattatgacttacctctggaagccttatattcataatttgtgtttttgacaaaggcataaatttcttttactattcggttacattatagatacggttcatctacc

SEQ ID NO: 2305 - DNA, 532 bp, Cleome spinosa
tctcacatcggctagggtttctcctccatctggttcaatgggaaaaggaacgggaagtttcggtaagaggaggaacaagactcacacgctctgtgtgaggtgtggccgccggagcttccacatccagaagagccgctgctctgcctgtgcttttcccgccgctcgcaagcgaacgtataactggagcgtgaaggccattcggagaaagaccaccggaactggtagaatgaggtacctccgccatgtgcctcggaggttcaagactggctttagagaaggcacccaagcaacaccaaggaacaaggctgcttctgcgtctgcttaggcaatcaatgagtgaatccttggaactgggcacatgattcaatgagcctataactcctcaaagaatacagatgtgggttttgtttttgttttttttctaatgcttattatgtagtttttgtttaaattttggacaagaatggatgttgttgcttggcatttttgttatcgtactatgtccttgttcagttttgatatgcttcagaac

SEQ ID NO: 2306 - DNA, 681 bp, Cyamopsis tetragonoloba
cacgaggggaacagggagcttcggtaaaaggaggaacaagacccacactctctgtgtgaggtgcggccgccgcagcttccacctccagaagagtcgctgcgctgcctgcgctttccccgccgctcgcaagaggaaatataactggagtgtgaaggccattaggagaaagaccactggaactggtaggatgaggtacttgcgtcacgttcctcgaagattcaagagcggattcagagaaggtactgaagctgcacccaggaagcgaggatctgctacaactgcttaaggttttaaatgatctttttttgctgtactagttaattataggagtaaaggtttccttgttggacttgagctccatggaacttttttctttctggcatttttatttcctttactatgtagttgttttattatatttcaacatgaggattggaagacattttggttgttcagtgagctttttgacatcaataatttcgtgctttattattatactccatagaaaactttaaggactaaacaacttaaatactccagtttcccaagaggaaaaggtacctgctaacgcatttaaagtgggatccaatgctcttcttttatacagtgcttacgctgaaaatggcaacgcaccgaagagcacaatatgtgaaagactttgaaccgggatccagccctttt

SEQ ID NO: 2307 - DNA, 595 bp, Raphanus sativus
  misc_feature (164)..(164): n is a, c, g, or t
  misc_feature (296)..(296): n is a, c, g, or t
acgacgccgaaacctcaagtgttttcttactcgcattcgttgcaatgacgaagggaacgggaagtttcggaaagagaaggaacaagagtcacacactctgtgtgagatgtggccgtcgcagtttccacatccagaagagccgttgctccgcctgtgcctacccngccgctcgcaagaggacctacaactggagtgtgaaggcaatccgtagaaagactacaggaactgggaggatgaggtatcttcgcaatgtgcctcgcaggttcaagaccggtttcagagaaggtaccgaagcnaagccaagggtcaagtcagcagcgtcttcgtaagcttaaaccggtgcattgattagtcgcgggaagagttacaactttagtttttgggcttctgagtttgtttggaagattacttttttattttattgagcatctgataactactttcctttggtatcttttcactttcttttatataaaattttggacttggatgaaatttagtttacctctgcaatccgcaagtctttgattccattattttgtgttagactattccttaaggttcttttttcctttatcgacgggtgtttatcata

SEQ ID NO: 2308 - DNA, 543 bp, Raphanus sativus
ggattcacgacgccgaaaactcaagtgttttcttactcgcattcgttgcaatgacgaagggaacgggaagtttcggaaagagaaggaacaagagtcacacactctgtgtgagatgtggccgtcgcagtttccacatccagaagagccgttgctccgcctgtgcctaccccgccgctcgcaagaggacctacaactggagtgtgaaggcaatccgtagaaagactacaggaactgggaggatgaggtatcttcgcaatgtgcctcgcaggttcaagaccggtttcagagaaggtaccgaagccaagccaagggtcaagtcagctgcgtcttcgtaagcttaaaccggtgcattgattattcgcgggaagagttacaactttagtttttgggcttctgagtttgtttgggaagattactttttgttttattttattgagcatctgataactactttcgtttgatatcttttcactttcttttatataaaaatttggacttggatgaaatttagtttacctctgcaatccgcaagtctttgatcca

SEQ ID NO: 2309 - DNA, 553 bp, Vaccinium corymbosum
atactagggtttctcctgctgcgcaccaatggggaaggggacagggagttttggtaagaggaggaacaagacccacaccctttgtgtgagatgtggccgccgcagcttccatctccagaagagccgatgctctgcttgtgcttccctgctgccgcaagaggaaatataactggagtgtgaaggcggatccggaggaaagacaaaccgggactggtcgtatgaggtacctccgtaacgtgcctcgcagattcaagagtggtttcagagaagggactgaagcagctccaaggaagaaggcagcagcagctactgcttgagccattgaaggcttgtatcgggcgtgatttagggtactgaattgtggtttcattttcaagtgtaggaactgagttcactttgggaacctcatttggaggctgttgctccaatttgatatctgttttaagatttttggtcttttaatctgtagtttattcgagtttttgatacaaatcagactatggctttgaattcccagtatcctgagtctaatgagatattacgatttccatgg

SEQ ID NO: 2310 - DNA, 1508 bp, Sorghum bicolor
tgagtagcccggcccaaaccagtgtgccacgtaacgctgtgggaccaggtgatggaggacgatgggagtcagccagttgtccgaggtggcagcggcgccacctccagaatccagttccgctccccgattgggcggaggcaaatccagaaatctccacctcacatccgccgctaatcgccgctcgcttctcccccccggcaacaaaacacacttgtgctacaaatatgtccacgtaacccttctccaagccttaccactccacggtttcaatcaaaaaaaagaaaagaaaaagcttagcttagctttgctcgccagacaaaccggagcagaggcagagctgcagcagcagatggcgtcgacgatcatggccgccacctcccgcgtcgtcgcggccaagacgccgttcctcggccagggccgcgccgccgccaatgccagccccctccgggacgtcgccgccgccgccagcggccggatcaccatgggcaacgacctgtggtacggcccggaccgcgtcaagtacctgggccccttctccgcgcagacgccgtcgtacctcaccggcgagttccccggcgactacgggtgggacaccgccgggctgtcggcggacccggaggcgttcgcgcggaacagggcgctggaggtgatccacgggcggtgggcgatgctgggggcgctgggctgtatcacccctgaggtgctcgagaagtgggtgcgcgtggacttcaaggagcccgtctggttcaaggccggcgcgcagatcttctccgagggcggcctggactacctcgggaaccccaacctggtgcacgcgcagagcatcctcgccgtgctcggcttccaggtcatcctcatgggcctcgtcgagggcttccgcatcaacggcctcgacggcgtcggcgagggcaacaacctctaccccggcggccagtacttcgaccccttgggcctcgccgacgaccccgtcaccttcgccgagctcaaggtcaaggagatcaagaacggccgcctcgccatgttctccatgttcggattcttcgtccaggccatcgtcaccggcaaggggccactcgagaacctgctcgaccacctcgatgaccccgtcgccaacaacgcctgggtctacgccaccaagttcgcgccagggtcttaagctagccggacacggcggcggcgtgccgggacattgtacactactcgtttgtcttgtgacattacatttgtaccatgaacgaatgcaaatattcttgtgctctctcatcagaactcaggaacgtcgtactggccactagttttgatcttccattccatccaatccatgtatgctccgttttagttgttaactgatttgtgtccatatatgtagatgtctctactattattttttttgttacaaacacaagcagtccggaagtagtgcagaattcagaggctgctaattacaataggcgtatttccaaactgtgtacttaggtatatatccctgtgtcagatgcgcatttggg

SEQ ID NO: 2311 - DNA, 1744 bp, Sorghum bicolor
tgagtagcccggcccaaaccagtgtgccacgtaacgctgtgggaccaggtgatggaggacgatgggagtcagccagttgtccgaggtggcagcggcgccacctccagaatccagttccgctccccgattgggcggaggcaaatccagaaatctccacctcacatccgccgctaatcgccgctcgcttctcccccccggcaacaaaacacacttgtgctacaaatatgtccacgtaacccttctccaagccttaccactccacggtttcaatcaaaaaaaagaaaagaaaaagcttagcttagctttgctcgccagacaaaccggagcagaggcagagctgcagcagcagatggcgtcgacgatcatggccgccacctcccgcgtcgtcgcggccaagacgccgttcctcggccagggccgcgccgccgccaatgccagccccctccgggacgtcgccgccgccgccagcggccggatcaccatgggcaacgacctgtggtacggcccggaccgcgtcaagtacctgggccccttctccgcgcagacgccgtcgtacctcaccggcgagttccccggcgactacgggtgggacaccgccgggctgtcggcggacccggaggcgttcgcgcggaacagggcgctggaggtgatccacgggcggtgggcgatgctgggggcgctgggctgtatcacccctgaggtgctcgagaagtgggtgcgcgtggacttcaaggagcccgtctggttcaaggccggcgcgcagatcttctccgagggcggcctggactacctcgggaaccccaacctggtgcacgcgcagagcatcctcgccgtgctcggcttccaggtcatcctcatgggcctcgtcgagggcttccgcatcaacggcctcgacggcgtcggcgagggcaacaacctctaccccggcggccagtacttcgaccccttgggcctcgccgacgaccccgtcaccttcgccgagctcaaggtcaaggagatcaagaacggccgcctcgccatgttctccatgttcggattcttcgtccaggccatcgtcaccggcaaggggccactcgagaacctgctcgaccacctcgatgaccccgtcgccaacaacgcctgggtctacgccaccaagttcgcgccagggtcttaagctagccggacacggcggcggcgtgccgggacattgtacactactcgtttgtcttgtgacattacatttgtaccatgaacgaatgcaaatattcttgtgctctctcatcagaactcaggaacgtcgtactggccactagttttgatcttccattccatccaatccatgtatgctccgttttagttgttaactgatttgtgtccatatatgtagatgtctctactattattttttttgttacaaacacaagcagtccggaagtagtgcagaattcagaggctgctaattacaataggcgtatttccaaactgtgtacttaggtatatatccctgtgtcagatgcgcatttggggaataaggctctgaaaggggtcccagagaagccgaggaaaagactgcaacaaccttgtaatggaagaagatgacatctggtggtggtgggagactgataaaacaagcacttccttgagtagtttgtcaatttatacgatatatcagcttcaggagggtgttcaccaacagatggattctataatggcgaatttcttctggcaatgggccaaatgaaaattttaaatatcatgtggt

SEQ ID NO: 2312 - DNA, 1084 bp, Saccharum officinarum
aaaagaaaaagctagcttagctttgctcgccagacaaaccggagcagagctgcagcagatgatggcgtcgacgatcatggccgccacctcccgcgtcgtcgcggccaagacgccgttcctcggccagggccgcgccgccgccaatgccagccccctccgcgacgtcgccgccgccgccagcggccggatcaccatgggcaacgacctgtggtacggcccggaccgcgtcaagtacctgggccccttctccgcgcagacgccgtcctacctcaccggcgagttccccggcgactacggctgggacaccgccgggctgtcggcggacccggaggcgttcgcgcggaacagggcgctggaggtgatccacgggcggtgggcgatgctgggggcgctgggctgcatcaccccggaggtgctcgagaagtgggtgcgcgtggacttcaaggagcccgtgtggttcaaggccggcgcgcagatcttctccgagggcgggctggactacctcggcaaccccaacctggtgcacgcgcagagcatcctcgccgtgctggggttccaggtcatcctcatgggcctcgtcgagggcttccgcatcaacggcctcgacggcgtcggcgagggcaacaacctctaccccggcggccagtacttcgacccgttgggcctcgccgacgaccccgtcaccttcgccgagctcaaggtcaaggagatcaagaacggccgcctcgccatgttctccatgttcggcttcttcgtccaggccatcgtcaccggcaaggggcccctcgagaacctgctcgaccacctcgacgaccccgtcgccaacaacgcctgggtctacgccaccaagttcgcgccagggtcttaagctagccggacacggcggcgtgccggaacattgtagactactcgtttgtgttgtgacattacatttgtaccatgaacgaatgcaaatattcttgtgctctcagaactcaggagcgtactggacaggttttggtcttccattccatccatgtatgctccgttttagttgttaactgatttgtgtccatatatgcagttttgtgtagtagagttttac

SEQ ID NO: 2313 - DNA, 1072 bp, Panicum virgatum
ctccgcagcagagcacgcatcaagctacgacacgcgcgcagatggcgtcgacgatcatggccgccacctcccgcgtcctcgccgccaagaccccgttcctcggccagggccgcgccgccgccaatgccagcccgctccgcgacgtcgccgcagccgccagcggccggatcaccatgggcaacgacctgtggtacgggcccgaccgcgtcaagtacctgggccccttctccgcccagacgccctcctacctcaccggcgagttccccggcgactacggctgggacacggccgggctctccgccgacccggaggcgttcgcgcgcaacagggcgctggaggtgatccacgggcggtgggcgatgctgggcgcgctgggatgcatcaccccggaggtgctcgagaagtgggtgcgcgtggacttcaaggagcccgtctggttcaaggccggcgcgcagatcttctccgagggcgggctcgactacctgggcaaccccaacctggtgcacgcgcagagcattctcgccgtgctcggattccaggtcatcctcatgggcctcgtcgagggcttccgcatcaacggcctcgacggcgtcggcgagggcaacaacctctaccccggcggccagtacttcgaccccctgggcctcgccgacgaccccgtcaccttcgctgagctcaaggtcaaggagatcaagaacggccgcctcgccatgttctccatgttcggattcttcgtgcaggccatcgtcaccggcaaggggcccctcgagaacctgctcgaccacctcgacgaccccgtcgccaacaacgcctgggtctacgccaccaagttcgcgcccgggtcttaagctagacggcggcctcttcgtgccggaccaccattgtaggcattacgtttgtaccaccaccaatgaatgcaaatattgccatcgcaggattcaggattgtactggaggagttttggggtttgcattatgctctctgtcagttcagttggacatgtgtgctcctgaaacagatagtgtgcagtttgtgatgtatatatgcagctgcttctttgcatttcggttct

SEQ ID NO: 2314 - DNA, 1006 bp, Panicum virgatum
gccttaactccgcagcagagcacgcatcaagaagctagtacgacacgcgcgcgcagatggcgtcgacgatcatggccgccacctcccgcgtcctcgccgccaagaccccgttcctcggccagggccgcgccgccgccattgccagcccgctccgcgacgtcgtcgccgccgccgccgccagcggccggatcaccatgggcaacgacctgtggtacggccccgaccgcgtcaagtacctgggccccttctccgcccagacgccctcctacctcaccggcgagttccccggcgactacggctgggacacggccgggctctccgccgacccggaggcgttcgcgcgcaacagggcgctggaggtgatccacgggcggtgggcgatgctgggcgcgctggggtgcatcaccccggaggtgctcgagaagtgggtgcgcgtggacttcaaggagcccgtctggttcaaggccggcgcgcagatcttctccgagggcgggctcgactacctgggcaaccccaacctggtgcacgcgcagagcatcctcgccgtgctggggttccaggtcgtgctcatgggcctcgtcgagggcttccgcatcaacggcctcgacggcgtcggcgagggcaacaacctctaccccggcggccagtacttcgaccccctgggcctcgccgacgaccccgtcaccttcgccgagctcaaggtcaaggagatcaagaacggccgcctcgccatgttctccatgttcggattcttcgtgcaggccatcgtcaccggcaaggggcccctcgagaacctgctcgaccacctcgacgaccccgtcgccaacaacgcctgggtctacgccaccaagttcgcgcccgggtcttaagctagacggcggccggcctcttcgtgccggaccaccattgtactgtaggcattacgtttgttttgtaccaccaccaatgaatgcaaatattgccatctcaggattcaggattgtactggaggagttttggggtttgc

SEQ ID NO: 2315 - DNA, 1233 bp, Cynodon dactylon
cctagcactagaactatccaactgtccagagtcaagacacagccggagccgcagcagatggcatcgacgatcatggccgccaccaactcccgcgtcgtcgccgccaagacgccgttcctcggccagggccgcaccgccggcaatgccaccccactccgcgacgtcgccgccgcagccggtggccggatcaccatgagcaacgacctgtggtacggcccggaccgcgtcaagtacctgggccccttctccgcgcagacgccgtcctacctcaccggcgagttcccgggcgactacgggtgggacaccgccgggctctccgccgacccggaggcgttcgcgcggaaccgagctctggaggtgatccacgggcggtgggcgatgctgggcgcgctgggctgcatcacgccggaggtgctggagaagtgggtgcgcgtggacttcaaggagcccgtctggttcaaggccggcgcgcagatcttctccgagggcgggctcgactacctcggcaaccccaacctggtgcacgcgcagagcatcctcgccgtgctgggattccaggtcgtgctcatgggcctcgtcgagggcttccgcatcaacggcctcgacggcgtcggcgacggcaacaacctctaccccggcggccagtacttcgacccgctgggtttggcggatgaccctgtcaccttcgctgagctgaaggtcaaggagatcaagaacggcaggctcgccatgttctccatgttcgggttcttcgtgcaggccatcgtcaccggcaagggcccgctcgagaacctgctcgaccacctcgacgaccctgtcgccaacaacgcgtgggtctacgccaccaaattcgcgccggggtcttaattaagctatcgggcccgtttcgcgattgtagactactcgtttgtgacattacatttgtactatgaatatgaatgcaaatattgtaatctcaggatccaggaacgtactggaggagttttggtccggaaaatcttgtttacgcacggccacgcatctggtggccccggattttgccggccatggaatagagactctaagacgctggaggttgaagacgatgaaaacatggcttatgtccgctgtcaataggaggtggatattaaggttagcaagatcaccccttgatgttcggttaggtgatgaacacgttataatctctaaaatgattaaaaagattagtgaattaaagaaataagatacgaggga

SEQ ID NO: 2316 - DNA, 1168 bp, Setaria italica
cttccccctccatctcgcgtctccccggcaacaaaaacactttgtgctacaaatacgtccacgcaacccctctcctagccttgacacccccgcagtgcagtgccgccgcagcagagcagcaagctacgagggatggcatcgatcatggccgccgccacctcccgcgtcctcgccgccaagacgctgttcctcggccagggccgcgccgccgccaatgccagccccctccgcgacgtcgccgcagccgccagcggccggatcaccatgagcaacgacctgtggtacggcccggaccgcgtcaagtacctgggccccttctccgcgcagactccctcctacctcaccggcgagttccccggcgactacggctgggacacggcggggctctccgccgacccggaggcgttcgcccgcaacagggcgctggaggtgatccacgggcggtgggcgatgctgggcgcgctgggctgcatcacgcccgaggtgctcgagaagtgggtgcgcgtggacttcaaggagcccgtgtggttcaaggccggcgcgcagatcttctccgagggcgggctggactacctgggcaaccccaacctggtgcacgcgcagagcatcctcgccgtgctgggcttccaggtcatcctcatgggcctcgtcgagggcttccgcatcaacggcctcgacggcgtcggcgagggcaacaacctctacccgggcggccagtacttcgacccgctcggcctcgccgacgaccccgtcaccttcgccgagctcaaggtcaaggagatcaagaacggacgcctcgccatgttctccatgttcggattcttcgtgcaggccatcgtcaccggcaaggggcccctcgagaacctgctcgaccacctcgacgaccccgtcgcaaacaacgcctgggtctacgccaccaagttcgcgcccgggtcttaagaagctagacggctgcttcgtgcctgccaccattgtagactactcgttacttttgtaccaccaattaatgcaaataccttgttctcaggattcaggaatgtgcattatgctctctgtcagttgtggcttgtgtgctcctgaaacagatgatgtgctgaactgctgatttacgatctatacatgtagctgcctctttgcatttcagttcatgttttgaggttttgacata

SEQ ID NO: 2317 - DNA, 928 bp, Pennisetum glaucum
gccttgacaccccggcagcagagcagcaaaaagctactacgagtgatggcatcgatcatggccgccgccacctcccgcgtcatcgccgccaagacgccgttcctcggccagggccgcgccgccgccaatgtcagccccttccgcgacgtcgccgccgccgccagcggccggatcaccatgagcaacgacctgtggtacggcccggaccgcgtcaagtacctgggccccttctccgcgcagactccctcctacctcaccggcgagttccccggcgactacggctgggacacggcggggctctccgccgacccggaggcgttcgcccgcaacagggcgctggaggtgatccacgggcggtgggcgatgctcggcgcgctgggctgcatcacgcccgaggtgctcgagaagtgggtgcgcgtggacttcaaggagcccgtgtggttcaaggccggcgcgcagatcttctccgagggcggcctcgactacctgggcaaccccaacctggtgcacgcgcagagcatcctcgccgtgctgggcttccaggtcatcctcatgggcctcgtcgagggattccgcatcaacggcctcgacggcgtcggcgagggcaacaacctctacccgggcggccagtacttcgacccgctcggcctcgccgacgaccccgtcaccttcgccgagctcaaggtcaaggagatcaagaacggccgcctcgccatgttctccatgttcgggttcttcgtgcaggccatcgtcaccgggaaggggcccctagagaacctgctcgaccacctcgacgaccccgtcgccaacaacgcctgggtctacgccaccaagttcgcgcccgggtcttaaggagctggaccgacggctagctgcttcaattcgggcctgccaccattgtagactacccgttcccatttgtaccacc

SEQ ID NO: 2318 - DNA, 1092 bp, Zea mays
gctagcttttgctttgctcaccagataaaccgcagcagatggcgtcgacgatcatggccgccacctcccgcatcgtcgcggccaagacgccgtttcttggccagggtcgcgccgccgccaatgccagccccctccgcgacgtcgccgccgccgctgctggcggccggatcaccatggtacgtggagcatccatcgtgagagtgctcgcttcgcttccattgcagggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaggtgctggagaagtgggtgcgcgtggacttcaaggagcccgtgtggttcaaggccggcgcgcagatcttctcggagggcgggctggactacctgggcaaccccaacctggtgcacgcgcagagcatcctggccgtgctcggcttccaggtcatcctcatgggcctcgtcgagggcttccgcatcaacggcctcgacggcgtcggcgagggcaacaacctctaccccggcggccagtacttcgacccgctgggcctcgccgacgaccccgtcaccttcgccgagctcaaggtcaaggagatcaagaacggccgcctcgccatgttctccatgttcggcttcttcgtccaggccatcgtcaccggcaaggggcccctcgagaacctgctcgaccacctcgacgaccccgtcgccaacaacgcctgggtctacgccaccaagttcgcaccagggtcttaagctagctaccgggccgcggcgtgccaggacattgtgttgtacactactcgtttctgtcgtgatctgtaccatgaacgaatgcaaatattcttgtgctctcccagaaggaacgaactggactagttttgctcttccattccatgtatactctgcttcagcatatatgtagttgtgtctactggtttttgcagttgtt

SEQ ID NO: 2319 - DNA, 989 bp, Secale cereale
ccaccgtacggactccggagcagcacacatggcatccacgatcatggccgccgcctcccgcgccgttgtggccaagacgccgttcctcagcggccagggccgcgccgccagcgccagccccctgcgcgacatcgccgccgcggccaacggcagaatcaccatgggcaacgacttgtggtacggcccggaccgcgtcaagtacctgggccccttctccgcgcagacgccgtcgtacctgaacggcgagttccccggcgactacggctgggacaccgccgggctttctgccgacccggaggcgttcgcgaggaacagggcgctggaggtgatccacgggcggtgggcgatgctcggcgctcttgggtgcgtcttccccgaggtgctccagaagtgggtgggcgtcgagttcaaggagcccgtctggttcaaggccggctcgcagatcttctctgagggtggcctcgattaccttgggaaccccaacctcgtccacgcgcagagcatccttgccgtgctcggcttccaggtccttctcatgggtctcgttgaagggttccgcatcaacggtctcgatggtgtcggcgaaggcaacgacctctaccccggcggccagtacttcgacccgctcggccttgccgacgacccggtcaccttcgcggagcttaaggtgaaggagatcaagaatggccgtctcgccatgttctctatgtttgggttcttcgtccaagctatcgtcaccggcaagggcccattggagaacctgttcgaccacctcgacgaccctgtcgccaacaatgcatgggttttcgctaccaagtttgcgcctggatcttaggctggccgacgcgccacggtggcctgccattgtaaagtgtaaactactcccatgtgtgtgcaaatagcaacgaatggtcgatgtgatctcgaaattcgaaatttggagcattttttggttcattttctgacgtgtgttgcttacgtgtgttgct

SEQ ID NO: 2320 - DNA, 952 bp, Triticum aestivum
tcactgagaggcacccagcagcagcagccggctaggccaccgtacgtacggactccgatccggagcagcaggcatggcatccaccatcatggccgccgcctcccgcgccgtcgtcgccaagacgccgttcctcagcggccagggccgcgccgcaggcgccagccccctgcgcgacatcgccgccgcggccaacggcagaatcaccatgggcaacgacttgtggtacggcccggaccgcgtcaagtacctggggcccttctccgcgcagacgccgtcctacctgaacggcgagttcccgggcgactacggctgggacaccgccgggctttccgccgacccggaggcgttcgctaggaacagggcgctggaggtgatccacgggcggtgggcgatgctcggcgctcttgggtgcgtcttccccgaggtgctccagaagtgggtgggcgtcgagttcaaggagcccgtctggttcaaggccggctcgcagatcttctccgagggtggcctcgattaccttgggaaccccaacctcgtccacgcgcagagcatccttgccgtgctgggcttccaggtccttctcatgggtctggttgaagggttccgcatcaatggtctcgacggtgtcggcgagggcaacgacctctaccccggcggccagtacttcgacccgctcggccttgccgacgaccctgtcaccttcgctgagcttaaggtgaaggagatcaagaatggccgtctcgccatgttctctatgtttgggttcttcgtccaagctatcgtcaccggtaagggcccattggagaacctgttcgaccacctcgacgaccctgtcgccaacaatgcatgggttttcgctaccaagtttgcgcctggatcttaggctggccgacgcgccatggtggcatgccattgtaaagtgtaaactactcccatgtgtgtgcaaatagcaacg

SEQ ID NO: 2321 - DNA, 1025 bp, Triticum aestivum
ctccctcgtgtgccttgagagacgccgaccacaccacgactggcacccagcagcaacagccggctaggccaccgtactacggactccggagcagcagacatggcatccacgatcatggccgccgcctcccgcgccgttgtcgccaagacgccgttcctcagcggccagggccgcgccgccagcgccagccccctgcgcgacatcgccgccgcggccaacggcagaatcaccatgggcaacgacttgtggtacggcccggaccgcgtcaagtacctgggccccttctccgcgcagacgccgtcctacctgaacggcgagttccccggcgactacggctgggacaccgccgggctttctgccgacccggaggcgttcgctaggaacagggcgctggaggtgatccacgggcggtgggcgatgctcggcgctcttggctgcgtcttccccgaggtgctccagaagtgggtgggcgtcgagttcaaggagcccgtctggttcaaggccggctcgcagatcttctccgagggcggcctcgattaccttggaaaccccaacctcgtccacgcgcagagcatccttgccgtgctgggcttccaggtccttctcatgggtctggttgaagggttccgcatcaatggtctcgacggtgtcggcgagggcaacgacctctaccccggcggccagtacttcgacccgctcggccttgccgacgaccctgtcaccttcgctgagctcaaggtgaaggagatcaagaatggccgtctcgccatgttctctatgtttgggttcttcgtccaagctatcgtcaccggtaagggcccattggagaacctgttcgaccacctcgacgaccctgtcgccaacaatgcatgggttttcgccaccaagtttgcgcctggatcttaggctcgctggccgacgcgccacggtggtctgccattgtaaagtgtaaactactcccatgtgtgtgcaaatagcaacgaatggtcgatgtgatctcgaaatttggaggattttttggttca

SEQ ID NO: 2322 - DNA, 1098 bp, Leymus cinereus x Leymus triticoides
  misc_feature (1067)..(1070): n is a, c, g, or t
cactcactaagaagcacccagcagcaacagccggccaggccaccgtacggactccggagcagcagacatggcatccacgatcatggccgccgcctcccgtgccgttgtcgccaagacgccgttcctcagcggccagggccgcgccgccagcgccagccccctgcgggacatcgccgccgcggccaacggcagaatcaccatgggcaacgacttgtggtacggcccggaccgcgtcaagtacctgggccccttctccgcgcagacgccgtcgtacctaaacggcgagttcccaggcgactacggctgggacaccgccgggctttctgccgacccggaggcgttcgctaggaacagggcgctggaggtgatccacgggcggtgggcgatgctcggcgctcttgggtgcgtcttccccgaggtgctccagaagtgggtgggcgtcgagttcaaggagcctgtctggttcaaggccggctcgcagatcttctctgagggtggtctcgattaccttggaaaccccaacctcgtccacgcgcagagcatccttgccgtgctcggcttccaggtccttctcatgggtcttgttgaagggttccgcatcaacggtctcgatggtgtcggcgagggcaacgacctctaccccggcggccagtacttcgacccgctcggccttgccgacgaccctgtcaccttcgctgagcttaaggtgaaggagatcaagaatggccgtcttgccatgttctctatgtttgggttcttcgtgcaggctatcgtcaccggcaagggcccattggagaacctgttcgaccacctggacgaccctgtcgccaacaatgcatgggttttcgccaccaagtttgcgcctggatcttaggctggccgacgcgccacggcggcctgccattgtgaagtgtaaactactctcatgtgtgtgcaaatagcaacgaatggtcgatgtgatctcgaaactcgaaaatttggaggattttttggttcactttctgatgtgtgtcgcttatatgttgcgatgtgcttggctcattcttggtggttacattttatcaagnnnngatggtggagtaactgattagaataact

SEQ ID NO: 2323 - DNA, 1115 bp, Avena sativa
cagcagcacagcttggccgccgaccggaccccggagcagcagatatggcatccactatcatggccgccgcctcccgcgccgtcgccgccaagacgccgttcctcagcggccagagccgcgccgccagcgccagcccccttcgcgatgtcgccgccgcggccaacggcaggatcaccatgggcaacgacttgtggtacggtccagaccgcgtgaagtacctgggccccttctccgcgcagacgccgtcgtacctcaacggcgagttccccggcgactacggctgggacaccgccgggctatctgccgacccggaggccttcgccaggaacagggcgctggaggtgatccacgggcggtgggccatgctcggcgctcttgggtgcgtcttccccgaggtgctccagaagtgggtgggcgtcgagttcaaggagcccgtttggttcaaagccggctcgcagatcttctccgacggcggtctcgactacctcggaaaccccaacctcgtccacgcacagagcatcctcgccgtgctcggcttccaggtccttctcatgggccttgttgaggggttccgcatcaacggccttgatggcgtcggcgagggcaacgacctctaccccggcggccagtacttcgatcccctcggcctcgctgacgacccagtcaccttcgccgagcttaaggtgaaagagatcaagaatggccgtctcgccatgttctccatgtttgggttcttcgtccaggctatcgtcaccggcaagggtccgttggagaacctgttcgaccacctcgacgacccagttgccaacaatgcctgggttttcgccactaagtttgcgcctgggtcttaggccggccggcacggcatggcgtaccgccattgtaaagtgtaaactactgttttgtgtgcagtgacacgcacgcaacttggaaggaatggtcgacgcgatctcaaaattcagaaatttgaaggattttttggttcgctttctgtttctgatatctgccacttatatgttgtgcttggctaattctgtgtgtttatgtgtacaattgtatcacgtggagacgtggagtaaccgatgagaacaaactagcttccttttcgaaagagg

SEQ ID NO: 2324 - DNA, 1238 bp, Avena sativa
ccgcaacagcagcacagcttggccgccgaccggaccccggagcagcagatatggcatccactatcatggccgccgcctcccgcgccgtcgccgccaagacgccgttcctcagcggccagagccgcgccgccagcgccagccccctccgcgatgtcgccgccgcggccaacggcaggatcaccatgggcaacgacttgtggtacggtccagaccgcgtcaagtacctgggccccttctccgcgcagacgccgtcgtacctcaacggcgagttccccggcgactacggctgggacaccgccgggctatctgccgacccggaggccttcgccaggaacagggcgctggaggtgatccacgggcggtgggccatgctcggcgctcttgggtgcgtcttccccgaggtgctccagaagtgggtgggcgtcgagttcaaggagcccgtctggttcaaggccggctcgcagatcttctccgacggcggtctcgactacctcggaaaccccaacctcgtccacgcacagagcatcctcgccgtgctcggcttccaggtccttctcatgggccttgttgaggggttccgcatcaacggccttgatggcgtcggcgagggcaacgacctgtaccccggcggccagtacttcgaccccctcggcctcgccgacgacccagtcaccttcgccgagcttaaggtgaaggagatcaagaatggccgtctcgccatgttctccatgtttgggttcttcgtccaggctatcgtcaccggcaagggtccgttggagaacctgttcgaccacctcgacgacccagttgccaacaatgcctgggttttcgccactaagtttgcgcctgggtcttaggccggccgacacggcatggcgtaccgccattgtaaagtgtaaactactgttttgtgtgcagtgacacgcacgcaacttggaaggaatggtcgacgcgatctcaaaattcagaaatttgaaggattttttggttcgctttctgtttctgatatctgccacttatatgttgtgcttggctaattctgtgtgtttatgtgtacaattgtatcacgtcgagacgtggagtaaccgatgagaacaactagcttccttttcgaagagaaaaactagatgagaaggactgtacgtgaagttcaacaaaatgcatgctacctgagcatttgaactggcgagcgtagcaggggcaaaatccattttcacctcacatgacatgaggttcat

SEQ ID NO: 2325 - DNA, 947 bp, Secale cereale
  misc_feature (472)..(472): n is a, c, g, or t
  misc_feature (511)..(511): n is a, c, g, or t
  misc_feature (526)..(526): n is a, c, g, or t
cagcagcaacagccggctaggccaccgtacggactccggagcagcacacatggcatccacgatcatggccgccgcctcccgcgccgttgtcgccaagacgccgttcctcagcggccagggccgcgccgccagcgccagccccctgcgcgacatcgccgccgcggccaacggcagaatcaccatgggcaacgacttgtggtacggcccggaccgcgtcaagtacctgggccccttctccgcgcagacgccgtcgtacctgaacggcgagttccccggcgactacggctgggacaccgccgggctttctgccgacccggaggcgttcgcgaggaacagggcgctggaggtgatccacgggcggtgggcgatgctcggcgctcttgggtgcgtcttccccgaggtgctccagaagtgggtgggcgtcgagttcaaggagcccgtctggttcaaggccggctcgcagatcttctcngagggtggcctcgattaccttgggaaccccaacctcgtncacgcgcagagcatncttgccgtgctcggcttccaggtccttctcatgggtctcgttgaagggttccgcatcaacggtctcgatggtgtcggcgagggcaacgacctctaccccggcggccagtacttcgacccgctcggccttgccgacgaccctgtcaccttcgcggagcttaaggtgaaggagatcaagaatggccgtctcgccatgttctctatgtttgggttcttcgtccaagctatcgtcaccggcaagggcccattggagaacctgttcgaccacctcgacgaccctgtcgccaacaatgcatgggttttcgctaccaagtttgcgcctggatcttaggctggccgacgcgccacggtggcctgccattgtaaagtgtaaactactcccatgtgtgtgcaaatagcaacgaatggtcgatgtgatctcg

SEQ ID NO: 2326 - DNA, 1128 bp, Triticum aestivum
ccaccactcactgagaggcacccagcagcagcagccggctaggccaccgtacgtacggactccgatccggagcagcaggcatggcatccaccatcatggccgccgcctcccgcgccgtcgtcgccaagacgccgttcctcagcggccagggccgcgccgcaggcgccagccccctgcgcgacatcgccgccgcggccaacggcagaatcaccatgggcaacgacttgtggtacggcccggaccgcgtcaagtacctggggcccttctccgcgcagacgccgtcctacctgaacggcgagttcccgggcgactacggctgggacaccgccgggctttccgccgacccggaggcgttcgctaggaacagggcgctggaggtgatccacgggcggtgggcgatgctcggcgctcttgggtgcgtcttccccgaggtgctccagaagtgggtgggcgtcgagttcaaggagcccgtctggttcaaggccggctcgcagatcttctccgagggtggcctcgactaccttgggaaccccaacctcgtccacgcgcagagcatccttgccgtgctgggcttccaggtccttctcatgggcctggtcgaagggttccgcatcaatggtctcgacggtgtcggcgagggcaacgacctctaccccggcggccagtacttcgacccgctcggccttgccgacgaccctgtcaccttcgctgagctcaaggtgaaggagatcaagaatggccgtctcgccatgttctccatgtttgggttcttcgtccaagctatcgtcaccggcaagggcccattggagaacctgttcgaccacctcgacgaccctgtcgccaacaatgcatgggttttcgccaccaagtttgcgcctggatcttaggctggccgacgttgccattgtaaagtgtaaactactcccatgtgtgtgtgtgtgcaaatagcaacgaatggtcgatgtgatctcgaaatttggaggattttttggttcactttctgatgtgtgtccttatatatttatcttgcgatgtgcttagctctttcttggtggttacattttgtcaagtgaagatggtggagtaactgattagaataactacgatgtgaagctcgtagcaaaagta

SEQ ID NO: 2327 - DNA, 1181 bp, Triticum aestivum
tcggcacgaggagcagccggctaggccaccgtacccgtactacggactccggagcagcaggcatggcatccaccatcatggccgccgcctcccgcgccgtcgtcgccaagacgccgttcctcagcggccagggccgcgccgccagcgccagccccctgcgcgacatcgccgccgcggccaacggcagaatcaccatgggcaacgacttgtggtacggcccggaccgcgtcaagtacctgggccccttctctgcgcagacgccgtcctacctgaacggcgagttcccgggcgactacggctgggacaccgccgggctttccgccgacccggaggcgttcgctaggaacagggcgctggaggtgatccacgggcggtgggcgatgctcggcgctcttggctgcgtcttccccgaggtgctccagaagtgggtgggcgtcgagttcaaggagcccgtctggttcaaggccggctcgcagatcttctccgagggtggcctcgactaccttgggaaccccaacctcgtccacgcgcagagcatccttgccgtgctgggcttccaggtccttctcatgggcctggtcgaagggttccgcatcaatggtctcgacggtgtcggcgagggcaacgacctctaccccggcggccagtacttcgacccgctcggccttgccgacgaccctgtcaccttcgctgagctcaaggtgaaggagatcaagaatggccgtctcgccatgttctccatgtttgggttcttcgtccaagctatcgtcaccggcaagggcccattggagaacctgttcgaccacctcgacgaccctgtcgccaacaatgcatgggttttcgccaccaagtttgcgcctggatcttaggctggccgacgttgccattgtaaagtgtaaactactcccatgtgtgtgtgtgtgtgcaaatagcaacgaatggtcgatgtgatctcgaaatttggaggattttttggttcactttctgatgtgtgtccttatatatttatcttgcgatgtgcttagctctttcttggtggttacattttgtcaagtagtaactgattagaataactacgatgtgaagctcgtaccaaaagtaacgacatcaggggttctacccaaccgtgtacgaaggattacatgtcacacacactagtggctggggcgcgccctgggcgc

SEQ ID NO: 2328 - DNA, 1107 bp, Hordeum vulgare
ccctctcgaattcccaccactcactgagaagcacccagcagcaacagccggctaggccaccgtacggaccccggagcagcagacatggcatccacgatcatggccgccgcctcccgcgccgttgtcgccaagacgccgttcctcagcggccagggccgcgccgccagcgccagccccctgcgcgacatcgccgccgcgaccaacggcagaatcaccatgggcaacgacttgtggtacggcccggaccgcgtcaagtacctgggccccttctccgcgcagacgccgtcgtaccttaacggcgagttccccggcgactacggctgggacaccgccgggctttctgccgacccggaggcgttcgctaggaacagggcgctagaggtgatccacggccggtgggcgatgctcggcgctcttgggtgcgtcttccccgaggtgctccagaagtgggtgggcgtcgagttcaaggagcccgtctggttcaaggccggctcgcagatcttctctgagggtggtctcgattaccttgggaaccccaaccttgtccacgcgcagagcatccttgccgtgcttggcttccaggtccttctcatgggtcttgttgaagggttccgcatcaacggtctcgatggtgtcggcgagggcaacgacctctaccccggcggccagtacttcgacccgctcggccttgccgacgaccctgttaccttcgcggagcttaaggtgaaggagatcaagaatggccgtcttgccatgttctctatgttcgggttcttcgtgcaagctatcgtcaccggcaagggcccattggagaacctgttcgaccacctcgacgaccctgtcgccaataatgcatgggttttcgccaccaaatttgcgcctggatcttaggctgcccgacgcgccacggtggcctgccattgtaaaatgtaaattattcccatgtgtgtgcaatagcaacgaatggtcgatgtgatccctgaaattcgaaaatttggaggattttttggttcaatttctgatgtgtgttgcttatatgttgcaatgtgcttagctcattcttgatggttactgtcaaagtaaaacaagattgaatgaaagtgaatg

SEQ ID NO: 2329 - DNA, 985 bp, Triticum aestivum
ctaggccaccgtacggaccccggagcagcacacatggcatccacgatcatggccgccgcctcccgcgccgttgtggccaagaccccgttcctcagcggccagggccgcgccgccagcgccacccccctccgcgacatcgccgccgcggccaacggcagaatcaccatgggcaacgacttgtggtacggcccggaccgcgtcaagtacctgggccccttctccgcgcagacgccgtcgtacctgaacggcgagttccccggcgactacggctgggacaccgccgggctttctgccgacccggaggcgttcgcgaggaacagggcgctggaggtgatccacgggcggtgggcgatgcttggcgctcttgggtgcgtcttccccgaggtgctccagaagtgggtgggcgtcgagttcaaggagcccgtctggttcaaggccggctcgcagatcttctccgagggtggcctcgattaccttgggaaccccaacctcgtccacgcgcagagcatccttgccgtgctcggcttccaggtccttctcatgggtctcgttgaagggttccgcatcaacggtctcgatggcgtcggcgagggcaacgacctctaccccggcggccagtacttcgacccgctcggccttgccgacgaccctgtcaccttcgctgagcttaaggtgaaggagatcaagaatggccgtctcgccatgttctctatgtttgggttcttcgtccaagctatcgtcaccggtaagggcccattggagaacctgttcgaccacctcgacgaccctgtcgccaacaatgcatgggttttcgctaccaagtttgcgcctggatcttaggctggccgacgcgccatggtggcatgccattgtaaagtgtaaactactcccatgtgtgtgcaaatagcaacgaatggtcgatgtgatctcgaaatttggaggattttttggttcactttctgatgtgtgtcgcttatatgttgcg

SEQ ID NO: 2330 - DNA, 941 bp, Hordeum vulgare
cggctaggccaccgtacggaccccggagcagcagacatggcatccacgatcatggccgccgcctcccgcgccgttgtcgccaagacgccgttcctcagcggccagggccgcgccgccagcgccagccccctgcgcgacatcgccgccgcgaccaacggcagaatcaccatgggcaacgacttgtggtacggcccggaccgcgtcaagtacctgggccccttctccgcgcagacgccgtcgtaccttaacggcgagttccccggcgactacggctgggacaccgccgggctttctgccgacccggaggcgttcgctaggaacagggcgctagaggtgatccacggccggtgggcgatgctcggcgctcttgggtgcgtcttccccgaggtgctccagaagtgggtgggcgtcgagttcaaggagcccgtctggttcaaggccggctcgcagatcttctctgagggtggtctcgattaccttgggaaccccaaccttgtccacgcgcagagcatccttgccgtgcttggcttccaggtccttctcatgggtcttgttgaagggttccgcatcaacggtctcgatggtgtcggcgagggcaacgacctctaccccggcggccagtacttcgacccgctcggccttgccgacgaccctgttaccttcgcggagcttaaggtgaaggagatcaagaatggccgtcttgccatgttctctatgttcgggttcttcgtgcaagctatcgtcaccggcaagggcccattggagaacctgttcgaccacctcgacgaccctgtcgccaataatgcatgggttttcgccaccaaatttgcgcctggatcttaggctgcccgacgcgccacggtggcctgccattgtaaaatgtaaattattcccatgtgtgtgcaatagcaacgaatggtcgatgtgatccctgaaattcg

SEQ ID NO: 2331 - DNA, 1023 bp, Hordeum vulgare
agcaacagccggctaggccaccgtacggaccccggagcagcagacatggcatccacgatcatggccgccgcctcccgcgccgttgtcgccaagacgccgttcctcagcggccagggccgcgccgccagcgccagccccctgcgcgacatcgccgccgcgaccaacggcagaatcaccatgggcaacgacttgtggtacggcccggaccgcgtcaagtacctgggccccttctccgcgcagacgccgtcgtaccttaacggcgagttccccggcgactacggctgggacaccgccgggctttctgccgacccggaggcgttcgctaggaacagggcgctagaggtgatccacggccggtgggcgatgctcggcgctcttgggtgcgtcttccccgaggtgctccagaagtgggtgggcgtcgagttcaaggagcccgtctggttcaaggccggctcgcagatcttctctgagggtggtctcgattaccttgggaaccccaaccttgtccacgcgcagagcatccttgccgtgcttggcttccaggtccttctcatgggtcttgttgaagggttccgcatcaacggtctcgatggtgtcggcgagggcaacgacctctaccccggcggccagtacttcgacccgctcggccttgccgacgaccctgttaccttcgcggagcttaaggtgaaggagatcaagaatggccgtcttgccatgttctctatgttcgggttcttcgtgcaagctatcgtcaccggcaagggcccattggagaacctgttcgaccacctcgacgaccctgtcgccaataatgcatgggttttcgccaccaaatttgcgcctggatcttaggctgcccgacgcgccacgtggcctgccattgtaaaatgtaaattattcccatgtgtgtgcaatagcaacgaatggtcgatgtgatccctgaaattcgaaaatttggaggattttttggttcaatttctgatgtgtgttgcttatatgttgcaatgtgcttagctcattcct

SEQ ID NO: 2332 - DNA, 1082 bp, Leymus cinereus x Leymus triticoides
  misc_feature (967)..(967): n is a, c, g, or t
  misc_feature (1050)..(1052): n is a, c, g, or t
gcacccagcagcaacagccggctaggccaccgtacggactccggagccgcagacatggcatccacgatcatggccgccgcctcccgcgccgttgtcaccaagacgccgttcctcagcggccagggccgcgccgccagcgccagccccctgcgcgacatcgccgccgcggccaacggcagaatcaccatggggaacgacttgtggtacggcccagaccgcgtcaagtacctgggccccttctccgcgcagacgccgtcgtatcttaacggcgagttccccggcgactacggctgggacaccgctgggctttctgccgacccggaggcgttcgctaggaacagggcgctggaggtgatccacgggcggtgggcgatgctcggcgctcttgggtgcgtcttccccgaggtgctccagaagtgggtgggcgtcgagttcaaggagcctgtctggttcaaggccggctcgcagatcttctctgagggtggtctcgattaccttgggaaccccaacctcgtccacgcgcagagcatccttgccgtgctcggcttccaggtccttctcatgggtcttgttgaagggttccgcatcaacggtcttgatggcgtcggcgagggcaacgacctctaccccggcggccagtacttcgacccgctcggccttgccgacgaccctgtcaccttcgcggagcttaaggtgaaggagatcaagaatggccgtcttgccatgttctctatgtttgggttcttcgtgcaggctatcgtcaccggcaagggtccattggagaacctgttcgaccacctcgacgaccctgtcgccaacaatgcatgggttttcgccaccaagtttgcgcctggatcttaggctggccgacgcgccacggcggcctgccattgtaaagtgtaaactactctcatgtgtgtgcaaatagcaacgaatggtcgatgtgatcagtgatctcgaaattcgnaaatttggaggattttttggttcactttctgatgtgtgtcgcttatatgttgcggtgtgcttagctcattcttggtggttacnnnttaccaagtgaagatggtggagaactatga

SEQ ID NO: 2333 - DNA, 1099 bp, Triticum aestivum
ccagcagcaacagccggctaggccaccgtacggaccccggagcagcacacatggcatccacgatcatggccgccgcctcccgcgccgttgtggccaagaccccgttcctcagcggccagggccgcgccgccagcgccacccccctccgcgacatcgccgccgcggccaacggcagaatcaccatgggcaacgacttgtggtacggcccggaccgcgtcaagtacctgggccccttctccgcgcagacgccgtcgtacctgaacggcgagttccccggcgactacggctgggacaccgccgggctttctgccgacccggaggcgttcgcgaggaacagggcgctggaggtgatccacgggcggtgggcgatgcttggcgctcttgggtgcgtcttccccgaggtgctccagaagtgggtgggcgtcgagttcaaggagcccgtctggttcaaggccggctcgcagatcttctccgagggtggcctcgattaccttgggaaccccaacctcgtccacgcgcagagcatccttgccgtgctcggcttccaggtccttctcatgggtctcgttgaagggttccgcatcaacggtctcgatggcgtcggcgagggcaacgacctctaccccggcggccagtacttcgacccgctcggccttgccgacgaccctgtcaccttcgctgagcttaaggtgaaggagatcaagaatggccgtctcgccatgttctctatgtttgggttcttcgtccaagctatcgtcaccggtaagggcccattggagaacctgttcgaccacctcgacgaccctgtcgccaacaatgcatgggttttcgctaccaagtttgcgcctggatcttaggctggccgacgcgccacggtggcatgccattgtaaagtgtaaactactcccatgtgtgtgcaaatagcaacgaatggtcgatgtgatctcgaaatttggaggattttttggttcactttctgatgtgtgttgcttatatgttgcgatgtgcttagctcgtttttggtggttacattttgtcaagggaagatggtggcgtaactgattagactaactatgatgtgaagcttgtaccaaaagta

SEQ ID NO: 2334 - DNA, 1118 bp, Avena sativa
aacagcagcacagcttggccgccgaccggacccccggagcagcagatatggcatccactatcatggccgccgcctcccgcgccgtcgccgccaagcgccgttcctcagcggccagagccgcgccgccagcgccagcccccttcgcgatgtcgccgccgcggccaacggcaggatcaccatgggcaacgacttgtggtacggtccagaccgcgtgaagtaccttgggccccttctccgcgcagacgccgtcgtacctcaacggccgagttccccggcgactacggctgggacaccgccgggctatctgccgacccggaggcctttgccaggaacagggcgctggaggtgatccacgggcggtgggccatgctcggcgctcttgggtgcgtcttccccgaggtgctccagaagtgggtgggcgtcgagttcaaggagcccgtctggttcaaggccggctcgcagatcttctccgacggcggtctcgactacctcggaaacccaacctcgtgcacgcacagagcatcctcgccgtgctcggcttccaggtccttctcatgggccttgttgaggggttccgcatcaacggccttgatggcgtcggtgagggcaacgacctctaccccggcggccagtacttcgaccccctcggcctcgccgacgacccagtcacattcgcggagcttaaggtgaaggagatcaagaatggccgtctcgccatgttctctatgtttgggttcttcgtccaggctatcgtcaccggcaagggtccgttggagaacctgttcgaccaccttgacgacccagtggccaacaatgcctgggttttcgccacgaagtttgcgcctgggtcttaggccggccgacacggcatggcgtaccgccgttgtaaagtgtaaactactgttttgtgtgtagtgacacgcacgcaaattggaaggaatggtcgaggcgatctcaaaattcagaaatttgaaggattttttggttcgctttctgatatctgccacttatatgttgtgcttagctaattctgtatgtttatgtgtacaattgtataagtggagacgtggagtaccttatcagaacaactcacttccctttcaaaagagataaactag

SEQ ID NO: 2335 - DNA, 1071 bp, Lolium multiflorum
agctaccactcactgagaagcacccagcagcagcagcaaagcttggccgccgtccagaccccggagcagcagatatgacatcgacgatcatggccgccgcctcccgcaccgtcgccgccaagacgccgttcctcagcggccagagccgcgccgccagcgccagcccactccgcgttgtcgccgccgcggccaacggcaggatcaccatgggcaacgacttgtggtacggcccggaccgcgtcaagtacctgggccccttctccgcgcagacgccgtcgtacctcaacggcgagttccccggcgactacggctgggacaccgccgggctatccgccgacccggaggccttcgccaggaacagggcgctcgaggtcatccacggccggtgggccatgctcggcgcgctcggctgcgtcttccccgaggtgctgcagaagtgggtgggcgtcgagttcaaggagcccgtctggttcaaggccggctcgcagatcttctccgacggcggcctcgactacctcggaaaccccaacctcgtccacgcgcagagcatcctcgccgtgctcggcttccaggtcctgctcatgggcctcgtcgagggattccgcatcaacggcctcgacggcgtcggcgagggcaacgacctctaccccggcggccagtacttcgaccccctcggcctcgcggacgaccccgtcaccttcgccgagctcaaggtcaaggagatcaagaacggacgcctcgccatgttctccatgtttgggttcttcgtgcaagccatcgtcaccggcaagggcccgttggagaacctcttcgaccacctcgacgaccctgtcgccaacaatgcctgggttttcgccaccaagttcgctcctggctcttaggccggtcgacgcagcacggcgccccgccgcttgtaaagtgtaaactactcttgtttgtctagtgtcatgcacgcaaatcgcaaacaatggtctcttgtactgttcttgtcagaattcagaaatctcaaggattttttggttccatctctcatgtctgtcaacttactatatgctctgcttaaaaaaaaaa

SEQ ID NO: 2336 - DNA, 2500 bp, Oryza sativa
ccctcttaaaaatagaagatactcctatacggattccatcgcttctggatgtgggtcccaggcgctcttcagcccggcccaaaaaacactgctgggccgaaacctgcgataacacatgagataggcaggcatccgacgtggcagcgccacgatccgaagccgcgccccgattggccccgcccaaatccagaaatctccacctcacccgctcacctccgccacaaactcccccgctacatatacgttacacgtagcacctccccttctagagtagtgttagtcttagcgaatccagcagcagaagcagcagcagcagctcagccgccgccgatggcgtccacgatcatggccccaacctcccgcgtcctcgccgccaagacccccttcctcggccatccccgcccctccaatgcccccgtccgcgacatcgccgccgccgccaccggccgcatcaccatgagcaaggagctgtggtacgggccggatagggtgaagtacctggggccattctcggcgcagacgccgtcgtacctgaggggcgagttcccgggcgactacgggtgggacacggcggggctctccgcggacccggaggcgttcgcgaggaacagggcgctggaggtgatccacggccggtgggcgatgctcggcgcgctgggctgcatcacgccggaggtgctcgagaagtgggtgcgcgtcgacttcaaggagcccgtgtggttcaaggccggcgcccagatcttctccgacggcggcctcgactacctcggcaaccccaacctggtgcacgcccagagcatcctcgccgtgctgggattccaggtcgtcctcatgggcctcgtcgagggctaccgcatcaacggcctccccggcgtcggcgacggcaacgacctctaccccggcggccagtacttcgacccgctcggcctcgccgacgaccccgtcaccttcgccgagctcaaggtcaaggagatcaagaatggccgcctcgccatgttctccatgttcggcttcttcgtccaggccatcgtcaccggcaagggccccttggagaacctgctcgaccacctcgccgaccccgtcgccaacaacgcctgggtctacgccaccaagttcacgccgggctcgtgaatggcccagccgccattgtagactactctctctctccatcgctcgatgtaccaatgcttgcacagattgtacgatgctgtgatgaatctgatatgatccatccagaattcagaaactgaaaaaagttggggtttgcaacttatgtgtcagctgctgctttaagcttagttaactcttttgatgttttaatttgtacatttgtgtactttgtaatgatccatacgagacctagtgtttgattattgctaatttgctgtggcattttcttgcatcaagtactggatacagagttcatcattcagatttttgaagatacaaaccttgcagacttcagttgaagcagagacaaaaacatttgcagacaaaggcagagatggagtaaaaacgccttgcaaattcgatgatttccttgctgtacacatattacagagctggtgttgcattatctctattcgctcatggcggataatctgtatttaattacccttccatatctcaggttcatctctctacatacaagatggcatacatacactgacaacaaagaactaatatacatgtacagacttcttgctttcacctatataaatcttttctctgataagctggacaccggacgatcgagtgccagcaccaccgccattgatgatggagctcatcatcgtcatcaacaacatcaccatcatctcgtcaggcttgcgatgaagaggagagaacctcgaagccttgtttttcacctcccagtctcttccattgtctcttcttggatgcagtagcagggaatgtagggaaatgcacttggattcagattgaatgcattcactttgagctcttcttcccccaccatcttttccgggatttctcctcaccaaccttctgaagatttaccttggtctccttcaaccgagacttgtagtctttcttccatgtcgcgaatcggtccttgagctttcggagttcatcgtctgggttcatgtttgaaccaacttgtccggacttcacggcaacaaggaagccagcatcgtcttcaaacacctgccgcctgtcctcaaactccttggctaggtggttcaccgcgtttatccgcctatctgaattcggtgctgccactctagcctcagagttgtggttttgatatttgaactctgtcccttcaggggtatgggtcccggtcgacgtatcttcagaatcataatgagcatgcattggagcagcgtcggttcgagctgctcggctggccacatcttctgcagttaggctcttcttggcagccacaaggctcaactgaaatgaatacagatgatttacatttagactccaaaggaatgtaatcttctaatgataatacaggaaaacactattgcaagac

SEQ ID NO: 2337 - DNA, 1214 bp, Oryza sativa
gctacatatacgttacacgtagcacctccccttctagagtagtgttagtcttagcgaatccagcagcagaagcagcagcagcagctcagccgccgccgatggcgtccacgatcatggccccaacctcccgcgtcctcgccgccaagacccccttcctcggccatccccgcccctccaatgcccccgtccgcgacatcgccgccgccgccaccggccgcatcaccatgagcaaggagctgtggtacgggccggatagggtgaagtacctggggccattctcggcgcagacgccgtcgtacctgaggggcgagttcccgggcgactacgggtgggacacggcggggctctccgcggacccggaggcgttcgcgaggaacagggcgctggaggtgatccacggccggtgggcgatgctcggcgcgctgggctgcatcacgccggaggtgctcgagaagtgggtgcgcgtcgacttcaaggagcccgtgtggttcaaggccggcgcccagatcttctccgacggcggcctcgactacctcggcaaccccaacctggtgcacgcccagagcatcctcgccgtgctgggattccaggtcgtcctcatgggcctcgtcgagggctaccgcatcaacggcctccccggcgtcggcgacggcaacgacctctaccccggcggccagtacttcgacccgctcggcctcgccgacgaccccgtcaccttcgccgagctcaaggtcaaggagatcaagaatggccgcctcgccatgttctccatgttcggcttcttcgtccaggccatcgtcaccggcaagggccccttggagaacctgctcgaccacctcgccgaccccgtcgccaacaacgcctgggtctacgccaccaagttcacgccgggctcgtgaatggcccagccgccattgtagactactctctctctccatcgctcgatgtaccaatgcttgcacagattgtacgatgctgtgatgaatctgatatgatccatccagaattcagaaactgaaaaaagttggggtttgcaacttatgtgtcagctgctgctttaagcttagttaactcttttgatgttttaatttgtacatttgtgtactttgtaatgatccatacgagacctagtgtttgattattgctaatttgctgtggcattttcttgcatcaagtactggatacagagttcatcattcagatttttgaagata

SEQ ID NO: 2338 - DNA, 1058 bp, Brachypodium distachyon
cgcagagcagcaaactgagacgccggagccgcagaagatggtatcgaccctcatggcccccgcctcccgcgccgtcgccggcaagacgccattcctcggcgcccgccccgccgtcgccagccccctccgcgacgtcgccgccgccgcgtccaacggcaggatctccatgagcaacgagctgtggtacgggccagaccgggtgaagtacctgggcccattctcggcccagacgccgtcatacctgagcggcgagttcccgggcgactacggctgggacacggccgggctatcggccgaccctgaagccttcgcccggaacagggcgctggaggtgatccacgggcgatgggcgatgctcggcgccctcggctgcgtgttcccggaggtgctccagaagtgggtgggcgtggagttcaaggagcccgtgtggttcaaggcgggcgcccagatcttctccgagggcgggctcgactacctgggaaaccccaacctggtccacgcgcagagcatcctggcggtcctcggctcgcaggtgctcctcatgggcctcgtcgaagggttccgcatcaacgggctcgacggcgtcggggaaggcaacgacctttacccgggcgggcagtatttcgacccgttgggactagccgatgaccctgtcacttttgctgagctcaaggtgaaggagatcaagaacggccggctcgccatgttctccatgttcgggttcttcgtgcaggccatcgttaccgggaaggggcccttggagaacctcttcgaccaccttgatgaccccgtcgccaacaacgcctgggttttcgccaccaagttcgcgcctgggtcttaggccctggcacggcacggcgcctggtccgccattgtaaactactcttctctgtgtgtataaacgtaccatgcgtgcaaattgcaaagaatggtcgatgtggattaaggaacttcagataagtggaggtttttttggttcgttttgtgtcgtctgctgcacttgtgagctggctgtttcaattatttctgggtgaagacatcatattagcattttatct

SEQ ID NO: 2339 - DNA, 3066 bp, Brachypodium distachyon
gggagggacgggatagggaagccatccgaggtggcaacaccacaccccgaccgatccaatgccgcccgccgattggcccgaaccaaatccagaaatcttctccacctcaactcaaatcctccacagcaaactcgtgctacaaatacttccacgtcgcctctctcaagtcctccaacaaacacctcgcagagcagcaaactgagacgccggagccgcagaagatggtatcgaccctcatggcccccgcctcccgcgccgtcgccggcaagacgccattcctcggcgcccgccccgccgtcgccagccccctccgcgacgtcgccgccgccgcgtccaacggcaggatctccatgagcaacgagctgtggtacgggccagaccgggtgaagtacctgggcccattctcggcccagacgccgtcatacctgagcggcgagttcccgggcgactacggctgggacacggccgggctatcggccgaccctgaagccttcgcccggaacagggcgctggaggtgatccacgggcgatgggcgatgctcggcgccctcggctgcgtgttcccggaggtgctccagaagtgggtgggcgtggagttcaaggagcccgtgtggttcaaggcgggcgcccagatcttctccgagggcgggctcgactacctgggaaaccccaacctggtccacgcgcagagcatcctggcggtcctcggctcgcaggtgctcctcatgggcctcgtcgaagggttccgcatcaacgggctcgacggcgtcggggaaggcaacgacctttacccgggcgggcagtatttcgacccgttgggactagccgatgaccctgtcacttttgctgagctcaaggtgaaggagatcaagaacggccggctcgccatgttctccatgttcgggttcttcgtgcaggccatcgttaccgggaaggggcccttggagaacctcttcgaccaccttgatgaccccgtcgccaacaacgcctgggttttcgccaccaagttcgcgcctgggtcttaggccctggcacggcacggcgcctggtccgccattgtaaactactcttctctgtgtgtataaacgtaccatgcgtgcaaattgcaaagaatggtcgatgtggattaaggaacttcagataagtggaggtttttttggttcgttttgtgtcgtctgctgcacttgtgagctggctgtttcaattatttctgggtgaagacatcatattagcattttatctatacctgtctaaaaaatacggaccttgacaagcatgttactgcgacctccgggcaaagatgtgattttgacggcgtgtgggcatgtggagcgggtggttcggaaggtgttatccccatcagtgtttttgtgatttgtttcttctatacacatcatgtaattgcgccacgtcggagtcatatgctgcggaggtgtgtctggtttgtaacttcacattaggagctctcatgtattcttcacaagggcgccgatggtataaaagtttcggatgtcgcatcggcatctcaccccaagagccacctaggaactccggtggctgcagcccaggccggctttggcagcggagactcggggctctccttctgcgactctccgcagcagcaggaccctccctgtctctggttgccactgtcaaccccgtcccaccggctccgtcgcgcacatcacctgttcgacggttggcctcggtcgcggtgccggtcgcggcgcgctgcaacggcatggggatgatgatggctggcagcggatcggtcgtggacgcaggaggaagaggcaacgccaccatgcccccctcccggtgacgactgtttgtcaggagctcgagggggcttctgttctcagtttgtcactatttggagagttggggcttgtttttcctttaattcttttaaggctgtgtcattctggaataggcagatgatacccattttatgttggtttctgagttacaaagtgctctatttctcaatatgtggttgacttgatgagcatttcatgcttttaaagtgctgttttcttattttctgtagatgtttaatttggattggatggttggccaggttttgggaaggtgaaggtgatggtgatggattgcagaagtgctagaatcctctagctgctcaattccttcatttgttacttctcacttttattgttgttatacctgttagatgtgagggatagtttttcagttggctctttttacagagcactgaatgcgccccaagtaccttaactttagtttatgtggagtgtcttatttccttttgaggttttaggtgtttctttggctagcaagtaaaggtagcttttaaacaagagttgtgttaatgtcgtgagggtggaagggagatgatctttgtctgttcctcgaaaggaagaagatcattgatcatcgatctctgcttctcttgttctctagcacattctgtttggagttttgtttaatgtacttttgtttctctcgtataccttgttcaattcaggacctatttgatagatgggttctacaatgtaacaaaaaagagagatataaggtgttagttggtattggggctatcatttggacaatgtggaaaactcgcaatgttgcttgtttctgtagcatttggtcgaatatggtccctctattagttttcaccatctgtttgattgttgatcactaggctggtttgcagaaagccgtcgtgcaggagcttctttgatggtgttcttggcgtggcggttgtggcaagtcgcgactaaggtgttctaccgttcgtgtggatggatcctgtcattaccctctttgcttcttgaagaatgagagctggtgaagtactgtcaaaggaattttgctggctgttgcactttcagaagttttagctgtagtttctagtattgctgggcaatcttttgtttcgaggattgtgatcctggagggtttccagccttgtgtggttgtgtttctcttcagctttgttgttctaattttgaatatttatgtaagactatatggtttcctttaatgaaaccggagggaggcctctgtttttcaaaaaaaaaa

SEQ ID NO: 2340 - DNA, 1131 bp, Glycine max
catccccaccaccaactcacactaaagtgtttctagccacaaatccctctggttctctttccctacatatgatgttacactcttccacatatttctctaaaccagtaagttatcttctagtatttttcaagtaacttaaggtttcaaacctaggaagttggaagtcatggcagcaacattgatggcagcaacaagttctggcactcttaaagcaactcctttcctaggccaaggcaagggtgccaatgccaatgctcttagggatgttgtttccatgggaactgggaagtacaccatgggcaatgatttgtggtatggaccagacagagtgaaatacttgggacccttttcagctcagaccccttcatacttgaaaggagaattcccaggggattatggatgggacactgctggcttatctgctgacccggaagcatttgccaagaacagggctcttgaggttatccatgggagatgggccatgcttggagcactaggatgcatcaccccagaggtgctagagaagtggttgagagtggacttcaaggagccagtgtggttcaaagctggagcccaaatattctcagaaggtgggcttgactatttggggaacccaaaccttgtccatgcacaaagcatcctggcagtgctgggcttccaagttatcctaatgggccttgttgaagggtaccgcatcaatgggcttgatggggtgggagagggcaatgacctctaccctgggggccagtactttgacccactgggccttgctgatgacccagtcacttttgctgagctcaaagtcaaggagatcaagaatggaaggctggccatgttctctatgtttggattctttgttcaagctattgtcactggaaaaggcccattggagaacctcttggaccaccttgacaaccctgtggctaacaatgcttgggtctatgccactaagtttgccccaggatcttaaatgtatatgacttcttcttccctaatccctatgatcatatcccttgtgtttgcctttgtgatttatgtgtagattatatgatcataataattgttggattagtgtacttcttaaggactaaggttcaatttaaacctgggatgcccttgtttgttgatcta

SEQ ID NO: 2341 - DNA, 984 bp, Castanea mollissima
caatccaattgagtttcaactctcaactgaaacaactgaaagcttggaagtcatggcatcaacgctaatggcagcaactgctagctctagcactgttctcaagccaaccccatttcttggccaaaataggggagccaatgtcaactctcttagagacgttgtacctatgggaactgggaaatacaccatggggaatgatttgtggtatggaccagacagagtgaagtacttgggacccttttcagctcagactccatcatacctgagaggagaatttcctggtgattatggatgggacactgctggcttatcagctgaccccgaagcctttgccaggaacagggcgcttgaggtgatccacggccgttgggctatgcttggagcactgggctgcatcaccccagaagtacttgagaaatgggttaaggtggacttcaaagaaccagtatggttcaaagctggagctcagatcttctcagaaggtggtcttgactacttgggcaaccccaaccttgttcatgcccaaagcatcctagcagtgctaggtttccaagtcatcctcatgggtctagttgagggattccgcatcaatggccttcctggagttggagagggtaacgacctctatcccggtggccaatacttcgaccctcttggccttgctgatgaccctgtcacatttgctgagctaaaggtcaaggagatcaagaatggccgcctagccatgttctcgatgtttggtttctttgtccaggctattgtcaccggcaagggccctctggagaacctcttggaccatcttgacaaccctgttgctaacaatgcatgggtctatgctaccaagtttgtgcccggatcttaaattcagcttcagagccatgatcttgttccatgagaatgaaatacaattgaagtccttgtgtagttattgtcttttttagacttcaaatttccatttgtgtgaaatgctagtaattttcggta

SEQ ID NO: 2342 - DNA, 1069 bp, Carpinus betulus
acttccgtcaacaattctctacttcttctaagcccagtttcagctgtaaaataactggaagcttgggattatggctgcaacgctaatggcagcaactgcaagctccagcactgtctcaggccaactccgtttcttggccaaaccaggggagccaacgctaaccctcttagagatgttgtctctatgggacctgggaaatacaccatggggaatgatctgtggtatgggccagacagagtgaagtacttgggacccttttcagctcagactccatcatacttgaccggagaatttcccggtgattatggctgggacactgctggtttatctgctgaccctgaagcctttgcaaagaacagggctcttgaggtgatccatggccgatgggctatgcttggagcactgggctgcatcactccagaagtccttgagaaatgggttaaagtagacttcaaggaaccagtatggttcaaagctggagctcaaatcttctcagaaggtggccttgactacctgggcaatcctaaccttgttcatgcccaaagcatcctagcagtgcttggcttccaagtcgtcctcatgggcctcgtcgagggattccgcatcaacggccttcccggagtcggagagggtaacgacctctacccgggcggccaatacttcgaccctctcggccttgccgatgaccctgtcacatttgctgagctcaaggtgaaggagataaagaacggccggctagccatgttctccatgtttggcttctttgtccaagccattgtcaccggcaagggcccgctggagaacctcttggaccatcttgacaaccctgtcgccaacaacgcatgggtctatgccaccaagttcgtgcccggatcttaagttgagcttcagtcctttgatcttgtttcatgtcaatgaaatagaaggggatccatgtgtagttactgtaattttagacttcaaaaacttcatgttgtattggtgtgatccaacggtagctattgattttcaggaaataatgcaaattgttataaaatatgctgatatagcaatgaaaatcaaatttagt

SEQ ID NO: 2343 - DNA, 872 bp, Secale cereale
ccgcctcccgcgccgttgtcgccaagacgccgttcctcagcggccagggccgcgccgccagcgccagccccctgcgcgacattgccgccgcggccaacggcagaatcaccatgggcaacgacttgtggtacggcccggaccgcgtcaagtacctgggccccttctccgcgcagacgccgtcgtacctgaacggcgagttccccggcgactacggctgggacaccgccgggctttctgccgacccagaggcgttcgcgaggaacagggcgctggaggtgatccacgggcggtgggcgatgctcggcgctcttgggtgcgtcttccccgaggtgctccagaagtgggtgggcgtcgagttcaaggagcccgtctggttcaaggccggctcgcagatcttctctgagggtggtctcgattaccttggaaaccccaacctcgtgcacgcgcagagcattcttgccgtgctcggcttccaggtccttctcatgggtctcgttgaagggttccgcatcaacggtctcgatggtgtcggcgagggcaacgacctctaccccggcggccagtacttcgacccgctgggccttgccgacgaccctgtcaccttcgcagagcttaaggtgaaggagatcaagaatggccgtctcgccatgttctctatgtttgggttcttcgtccaagctatcgtcaccggcaagggtccattggagaacctgttcgaccacctcgacgaccctgtcgccaacaatgcatgggttttcgctaccaagtttgcgcctggatcttaggctggccgacgcgccacgatggcctgccattgtaaagtgtaaactactcccatgtgtgtggaaatagcaacgaatggtcgatgactc

SEQ ID NO: 2344 - DNA, 978 bp, Setaria italica
atcgatcatggccgccgccacctcccgcgtcctcgccgccaagacgctgttcctcggccagggccgcgccgccgccaatgccagccccctccgcgacgtcgccgcagccgccagcggccggatcaccatggtacgtacccagcatcagtccagcttgcttaggtgctgacgaacaagtccttgttgtttgcagagcaacgacctgtggtacggcccggaccgcgtcaagtacctgggccccttctccgcgcagactccctcctacctcaccggcgagttccccggcgactacggctgggacacggcggggctctccgccgacccggaggcgttcgcccgcaacagggcgctggaggtgatccacgggcggtgggcgatgctgggcgcgctgggctgcatcacgcccgaggtgctcgagaagtgggtgcgcgtggacttcaaggagcccgtgtggttcaaggccggcgcgcagatcttctccgagggcgggctggactacctgggcaaccccaacctggtgcacgcgcagagcatcctcgccgtgctgggcttccaggtcatcctcatgggcctcgtcgagggcttccgcatcaacggcctcgacggcgtcggcgagggcaacaacctctacccgggcggccagtacttcgacccgctcggcctcgccgacgaccccgtcaccttcgccgagctcaaggtcaaggagatcaagaacggacgcctcgccatgttctccatgttcggattcttcgtgcaggccatcgtcaccggcaaggggcccctcgagaacctgctcgaccacctcgacgaccccgtcgcaaacaacgcctgggtctacgccaccaagttcgcgcccgggtcttaagaagctagacggctgcttcgtgcctgccaccattgtagactactcgttacttttgtaccaccaattaatgcaaataccttgttctcaggattcaggaatgtgcattatgctct

SEQ ID NO: 2345 - DNA, 905 bp, Secale cereale
tggccgccgctcccgcgccgttgtggccaagacgccgttcctcagcggccagggccgcgccgccagcgccagccccctgcgcaacatcgccgccgcggccaacggcagaatcaccatgggcaacgacttgtggtacggtccggaccgcgtcaagtacctgggccccttctccgcgcagacgccgtcgtacctgaacggcgagttccccggcgactacggctgggacaccgccgggctttctgccgacccggaggcgttcgcgaggaacagggcgctggaggtgatccacgggcggtgggcgatgctcggcgctcttgggtgcgtcttccccgaggtgctccagaagtgggtgggcgtcgagttcaaggagcccgtctggttcaaggccggctcgcagatcttctcagagggtggcctcgattaccttgggaaccccaacctcgtccacgcgcagagcatccttgccgtgctcggcttccaggtccttctcatgggtctcgttgaagggttccgcatcaacggtctcgatggtgtcggcgagggcaacgacctctaccccggcggccaatacttcgacccgctcggccttgccgacgaccctgtcaccttcgcggagcttaaggtgaaggagatcaagaatggccgtctcgccatgttctctatgtttgggttcttcgtccaagctatcgtcaccggcaagggcccattggagaacctgttcgaccacctcgacgaccctgtcgccaacaatgcatgggttttcgctaccaagtttgcgcctggatcttaggctggccgacgcgccacggtggcctgccattgtaaagtgtaaacaactcccatgtgtgtgcaaatagcaacgaatggtcgatgtgatctcgaaattcgaaattcggagcattttt

SEQ ID NO: 2346 - DNA, 1114 bp, Quercus alba
tgggacacagttctaggcgacaattccaattgagtttcaactctcaactgaaacaactgaaagcttggaagtcatggcatcaacgctaatggcagcaactgctagctctagaactgttctcaagccaaccccatttctaggccaaaataggggaaccaatgtcaactctcttagagacgttgtacctatgggaactgggaaatacaccatggggaatgaattgtggtatggaccagacagagtgaagtacttgggacccttctcagctcagactccatcatacctgagaggagaatttcctggtgattatggatgggacactgctggcttatcagctgaccccgaagcctttgccaggaacagggcgcttgaggtgatccacggccgttgggctatgcttggagcactgggctgcatcaccccagaagtacttgagaaatgggttaaggtggacttcaaagaaccagtatggttcaaagctggagctcagatcttctcagaaggtggtcttgactacttgggcaaccccaaccttgttcatgcccaaagcatcctagcagtgctaggtttccaagtcatcctcatgggtctagttgagggattccgcatcaacggccttcctggagttggagagggtaacgacctctatcccggtggccaatactttgaccctcttggccttgctgatgaccctgtcacatttgctgagctaaaggtcaaggagatcaagaatggccggctagccatgttctccatgtttggtttctttgtccaggctattgtcaccggcaaggggcctctggagaacctcttggaccatcttgacaaccctgttgctaacaatgcatgggtctatgccaccaagtttgtgcccggatcttaaattgagcttcagagccatgatcttgttccatgagaatgaaatacaattgaagtccttgtgtagttattgtcttttttagacttcaaatttccatttgtgtgaaatgctagtaattttcgggtagtgctggtcttctctagttaaacaaactgaaaaaaataggtattccttaatacgatgacgcaaaatagaaggttattcatatattggctaagagaatcataatgccaa

SEQ ID NO: 2347 - DNA, 1377 bp, Quercus alba
tgctcaatcctcttgaaagaagtctctgtatggtggcccgtggactaagataaaatgtggatagaaagatatgagtcaatatcttttgaagacttctgattggttgattcaaagctcacattcctacaaccacaatttcccactcttgcattcataaccacccatctctttgattgtccttattccctatacataatattacagtcaggctccttaattgtctacacagttctaggcgacaattccaattgagtttcaactctcaactgaaacaactgaaagcttggaagtcatggcatcaacgctaatggcagcaactgctagctctagaactgttctcaagccaaccccatttctaggccaaaataggggaaccaatgtcaactctcttagagacgttgtacctatgggaactgggaaatacaccatggggaatgaattgtggtatggaccagacagagtgaagtacttgggacccttctcagctcagactccatcatacttgagaggagaatttcctggtgattatggatgggacactgctggcttatcagctgaccccgaagcctttgccaggaacagggcgcttgaggtgatccacggccgttgggctatgcttggagcactgggctgcattaccccagaagtacttgagaaatgggttaacgtggacttcaaagaaccagtatggttcaaagctggagctcagatcttctcagaaggtggtcttgactacttgggcaaccccaaccttgttcatgcccaaagcatcctagcagtgctaggtttccaagtcatcctcatgggtctagttgagggattccgcatcaacggccttcctggagttggagagggtaacgacctctatcccggtggccaatactttgaccctcttggccttgctgatgaccctgtcacatttgctgagctaaaggtcaaggagatcaagaatggccggctagccatgttctccatgtttggtttctttgtccaggctattgtcaccggcaaggggcctctggagaacctcttggaccatcttgacaaccctgttgctaacaatgcatgggtctatgccaccaagtttgtgcccggatcttaaattgagcttcagagccatgatcttgttccatgagaatgaaatacaattgaagtccttgtgtagttattgtcttttttagacttcaaatttccatttgtgtgaaatgctagtaattttcgggtagtgctggtcttctctagttaaacaaactgaaaaaaatggtattccttaatacgatgacgcaaaatgaaggttattcatatattggctaagagaaatcataatgccaaggacccaattaagtttgaatggaccaaaaatttattacagtttct

SEQ ID NO: 2348 - DNA, 1090 bp, Glycine max
ccctacatattgatgttacactcttccacacatttctctttaaaccaattagttatcttctatttttcaagtaacttaaggtttcaaacctaggaagttggaagtcatggcagcaacattgatggcagcaacaacaagttctggtactcttaaagcaactcctttccttggccaaggcaagggtgccaatgccaatgctcttagggatgttgtctccatgggaactgggaagtacaccatgggcaatgatttgtggtatggaccagacagagtgaaatacttgggacccttctcagctcagaccccttcatacttgaaaggagaattccctggggattatggatgggacactgctggcttatctgctgacccagaagcatttgccaagaacagggctcttgaggtgatccatgggcgatgggccatgcttggagcactaggatgcatcaccccagaggtgctagagaagtggttgagagtggacttcaaggagccagtgtggttcaaagctggagcccaaatattctccgaaggtgggcttgactatttgggaaacccaaaccttgtccatgcacaaagcatcctggcagtgctgggcttccaagttatcctaatgggccttgttgaagggtaccgcatcaatgggcttgatggggtgggagagggcaatgacctctaccctgggggccagtactttgacccactgggcctagctgatgacccagtcacttttgctgagctcaaagtcaaggagatcaagaatggaaggttggccatgttctctatgtttggattctttgttcaagctattgtcactggaaaaggtccattggagaaccttttggaccacctagacaaccctgtggccaacaatgcttgggtctatgccactaagttttccccagggtcttaaaatgtatatgacttcttcttccctaatccctatgatcccatccctcgtgcttacctttgtgatttatgtgtagattatatgatcacaataattgttggattagtgtacttcttaaggactaaggttcaatttaaacctcggatgtctcttgtttgttaatatagttttgtctgaagc

SEQ ID NO: 2349 - DNA, 806 bp, Fraxinus spp
aaatggcatcaatggctgccactgccagttccaccgcagttgttagggcaactccattcttgggccaaaccaagaatgcaaatcctcttagagatgttgtctttatgggaaatggcaaatacaccatgggtaatgacttatggtatggaccggatcgcgtcaagtacttggggccattctctgctcaaactccatcgtacttgactggagaattcccaggtgattatggttgggacactgctggtttatctgctgatcctgaggcctttgcaaggaacagggcccttgaggttattcacgggcgatgggcaatgcttggagctctggggtgcatcaccccagaagttcttgagaaatgggttaaagtagactttaaagagccagtttggttcaaggctggagctcaaatcttctctgaaggtggactagactacttgggcaatcccagtcttgtacatgcacaaagcattttggccgttcttggattccaagtagttcttatgggacttgttgaaggattcagaattaacggcttagaaggtgtaggagagggcaacaacctttaccctggtggccaatactttgatcctcttggccttgctgatgaccccgtcacttttgctgagctcaaagtgaaggaaatcaagaatggaaggctagccatgttctccatgttcgggttctttgttcaggctattgtcactggaaaaggccctctggagaatctgttggaccaccttgataaccctgttgctaacaatgcctgggtctatgccaccaagttcgccccaggatcataagcccag

SEQ ID NO: 2350 - DNA, 1095 bp, Juglans hindsii x Juglans regia
  misc_feature (67)..(67): n is a, c, g, or t
  misc_feature (144)..(144): n is a, c, g, or t
  misc_feature (901)..(901): n is a, c, g, or t
ttctcaaaactcttctttctaagagcagtctcaattgtaaaataactgtaagattgggagcatggcngcaatggcaatggcagcaactgctagctctagcactgttctcaggccaactccatttcttggccaaaacaggggagncaacgccaaccctcttagagatgttgtgcccatgggaactgggaaatacaccatgggaaatgatctgtggtatgggccagacagagtgaagtacttgggacccttttcagctcagactccatcatacttgactggagaatttccaggtgactatggctgggacactgctggattatctgctgatccggaagcctttgctaagaacagggctcttgaggtgatccacggcagatgggcaatgcttggagcactgggctgcatcaccccagaagttcttgagaaatgggtcagagtagacttcaaagaaccagtatggttcaaagctggagctcaaatcttctcagaaggtggccttgactatctgggcaatcccaatcttgttcatgctcaaagcatcctagcagtgctaggcttccaagtcattctcatgggcttagtcgagggattccgcatcaacggccttcctggagttggagagggcaatgatctttacccaggtggccaatacttcgatcctcttggccttgctgatgaccctgtggcatttgctgaactcaaggtgaaggagatcaagaacggccggctagccatgttctcaatgttcggtttcttcgtccaagccatcgtcaccggcaagggcccgcttgagaacctcttggaccatcttgacaaccctgttgccaataatgcatgggtctatgccaccaagttcgtgcccggatcttaaactgaacttgggtccctcaatcttgtttcntgtgatctaaatagaattggaagtccatgtgtagttaacgtaatttcagacttaaaaacttacaaatgtgtatttgctttatccaacgatggccattgatttttgggttgtgcaagccttatctctggttgaacaatctgagagagatggtattcctaagtttgatgaatgaaaatgaataggaaattcatccg

SEQ ID NO: 2351 - DNA, 1211 bp, Phaseolus coccineus
gctccaaagcacaccatccccaccaccaacttctactcttgtttctaaccacatatccctcttattctctttccctacatatgatgttacattcccttcttctactcacttctctgcaaaccactagttatcattttttgaagtaacttgaggtttcaaacctaggaagttggaagtcatggcagcaacattgatggcagcaacaagtagttctggcactgttcttaagtcaactcctttccttggccaaggcaagggtgccaatgccaaccctcttagggatgttgtctcaatgggaaccgggaagtacaccatgagcaatgagttgtggtatggaccagacagagtgaaatacttgggacccttctcagctcaaaccccttcatacttgaagggtgaattcccaggtgattatggatgggacactgctggcttatctgctgacccagaagcatttgccaagaacagggctcttgaggtgatccatgggcgttgggccatgcttggagcactgggctgcatcaccccggaggtgctagagaagtggttgagagtggacttcaaggagcccgtatggttcaaagctggggcccagatattctcagaaggtgggcttgactatttggggaacccaaaccttgtccatgcccaaagcatcttggcagtgctgggcttccaagtagttctgatgggccttgttgaagggttccgcatcaatgggcttgatggagtaggagagggcaacaacctttaccctgggggccagtactttgacccactgggcctggctgatgacccagtaaattttgctgagctaaaagtgaaggagataaagaatggaaggttggccatgttctctatgtttgggttttttgttcaagccattgtaactggcaaaggcccattggagaacctgttggaccaccttgacaaccccgtggctaacaatgcttgggtctttgccaccaagtttgcccctggatcttaaatctccctattatccaccccttatcattattctcatttatatgtagattatcatcataaataataattgttggattagtgtactttttaaggactaagcctctttttccaatgagaaaggtgttttttttcctaatcataaaatgtataaatagattttcattgttattttcttttttatatctttgaaatagaatttaaatttttaatattagtaaaccagg

SEQ ID NO: 2352 - DNA, 1077 bp, Phaseolus coccineus
ctagttatcattttttgaagtaacttgaggtttcaaacctaggaagttggaagtcatggcagcaacattgatggcagcaacaagtagttctggcactgttcttaagtcaactcctttccttggccaaggcaagggtgccaatgccaaccctcttagggatgttgtctcaatgggaaccgggaagtacaccatgagcaatgagttgtggtatggaccagacagagtgaaatacttgggacccttctcagctcaaaccccttcatacttgaagggtgaattcccaggtgattatggatgggacactgctggcttatctgctgacccagaagcatttgccaagaacagggctcttgaggtgatccatgggcgttgggccatgcttggagcactgggctgcatcaccccggaggtgctagagaagtggttgagagtggacttcaaggagcccgtatggttcaaagctggggcccagatattctcagaaggtgggcttgactatttggggaacccaaaccttgtccatgcccaaagcatcttggcagtgctgggcttccaagtagttctgatgggccttgttgaagggttccgcatcaatgggcttgatggagtaggagagggcaacaacctttaccctgggggccagtactttgacccactgggcctggctgatgacccagtaaattttgctgagctaaaagtgaaggagataaagaatggaaggttggccatgttctctatgtttgggttttttgttcaagccattgtaactggcaaaggcccattggagaacctgttggaccaccttgacaaccccgtggctaacaatgcttgggtctttgccaccaagtttgcccctggatcttaaatctccctattatccaccccttatcattattctcatttatatgtagattatcatcataaataataattgttggattagtgtactttttaaggactaagcctctttttccaatgagaaaggtgttttttttcctaatcataaaatgtataaatagattttcattgttattttctttcttatatctttgaaatagaatttaaatttttaatatt

SEQ ID NO: 2353 - DNA, 1193 bp, Arachis hypogaea
gttgctccaagcaacacccatccccaccacaaaaacttgcaacccttcttgtgttcctaatcacacattccctacgattttatttcctacaaatgatgtcacactcaccgagacctcctttctacaagcttcggttatcaatttaatgtctcctatttaagcaaattaataagctttcaatttttgaactgaagtacctagaagcttggaagtcatggcagcaacattaatggcagccacagctagctctggcactgtccttaaatcaacccctttccttggtcaaactaggggatccaacgctaaccctcttagagatgttgtctctatgggaactgggaaatacaccatgggaaatgaattgtggtatggaccagacagagtgaaatacttgggacccttttcagctcagacaccttcgtacttgactggagagttcccaggagactatggttgggacactgctggtttgtctgctgatcctgaagcatttgccaggaacagggctcttgaggttatccatggacgctgggctatgctgggagcactagggtgcatcaccccagaagtgctagaaaagtgggtcagagtggacttcaaggagccagtttggttcaaagcaggagcacaaattttctccgaaggcggcctcgactacttaggcaacccaaatctagtccatgcacagagcacctggcagttcttggattccaagttgtcctcatgggcctcgtcgagggcttccgcatcaacggcctccccggcgtgggccagggcaacgacctctatcctgggggacagtactttgaccctcttggacttgccgacgaccctgtcactttcgctgagctcaaggtgaaggagatcaagaacggaaggttggctatgttctccatgtttggtttctttgtgcaagccattgtcactgggaaaggaccacttgagaaccttttggatcaccttgataaccctgtggctaacaatgcttgggtctatgccactaagtttgtgcctggttcttgatacccctgtatgcttaatgtgtatgtatcatgtgacatggaaattaaacttgtagattattaccattatatatttctgttatggtcatggatttcaatcacgtaacataaattgatcttcaattaggattgaagtaaaaacaagtaactatgatagagtaaaatgaatag

SEQ ID NO: 2354 - DNA, 907 bp, Centaurea maculosa
aaccacaccttcatctaaccaacaaaacacacacacagacacacacaaatggctgcaaccgctgctagctccaccactgtggttagagccaccccattcttgggtcaagccagatcaaacctcaaccccctaagagatgtggtctccatcccaaatgccaagttcaccatgtcaaatgatttgtggtatggaccggatcgtgttaagtacttgggaccattttcggctcagaccccatcttacttgaccggtgagttccccggtgactacggttgggacactgctggtttgtcggctgatcccgaggcttttgccaagaacagggcccttgaggtcatccatggacgatgggccatgcttggtgcattcgggtgcatcacccctgaggtccttgaaaagtgggtcaaagtggacttcaaggagccagtttggttcaaggctggagcccagatcttctctgaaggcggtctggactacctaggcaacccaaacctggttcatgctcagagcattctagccgtgctcggattccaagtgatcttgatgggactcgttgagggtttcagaattaacggtcttgatggtgttggagagggtaacaatttgtacccgggtgggcaatatttcgacccattgggattggctgatgacccagtaacatttgctgagttgaaggtgaaggagataaagaatggtagattggcaatgttctcaatgtttggattctttgtgcaagcgatagttaccggaaaaggtccattggagaacctattggaccatttggacaaccctgtggctaacaatgcatgggtctatgctaccaagtttgtgcctggctcataagccttcaaaaaccttccttgtaattgagagtttggtgagattgtgagaatgtgtagattattaa

SEQ ID NO: 2355 - DNA, 1093 bp, Tropaeolum majus
aacactcatcatttactcaagtgaaaaaaaaaggataacccaaatcaggaaatctaaagtaatagtgtttgagattgagcatggcatcaatggcttcaactgccacctccagtactgttctgagtccaaccccatttcttggtcaaaccagagggtcaagtgttaaccctcttagagatgttgtctccatgggtactggaaaatacactatgggaaatgatttgtggtatggaccagacagagtgaagtacttgggacccttttcagctcagactccatcttacctgactggagagtttccaggtgattatggatgggatactgctggtttatcagctgacccagaagcttttgctaagaacagggctcttgaggttatccatgggagatgggctatgctcggagcttttggttgtataaccccagaagtcctagagaagtgggttaaagtagacttcaaggagccagtttggttcaaggctggtgcacaaatattctcagaaggtggcttagactacttgggtaaccccaacctggttcatgcccaaagcatcttagcagtccttggattccaggttatcctcatgggtcttgttgaaggtttccggatcaatggtctccctgaagtaggagaaggcaatgatctttaccctggtggccaatacttcgatcctcttggccttgccgatgaccctgttacatttgctgagcttaaggttaaggaaatcaagaatggccggttagccatgttttccatgtttggtttctttgttcaagcaattgttactggcaaaggtccccttgagaacctcctagatcaccttagtgaccctgttgctaacaatgcctgggtttacgccaccaagttcgctcctggatcatagatttctcttcagtactccattatgcatccttgctacataacacttgttgtatatgtagatttatgagatcttgcataatttgtatttgagtaagattcaatgtagctataacctggtatgagctgtaacaattcaaatgatgtgattatctttcctcgttctttttgtatatgtgggtatttacactactattcttctatacatatacc

SEQ ID NO: 2356 - DNA, 910 bp, Cirsium arvense
acaaaacacacacacacacaaatggctgcaactgctgctagctccaccactgtggttagagccaccccattcttgggtcaagccagatcaaacctcaaccccctaagagatgttgtctccatccctaatgccaagttcaccatgtcaaatgatttgtggtatggaccggatcgtgttaagtacttgggaccattttcggctcagaccccatcttacttgactggtgagttccccggtgactacggttgggacactgctggtttgtcggctgatcccgaggcttttgccaagaacagggctcttgaggtcatccatggacgatgggccatgcttggcgcattcgggtgcatcacccccgaggtccttgaaaagtgggtcaaagtggacttcaaggagccagtttggttcaaggctggagcccagatcttctctgaaggcggtctggactacctaggcaacccaaacctagttcatgctcagagcattctagccgtgctcggattccaagtgatcttgatgggactcgttgagggtttcagaattaacggtcttgatggtgttggagagggtaacaatttgtacccgggtgggcaatatttcgacccattgggattggctgatgacccagtaacatttgctgagttaaaggtgaaggaaataaagaatggtagattggcaatgttctcaatgtttggattctttgtgcaagcgatagttaccggaaaaggtccattggagaacctactggaccatttggacaaccctgtggctaacaatgcatgggtctatgctaccaagtttgtgcctggctcataagccttcaaaaaccttccttgtaattgagagtttggtgagattgtgagaatgtgtagattattaatataatttaattttatatggaagtttaata

SEQ ID NO: 2357 - DNA, 894 bp, Cirsium arvense
cacacacacacaaatggctgcaaccgctgctagctccaccactgtggttcgagccaccccattcttgggtcaagccagatcaaacctcaaccccctaagagatgttgtctccatccctaatgccaagttcaccatgtcaaatgatttgtggtatggaccggaccgtgttaagtacttgggaccgttttcagctcagaccccatcttacttgaccggtgagttccccggtgactacggttgggacactgctggtttgtcggctgatcccgaggcttttgccaagaacagggctcttgaggtcatccatggacgatgggccatgcttggtgcattcgggtgcatcacccctgaggtccttgaaaagtgggtcaaagtggacttcaaggagccagtttggttcaaggctggagcccagatcttctcagaaggtggtttggactacctaggcaacccaaacttggttcatgctcagagcattctagccgtgctcggattccaagtgatcttgatgggactcgttgagggtttcagaattaacggtcttgatggggttggagagggtaacaatttgtacccgggtgggcaatatttcgacccattgggattggctgatgacccagtaacatttgctgagctaaaggtgaaggaaataaagaatggtagattggcaatgttctcaatgtttggattctttgtgcaagcgatagttaccggaaaaggtccattggagaacctattggaccatttggataaccctgtggctaacaatgcatgggtctatgctaccaagtttgtgcctggctcataagccttcaaaaatcttcattgtaattgagagtttggtgagattgtgagaatgtgtagattattaatataatttaattttatatggaa

SEQ ID NO: 2358 - DNA, 1121 bp, Euonymus alatus
atttcttccacaaaatatatgctccactctctctacacagactgcctacaactacaatctctcctctttgacagttcaatctaagctcttcaactgaaaagaggaaaaaggttggttgagacttgagagggaatggcatcaatgctaagtgccagcactgtcctcaggacaaccccatttcttggacagggcaggtcatcatttgctaaccctcttagagatgttgtctccatgggcactccaaaatacaccatggggaatgacttgtggtatggaccagacagagtgaagtacttgggaccattttcagctcaaactccttcatacttgactggagagttccctggtgactatggatgggatactgctggtttatcagctgacccagaggcttttgccaagaacagagccctagaggtgatccatgggagatgggctatgcttggggcactaggctgcattaccccagaagtacttgaaaaatgggttaacgtggacttcaaagagccagtgtggttcaaagcaggagctcaaatcttctctgaaggtggcctggactacttaggcaacccaaaccttgttcatgctcaaagcatattggcagttctgggattccaagttgttctcatgggacttgttgagggattccgcatcaatggcctccctggcgtcggagagggtaacgacctctatcctggtggtcagtacttcgaccctcttggcctagccgacgatcctactacgtttgctgagctcaaggtgaaggaaatcaagaatggcaggctagctatgttctctatgtttggtttctttgttcaagctattgtcactggaaagggtcctctggaaaacctcttggaccatcttgacgaccctgttgctaataatgcctgggtctatgccaccaagtttgcacctggatcgtaaattacttctctaggctatttgtttggattgtgtgaatgtaccaagactagaaagcttaatgcattgttaaaacttctgtacctttagaactcatgtaaatgttgattccatgcaacaaggtcggcttatggcctcggctccttttcagacatactctctacaccagcttaaatacagcaatgtaaaggacagcg

SEQ ID NO: 2359 - DNA, 1101 bp, Tropaeolum majus
cggccggggaactcaaataacactcatcatttactcaagtgaaaaaaaggataacccaaatcaggaaatctaaagtaatagtgtttgagattgagcatggcatcaatggcttcaactgccacctccagtactgttctgagtccaaccccatttcttggtcaaaccagagggtcaagtgttaaccctcttagagatgttgtctccatgggtactggaaaatacactatgggaaatgatttgtggtatggaccagacagagtgaagtacttgggacccttttcagctcagactccatcttacctgactggagagtttccaggtgattatggatgggatactgctggtttatcagctgacccagaagcttttgctaagaacagggctcttgaggttatccatgggagatgggctatgctcggagcttttggttgtataaccccagaagtcctagagaagtgggttaaagtagacttcaaggagccagtttggttcaaggctggtgcacaaatattctcagaaggtggcttagactacttgggtaaccccaacctggttcatgcccaaagcatcttagcagtccttggattccaggttatcctcatgggtcttgttgaaggtttccggatcaatggtctccctgaagtaggagaaggcaatgatctttaccctggtggccaatacttcgatcctcttggccttgccgatgaccctgttacatttgctgagcttaaggttaaggaaatcaagaatggccggttagccatgttttccatgtttggtttctttgttcaagcaattgttactggcaaaggtccccttgagaacctcctagatcaccttagtgaccctgttgctaacaatgcctgggtttacgccaccaagttcgctcctggatcatagatttctcttcagtactccattatgcatccttgctacataacacttgttgtatatgtagatttatgagatcttgcataatttgtatttgagtaagattcaatgtagctataacctggtatgagctgtaacaattcaaatgatgtgattatctttcctcttcttttttgtatatgtggagtattttacactacattcttacgt

SEQ ID NO: 2360 - DNA, 1201 bp, Platanus occidentalis
cagaattaactgcatcactcaaacccaacggtttcttccctgcaactccaacaaccggcaaggcgatagatatggcggctacgctaatggcagcatccgccagctccagcactgtccttagaccaaccccatttttgggccaaaaccgggcagccaatgctaacccacttagagatgttgtttctatgggcactgggaaattcactatggggaatgagttatggtatggtccagaccgtgtgaagtacttgggacccttctctgctcagaccccttcataccttaccggagaatttcccggtgactatggatgggacactgctgggttatctgctgatccagaggcctttgccaagaacagggctcttgaggtgatccacggccgatgggctatgctcggggcactcgggtgcatcacaccagaagtccttgagaaatgggtaaaagtagacttcaaggaaccagtgtggttcaaagctggagctcagatcttctccgagggtgggcttgactacttgggcaaccccaaccttgtccatgcccagagtatcttggcagttctgggcttccaagtcgttctgatgggattggtcgagggcttccgcatcaatggccttccaggagttggtgagggcaacaacctctaccctggtggaacctacttcgacccacttggacttgccgatgatcctgtcacctttgcagagctcaaggtgaaggagatcaagaatggccggctcgccatgttctccatgtttggattctttgtccaggccattgtcacgggcaaaggccccttggagaacctcttggatcaccttgacaaccctgtggctaacaatgcatgggtctatgccaccaagtttgttccaggatcctagatttgattcagtaactttgctcccatcttttgtgaaaatgagtttaaatgggtagtttgtgtgtagattataatggtatgtagtgggttttcaagaatgaaactcaattagtaagattcaatgtattttgtgatgttgctgttggaaagggcgttccaaaattatccttgaatttagcctaggttattttattttattttattttaaaatcaagttttattatttataactaattaatcgagtgaaccgagtcaaagaggtgttgtcatcacatttctagaaaataatcgaagcttcccataattgtgaaagggatcgta

SEQ ID NO: 2361 - DNA, 1152 bp, Prunus persica
ataaaatgtggatagaaagatatgagttggagatgcttaaaaatcctttgaagccttctcattggttgattcaaaccctcagaatccccaccataatttccccctcctccattttcagccacccatctgtgcataatattgcacacagcagcttccctttctacacacttccaagctgcaacacaaatcttattaacttatcagaagacaaagtcaactgaatttcctgaaaagcttgaaagtcatggcatctacactaatggcagcaactgctagctccagcactcttcttagaccaaccccatttcttggccaaaccagagggccaagtttcaacactcttagagatgttgccccaatgggaactgggaaatacaccatgggaaatgagttgtggtatgggccagacagagtgaagtatttgggacccttttctgctcagactccatcgtacctcaccggagaatttcccggtgattacggatgggacactgcagggttatcagctgacccagaggcctttgctaagaacagggctcttgaggtgatccacggccggtgggctatgcttggagcactaggctgcatcaccccagaggtgcttgaaaaatgggttagagtggacttcaaagagccagtgtggttcaaggccggagctcaaattttctcagaaggtggccttgactatttaggcaaccctaaccttgtccatgctcagagcatcctagcagtgctaggattccaagtcattctcatggggcttgttgagggatttcgcatcaacggtcttgacggcgtaggagagggcaacaacctctaccctggagggcaatacttcgaccctctcggccttgccgatgaccctgtgacatttgctgagctcaaggtcaaggaaatcaagaatgggagactagccatgttctccatgtttggcttctttgtccaagccattgtcactgggaagggtcctcttgagaacctcttggaccaccttgacaaccctgtggccaacaatgcatgggtctatgccaccaagtttgtgcctgggtcataaatttatcttcagtcctctaattgattgatcttgtttgggagaatgtaattgaatggattttatgtagatgtttatatagttgccgttttaatattggt

SEQ ID NO: 2362 - DNA, 1168 bp, Aristolochia fimbriata
gcccttctccctcctgcaactaaacaaccttccagtcacttctcaggcacttcttcctctcggatggcggccaccattactgcagcgtccgccagctctggcaccgttcttagaccctccgcgtttctgggtcagaagtccaacgccaaccctttgagagatgttgtgcctgcgggcaacggaaggattaccatggggaacgagctctggtacggtcccgaccgcgttaagtacttgggtcccttctccgctcagacgccgtcctacctcaccggagaattccccggcgactacggatgggacaccgccggtctctcggccgacccagaagccttcgccagaaacagggctctcgaggtgattcacgggaggtgggcgatgctcggagctctgggctgcatcacccctgaggttctggagaaatgggtgaaagtggacttcaaggagcccgtctggttcaaagccggggcacagatcttctccgagggcggactcgattacctgggcaaccccaacctcgtccacgcccagagcatcctggccgtgctgggcttccaagtcgtcctcatgggactcgtcgagggctttcgcatcaacggattgcccggcgtcggcgacggcaataacctctaccctggtggcacctacttcgaccccctcggcctcgccgacgaccccgtcaccttcgccgagctcaaggtcaaggagatcaaaaacggccggcttgccatgttctccatgttcgggttcttcgtccaggccatcgtcaccggcaagggacctcttgagaacctcttggaccacctcgacaaccccgttgccaacaacgcctgggtctacgccaccaaattcgtccctggatcttaaaaagagtgttttcctctgagtcgccttctcttggtcaggcgcacctctgtagaatatcttgccaagcccaagccatctcttgtaatatttaggaaccatggagtaatgaaatcattcttctgagtctctcactgcttgctgggttgggaattgggatgcagaagctgattgagattattctgatatctgatttgcaagggcagcaataactatcattttcaagaagtaacagtaatgactaatgactttcatttaactaaaaaaaaaaaaaaaagtaacggatgcgttgttaccactgctt

SEQ ID NO: 2363 - DNA, 1119 bp, Vigna unguiculata
ccgcgggaattcgataagcgtggtcgcggccgacgtacacggggactcacttctgcaaaccactggttatcatatttttttccgtaacttgaggtttgaaaacctaggaagttggaagtgatggcagcaacattgatggcagcaacaagtggttctggcactgttcttaaaccaactcctttcctcggccaaggaaagggtgccaatgccaaccctcttagggatgctgtctcaatgggaaccgggaagtacaccatgagcaatgatctgtggtatggaccggacagagtgaaatacttgggaccgttttcggctcaaacaccttcatacttgaagggagaatttccaggtgattatggatgggacactgctggtttatctgctgacccagaagcatttgccaagaacagggctcttgaggtgatccatgggcgttgggccatgcttggagcactgggctgcatcaccccagaggtgctagagaagtggttgagagtggacttcaaggagcctgtgtggttcaaagctggggcccagatattctcagaaggtgggcttgactatttgggcaacccaaaccttgtccatgcccaaagcatcttggcagtgctgggcttccaagttgttctgatgggccttgtcgaagggttccgcatcaatgggcttgatggagtaggagagggcaacaacctctaccctggaggccagtactttgacccactgggccttgctgatgacccaacaacttttgctgagctcaaagtgaaggagatcaagaatggaaggttggccatgttctccatgtttggattttttgttcaagccattgtaaccggcaaaggcccattagagaaccttttggaccaccttgacaacccagtggctaacaatgcttgggtctatgctaccaagtttgcccctggatcttaaatgtttatgattattgtcatttatatgtagattatgatcataaataataattgttggattagtgaactttttaaggattaagcctcatttgttaagctagttttgtttaaattattcaatgagaaaggtgttttttttaagagggaatgcaatgtttatatactctttctaacaatgatgacaagagct

SEQ ID NO: 2364 - DNA, 1181 bp, Vigna unguiculata
ggactcacttctgcaaaccactggttatcatatttttttccgtaacttgaggtttgaaaacctaggaagttggaagtgatggcagcaacattgatggcagcaacaagtggttctggcactgttcttaaaccaactcctttcctcggccaaggaaagggtgccaatgccaaccctcttagggatgctgtctcaatgggaaccgggaagtacaccatgagcaatgatctgtggtatggaccggacagagtgaaatacttgggaccgttttcggctcaaacaccttcatacttgaagggagaatttccaggtgattatggatgggacactgctggtttatctgctgacccagaagcatttgccaagaacagggctcttgaggtgatccatgggcgttgggccatgcttggagcactgggctgcatcaccccagaggtgctagagaagtggttgagagtggacttcaaggagcctgtgtggttcaaagctggggcccagatattctcagaaggtgggcttgactatttgggcaacccaaaccttgtccatgcccaaagcatcttggcagtgctgggcttccaagttgttctgatgggccttgtcgaagggttccgcatcaatgggcttgatggagtaggagagggcaacaacctctaccctggaggccagtactttgacccactgggccttgctgatgacccaacaacttttgctgagctcaaagtgaaggagatcaagaatggaaggttggccatgttctccatgtttggattttttgttcaagccattgtaaccggcaaaggcccattagagaaccttttggaccaccttgacaacccagtggctaacaatgcttgggtctatgctaccaagtttgcccctggatcttaaatgtttatgattattgtcatttatatgtagattatgatcataaataataattgttggattagtgaactttttaaggattaagcctcatttgttaagctagttttgtttaaattattcaatgagaaaggtgttttttttaagagggaatgcaatgtttatatactctttctaacaatgatgacaagagctaaaaggatgcattttttttttcctaatcataaaaaggtataaatatattttcatttttattttctttattgtaaatttagaatatgatttaaattttttatatt

SEQ ID NO: 2365 - DNA, 1203 bp, Cajanus cajan
ggggctccaaaccacatcatcagcaccaccaactcacactcttgcattgctaaccacaaatccctctgattctctttccctacatatgatgttacatgcaactcttctacatatttccataagccaattgttatcttattttttttgaagtaagttgaggtttgaaacctaggaagttggaagtgatggcaggaacattgatggcagctacaacaagctctggcactgttcttaagccaacccctttccttggccaaggcaagggtgccaatgccaaccctcttagggatgttgtctccatgggaactgggaaatacaccatggggaatgaattgtggtatggaccagacagagtgaagtacttgggacccttttcagctcagaccccttcatacttgaaaggagaatttccaggggattatggatgggacactgctggcttatctgctgacccagaagcatttgccaagaacagggctcttgaggtgatccatgggcgttgggccatgcttggagcactaggatgcatcaccccagaagtccttgagaagtgggtgagagtggacttcaaggagccagtgtggttcaaagctggagcccaaatattctcagaaggtgggcttgactacttggggaacccaaaccttgtccatgcacaaagcatcctggcggtgctgggcttccaagttgttctgatgggccttgttgaagggttccgcatcaatgggcttgatggagtgggagagggcaacaacctctaccctgggggccagtactttgacccactgggccttgctgatgaccctgccacttttgctgagctaaaagtcaaggagatcaagaatggaaggttggccatgttctctatgtttggtttctttgttcaggccattgtcaccggaaaaggcccattggagaatcttttggaccaccttgacaaccctgtggccaacaatgcttgggtctatgccactaagtttgtgcccggttcttaaatgtatccataatccatcccttgttgtgatttatgtgtagattatgatcataataattgtcggattagtgtacttcttaaggactaaggttcattttaaacctgggatatcccatgtttgttgatctagttttgtctaaagcaacctatgggaattttatgttaattctattaaccgaagaataagactcattaaatgagacaaaaat

SEQ ID NO: 2366 - DNA, 1195 bp, Cajanus cajan
gctccaaaccacatcatcagcaccaccaactcacactcttgcattgctaaccacaaatccctctgattctctttccctacatatgatgttacatgcaactcttctacatatttccataagccaattgttatcttattttttttgaagtaagttgaggtttgaaacctaggaagttggaagtgatggcaggaacattgatggcagctacaacaagctctggcactgttcttaagccaacccctttccttggccaaggcaagggtgccaatgccaaccctcttagggatgttgtctccatgggaactgggaaatacaccatggggaatgaattgtggtatggaccagacagagtgaagtacttgggacccttttcagctcagaccccttcatacttgaaaggagaatttccaggggattatggatgggacactgctggcttatctgctgacccagaagcatttgccaagaacagggctcttgaggtgatccatgggcgttgggccatgcttggagcactaggatgcatcaccccagaagtccttgagaagtgggtgagagtggacttcaaggagccagtgtggttcaaagctggagcccaaatattctcagaaggtgggcttgactacttggggaacccaaaccttgtccatgcacaaagcatcctggcggtgctgggcttccaagttgttctgatgggccttgttgaagggttccgcatcaatgggcttgatggagtgggagagggcaacaacctctaccctgggggccagtactttgacccactgggccttgctgatgaccctgccacttttgctgagctaaaagtcaaggagatcaagaatggaaggttggccatgttctctatgtttggtttctttgttcaggccattgtcaccggaaaaggcccattggagaatcttttggaccaccttgacaaccctgtggccaacaatgcttgggtctatgccactaagtttgtgcccggttcttaaatgtatccataatccatcccttgttgtgatttatgtgtagattatgatcataataattgtcggattagtgtacttcttaaggactaaggttcattttaaacctgggatatcccatgtttgttgatctagttttgtctaaagcaacctatgggaattttatgttaattctattaaccgaagaataagactcattaaatgagaca

SEQ ID NO: 2367 - DNA, 932 bp, Fagus grandifolia
ttccaattgagttttaactttcaactgaaagcttggaaggcatggcatcaatgctaatggcagcaactgctagctctagcactgttcttaagccaaccccatttcttggccaaaataggggaaccaatgccaactctcttagagatgttgtccctatgggaactgggaaatacaccatggggaatgatttgtggtatggaccagacagagtgaagtacttgggacccttttcagctcagactccatcgtaccttaaaggagaatttcctggtgattatggatgggacactgctgggttatcagctgacccagaagcctttgccaagaacagggcgcttgaggtgatccacggccgttgggctatgcttggagcattgggctgcatcaccccagaagtacttgagaaatatgttaacgtggactttaaagagccagtatggttcaaagctggagcccagatcttctcagaaggtggccttgactacttgggcaaccccaaccttgttcatgcccaaagcatcctagcagtgctgggcttccaagtcgtcctcatgggcctagttgaaggattccgtatcaatggccttcctggagttggagagggtaataacctctatccaggtggtcaatactttgaccctcttggccttgctgatgaccctgtcacatttgctgagctaaaggtcaaggagatcaagaatggccggctagccatgttctccatgtttggtttctttgtccaggctattgtcaccggcaagggcccagttggagaacctcttggaccatcttgacaaccctgttcgccaacaatgcatgggtctatgccaccaagtttgtgcccggatcttaaattgagctcattgttccatgagaatgaaaaacaattgaagtccatgtgtagttattgttctttttatacttcaaatttg

SEQ ID NO: 2368 - DNA, 1094 bp, Beta vulgaris
catatatatattgacttaattctagtcccttccacttcacaaccttccccattaaaattttgtgagcaacaaaaataacacatttactatatctagagattcaaccatggcatccatgctaagctcaggtactgtccttagaccaaccccttttctaggacaaggcaggggagctaatggaaacaccctcagagatgttgttcctgtgggatctgccaaattcaccatgggaaatgatctatggtatggaccagatagggtaaaatacttgggccctttttcagcacaaactccttcttacctaaacggtgaattccctggagattatggatgggacactgctggactatctgctgatcccgaggcttttgcacgaaacagggcccttgaggtcatacatggacgttgggctatgcttggagcactaggctgcataactccagaagtcctagaaaaatgggtaaaggttgacttcaaggagccagtttggttcaaggctggagcacaaattttctctgaaggtgggcttgactatctgggaaacccgaacctagtccatgctcaaagcattctagctgtgcttgggttccaagtgattctaatgggtctagttgagagcttccgtattaatggactcgacggggttggagagggcaacgacctctacccaggcggccaatatttcgacccgttgggcttagccgatgacccggttaccttcgcagagctcaaggtgaaggagataaaaaatggaaggctagctatgttttccatgtttggtttctttgtacaagctatagtgactggaaaaggtcccttggaaaacctcttagatcaccttgacaacccggtcgcaaacaatgcctgggtatatgccaccaagtttgtgcctggatcttaagttagtttgtatatgatctttaggtaaattctattaagatgttcaaagagatcaaatgtcttaatataagaacaatctgtagtgcacatatgggatttttgttttcttattttagaaaatttcaagagccaagaagaatgacaatgcttctttcaaatgatgacttgatcaagctattatccgtcaaatccaa

SEQ ID NO: 2369 - DNA, 906 bp, Centaurea maculosa
acacacacacacacaatggctgcaaccgctgctagctccaccaccgtggttcgagccaccccattcttgggtcaagccagatcaaacctcaacccccttagagatgttgtctccatccctaatgccaagttcaccatgtcaaatgatttgtggtatggaccggatcgtgttaagtacttgggacccttttcggctcagaccccatcttacttgaccggtgagtttcccggcgactacggttgggacaccgctggtttgtcggctgatcccgaggcttttgccaagaacagggctcttgaggtcatccatggacgatgggccatgcttggcgcattcgggtgcatcacccctgaggtccttgaaaagtgggtcaaagtggacttcaaggagccagtttggttcaaggctggagcccagatcttctcagaaggcggtctggactacctaggcaacccaaacctggttcatgctcagagcattctagccgtgctcggattccaagtggtcttgatgggcctcgttgagggtttcagaattaacggtcttgatggggttggagagggtaacaatttgtacccgggtgggcaatatttcgacccattgggattggctgatgacccagtaacatttgctgagttgaaggtgaaggagataaagaatggtagattggcaatgttctcaatgtttggattctttgtgcaagctatagttaccggaaaaggtccattggagaacctattggaccatttggacaaccctgtggctaacaatgcatgggtctatgctaccaagtttgtgcctggctcataagcctttaaaacctccttgtaatggagagttgggtgagattgtgagaatgtgtagattattaatataattcaattttatatggaaatttaatatggt

SEQ ID NO: 2370 - DNA, 1072 bp, Centaurea maculosa
  misc_feature (8)..(11): n is a, c, g, or t
  misc_feature (14)..(14): n is a, c, g, or t
  misc_feature (17)..(19): n is a, c, g, or t
  misc_feature (21)..(22): n is a, c, g, or t
  misc_feature (24)..(24): n is a, c, g, or t
  misc_feature (43)..(44): n is a, c, g, or t
  misc_feature (940)..(940): n is a, c, g, or t
tgaagctnnnngtnacnnntnncnccggtcccggattcaccgnnataaccacaaaacacacacacacacacacacaatggctgcaaccgctgctagctccaccaccgtggttcgagccaccccattcttgggtcaagccagatcaaacctcaacccccttagagatgttgtctccatccctaatgccaagttcaccatgtcaaatgatttgtggtatggaccggatcgtgttaagtacttgggacccttttcggctcagaccccatcttacttgaccggtgagtttcccggcgactacggttgggacaccgctggtttgtcggctgatcccgaggcttttgccaagaacagggctcttgaggtcatccatggacgatgggccatgcttggcgcattcgggtgcatcacccctgaggtccttgaaaagtgggtcaaagtggacttcaaggagccagtttggttcaaggctggagcccagatcttctcagaaggcggtctggactacctaggcaacccaaacctggttcatgctcagagcattctagccgtgctcggattccaagtggtcttgatgggcctcgttgagggtttcagaattaacggtcttgatggggttggagagggtaacaatttgtacccgggtgggcaatatttcgacccattgggattggctgatgacccagtaacatttgctgagttgaaggtgaaggagataaagaatggtagattggcaatgttctcaatgtttggattctttgtgcaagctatagttaccggaaaaggtccattggagaacctactggaccatttggacaaccctgtggctaacaatgcatgggtctatgctaccaagtttgtgcctggctcataagcctttaaaacctccttgtatggagagttgggtgagattgtgagaatgtgtagattattaatataattnaattttatatggaaaaacaaaaaaaaaaaaggcgccctataccagaggtcttatgtctataactaggactgccgctctctcgatggaacagcactggcacttggagacaccatctcgtgtgcgtagtgaatc

SEQ ID NO: 2371 - DNA, 931 bp, Cirsium arvense
gtccaactctacacacacaaaattagcatcaaatggctgcaaccgctgctagctccaccaccgtggttcgagccaccccattcttgggtcaaaccagatcgagtctgatcaaccccctaagagatgttgtctccatcccaaatgccaagtacaccatgggaaatgatttgtggtatggacctgatcgcgttaagtacttgggacccttttcggctcagacaccatcttacttgaccggcgaattcccaggagactacggttgggatacggctggtttgtcggctgatcccgaggctttcgccaagaacagggctcttgaggtcatccacggacgatgggccatgcttggcgcactcgggtgcattacccctgaggtcctcgaaaagtggctcaaagtggatttcaaggagccagtttggttcaaagctggagcccagatcttctcagaaggcggtctggactacctagggaacccaaacctagtccatgctcaaagcatcctagccgttctcggattccaagtgatcttaatgggcctcgttgaagggttcagaatcaacggtctcgatggggttggagacggcaacaacttgtatccgggcgggcaatatttcgacccgttgggactggctgatgacccagtgacatttgctgagctgaaggtgaaagagataaagaatggaagacttgcaatgttctcaatgtttgggttctttgtgcaagccatagttacaggaaaaggtcctttggagaaccttttggaccatttggacaaccctgtggctaacaatgcatgggtctatgccaccaagtttgtgcctggttcataaggctatggaacctggcttgtaattgagtgattggggagcatgtgtagattatttactataatttaattttatataaatcatatgatcgtttcaaaaaagaa

SEQ ID NO: 2372 - DNA, 1110 bp, Cucumis sativus
aatattcccccactttccccctctctcactcacacactactgcccattcctctattctttctcacaactcaaccacagaccttcaactacccatggccgccactgccgccaccgccaccctcctccgggccaccccttttctcggccaggccagagcctctcctcaaaaccccctcagagatgtcgtcgccatgggaactggaaaatacaccatgagtaatgatttgtggtatggacccgatagagttaagtacttggggccgttttcagctcagactccatcgtacttgaacggtgagttccctggtgattatggatgggacactgctggcttgtccgccgatcccgaggccttcgccaagaaccgagctcttgaggtaatccacggaaggtgggcaatgttgggcgctttgggttgcataacacccgaagtcttagaaaaatggcttaaagtggacttcaaggagccagtatggttcaaggcaggatcccaaatcttcacagaaggaggtctagactacttaggcaacccgaacttggtccacgcccaaagcattctagccgtgttggggttccaagtggtcctcatgggtctagtagaagggttccgcatcaacggccttgatggcgtcggcgagggcaatgacctgtacccaggcggtcaatactttgacccacttggactggctgatgaccctgtcaccttcgctgagctgaaggtgaaggagatcaagaatgggcgtcttgccatgttttccatgtttggattcttcgttcaagccattgtgaccggaaagggtcctcttgagaaccttcttgaccaccttgatgaccctgtggctaacaatgcttgggtttatgccaccaagtttgcccctggctcataagtatttcacattaattattgaaattgaacaagctaagtttgtttgttgtgtaaattgtttgtagttctctgggcgtttttttttggtgtgggtggatgtgattataattagatggatgagtattaaggtggatcaatggacattaattctcacttgatcaaatgactttaatgttcttaatcttagttattacatcatttaattagaggtagtcttgattgta

SEQ ID NO: 2373 - DNA, 871 bp, Flaveria ramosissima
tgaactttaaagctttgatcaatggcatccatggctgctaactccaccactgttgttagagccacccctttcttaggtcaaaccagaggctccaatgtcaatgcccttagagattctgtctccatggtcaatggcaagttcaccatgggaaatgacttgtggtatggaccggaccgagtgaagtacttgggacccttttcggcccagacaccatcatacttgactggtgaattccctggtgattatggttgggacaccgctggtttatctgctgatcccgaggcttttgccaagaaccgggctctcgaggtgatccacgggagatgggccatgttaggagcattcgggtgcatcacccccgaagtcctagaaaaatgggtcaaagtagatttcaaggagcccgtctggttcaaagccggagcccaaatcttctccgaaggcgggctagactatttgggcaacccgaacctagtccacgcccaaagcatactagcagtactcggtttccaagtggtcctaatgggccttgtcgaagggttccgcattaacgggctcgagggtgtaggagaaggtaacaacctctacccgggtggccagtattttgacccgttgggccttgcagatgacccggttactttcgccgagctaaaggtgaaggaaatcaagaatgggagactagcaatgttttcaatgtttgggttctttgtgcaagcaattgtgacaggaaaaggaccactggagaaccttttggaccatttggataaccctgtggctaacaatgcatgggtctatgctaccaagtttgttcctggttcataaattatgtggctttttaattgttcatgtaaattataagttggatgataaaatt

SEQ ID NO: 2374 - DNA, 866 bp, Flaveria ramosissima
aatcaccttgaactttgaagctttgatcaatggcatcaatggctgctaactccaccactgttgttagagccacacctttcttaggtcaaaccagaggctccaatgtcaatgcccttagagattctgtctccatggtcaatggcaagttcaccatgggaaatgacttgtggtatggaccggaccgagtgaagtacttgggacccttttcggcccaaacaccatcctacctgaccggtgaattccctggtgattatggttgggacaccgctggtttatctgctgatcccgaggcttttgccaagaaccgggctctcgaggtgatccacgggagatgggccatgttaggagcattcgggtgcatcacccccgaagtcctagaaaaatgggtgaaagtagatttcaaggagcccgtctggttcaaagccggagcccaaatcttctccgaaggcgggctagactatttgggcaacccgaacctagtccacgcccaaagcatactagcagtactcggtttccaagtggtcctaatgggcctcgtcgaagggttccgcattaacggcctcgagggtgtaggagaaggtaacaacctctacccgggtggccagtactttgacccgttgggccttgcggatgacccggtcactttcgccgagctaaaagtgaaggaaatcaagaatgggagactagcaatgttttcaatgtttgggttctttgtgcaagccattgtaacgggaaaaggaccattggagaaccttttggaccatttggataaccctgtggctaacaatgcatgggtctatgccaccaagtttgtccctggttcataaattatgtggctttttaattgttattgtaaattataagtt

SEQ ID NO: 2375 - DNA, 887 bp, Flaveria ramosissima
ttgaagtctttaatcaatggcatcatcaatggctgctaactccaccactgttgttagagccacccctttcttaggtcaaaccagaggctccaatgtcaacgcccttagagattctgtctccatggtcaatggcaaatacaccatgggaaatgacttgtggtatggaccggaccgagtgaagtacttgggacccttttcggcccagacaccatcatacttgacgggtgaattccccggtgattatggttgggataccgctggtttatctgctgatcccgaggcttttgctaagaaccgggctcttgaggtgatccacgggagatgggccatgttaggagcattcgggtgcatcactcccgaagtcctagaaaaatgggtgaaagtagatttcaaggagccagtctggttcaaagccggagcccaaatcttctccgaaggcgggctggattatttgggcaacccgaacctggtccacgcccaaagcatactagcagtactcggtttccaagtggtcctaatgggcctcgtcgaagggttccgcattaacgggctcgagggtgtaggtgaaggtaacaacctctacccgggtggccagtactttgacccgttgggccttgcggatgacccggtcactttcgccgagctaaaagttaaggaaatcaagaatgggagactagcaatgttttcaatgtttgggttctttgtgcaagcaattgtaacaggaaaaggaccattggagaaccttttggaccatttggataaccctgtggctaacaatgcatgggtctatgccactaagtttgtccctggttcataagttatgtaactttttaattgttattgtaaattataagttggatgataaaattgaataaaaaatattgtta

SEQ ID NO: 2376 - DNA, 1294 bp, Fraxinus spp
aaatggcatcaatggctgcggctgccagttctaccactgttgttagggcaactccattcttgggccaaaccaagaattccaaccctcttaaagatgtcgtctctgtgggaaatgggaaatacaccatgggtaatgaattgtggtatggaccggaccgtgtcaagtacttggggccgttctcggctcaaactccatcgtacttgaccggagaattccctggtgattatggttgggacactgctggattatctgctgatcctgaggcatttgcaaggaacagggctcttgaggttattcacgggagatgggcaatgcttggagctttgggatgcatcaccccggaagttcttgagaaatgggttaaagtggatttcaaagagccagtttggttcaaggctggagctcaaatcttctctgaaggtggactagactacttgggcaatcccaatcttgtacatgcacagagcattttggcagttcttggatttcaagttgttctcatgggactcgttgaaggatttagaatcaacggtttagacggcgttggtgagggcaacgacctgtaccccggtggacaatactttgatcctcttggccttgctgatgaccctgtgacttttgctgagctcaaggtgaaggaaatcaagaatggaaggctagccatgttctccatgttcggattctttgttcaggctattgtcactggaaaaggccctctggagaatctgttggaccatctcgataaccctgttgctaacaatgcctgggtttatgccacaaaattcgtgccaggatcataaacccagtttcatttgttcaatctagtaccacaaaacgaagagaacgcatgatttgtaaatttgcactgatttggtcgaatgattggagaacagagaactcatgtactagttgcattcaacaaatagtgatatgtacgtttctttatatctccaccctaactacaacattcaattgagtaatgaattacatcattgacacatgctatatactataagctcatgctgaactcgggcagggatgactagcagtaaatcaacacaatcccttagctgatgagttggctaatttgatgataagatcgatacatatacacaactatcctactctctaccaaattgattctgctgcaaaccgctaacgagaaaatacgcactcctagaaacaaataagacgtttgacggcacgatcaatactaaaaaaataatacaaaaatgactaaagtatgttttgcttacttctttccccccactactgttagtcgtatttttcccgg

SEQ ID NO: 2377 - DNA, 1046 bp, Humulus lupulus
ttttggctcagacttctcaagaagacaacttcaaccgagaaccaacctcagaaatgctaatggcaacaaccgctagctcaagctcattacttagaccaaccccatttcttggtcaaaacaggggaacaagctccaatggcttgagagatgttgttcctatgggaactggcaaatacaccatgggaaatgatttgtggtatggaccagacagagtgaagtacttgggacccttttcagctcaaactccatcttacttgactggagaattccctggtgattatggttgggacactgctggtttgtctgctgatcctgaggcctttgccaagaacagggctcttgaggtgatccacggtagatgggcaatgcttggagctttggggtgcataaccccagaagttttggagaaatgggtgaaagtggacttcaaggagccagtttggttcaaggccggagcccaaatcttctcagaaggtggattggactacttgggcaaccccaacttggtccatgcccaaagcatcctagcagtgctgggcttccaagtcattctaatgggtctggttgaagggttccgtatcaatgggcttgatggagttggagagggcaatgatttgtacccaggtgggcagtactttgatccattgggcctggctgatgacccagttacctttgctgagctcaaggtgaaggagatcaagaacggtagacttgctatgttctccatgtttgggttctttgttcaagccattgttactggaaagggaccacttgagaacctacttgatcaccttgacaacccagttgctaacaatgcttgggtctatgccacaaagtttgttcctgggtcgtaaattgagtagtgatcttgttctttaaaatgttttaattatatttgatgttatgactcatgagatgaagtaaattgtggtactattgtaaaggaaacattctatgtagattaatatcactactacttgccgtgttcttggcctaaaattgtttgtaattttatcagtttgatgatatccaacgtaactcggaaa

SEQ ID NO: 2378 - DNA, 1041 bp, Carica papaya
gttcacttcttcatttcagcaaatttatatacactcctcatttcttcttcacacaattccaggccgttcaagaagaaagaatacccagtttcccaattaactaagatctgagaagaaaatggcatcaatggcggcaactgcaagttcgagaactgttttaagcccaaccccttttcttggccagactaaagggtcaagctctaaccctttaagagatgctgtctctttgggaactgggaaattcaccatgggaaatgagctgtggtatggaccggacagagtaaagtacttgggacccttttcggctcagactccatcttacctgactggagagtttccaggggattacggatgggatactgctggtttatcagctgaccctgaggcttttgctaggaacagggctcttgaggtgattcatggtaggtgggcaatgcttggagcattaggctgcatcaccccggaagtcttagagaaatgggtaaaagtagacttcaaggaaccagtgtggttcaaggctggcgcacagattttctcagaaggtggtttggactacttgggcaatcccaaccttgtccatgcccaaagcatcctggcggtcttgggcttccaagtcattctcatgggtctcgtcgaaggtttccgcatcaatggcctgccaggagtcggagagggcaatgacctttaccccggtggccaatacttcgaccctcttggccttgcagatgatccagttacatttgccgagctcaaggtaaaggaaattaagaatggcaggctggcaatgttctccatgttcggattctttgttcaagccattgttaccggcaaaggaccacttgagaacctcctggatcaccttgacaaccctgttgccaacaatgcttgggtctatgccaccaagtttgttcctggatcatagactgatttctcaaaatcttgtttcatgtgtgcagattgaaattgttgtatgctgtagattttagtaaaacaagcaccctgattaagatctaatgtaacttgtgacttggtgttttatgg

SEQ ID NO: 2379 - DNA, 1308 bp, Tripterygium wilfordii
actgcctattaataaaatttctcctctttgatagctcaatctaagcttcaagtgaaataactgaagaggggaaaaagcttgtttgagaggaatggcatcaatgctaagtgctagcaccagcactgtcctcaggacaaccccatttcttggacagggcaggacctcatttgccaaccctcttagagatgttgtctctatgggcactccaaagtacaccatggggaatgacttatggtatggaccagacagagtgaagtacttaggaccattttcagctcaaactccttcatacttgactggagagttccctggtgactatggatgggatactgctggtttatctgctgacccagaggcttttgccaagaacagagcccttgaggtgatccatgggcgatgggctatgcttggagcactaggctgcattaccccagaagtacttgaaaaatgggttagtgtggatttcaaagagccagtgtggttcaaagctggagctcaaatcttctctgaaggtggcctggactacttaggcaatcccaaccttgttcatgctcaaagcatcttggcagttctgggattccaagttgttctcatgggacttgttgagggattccgcatcaacggcctccctggcgtcggagagggtaacgacctctaccctggcggccagtacttcgaccctctcggcctagccgacgatcctgttacgtttgctgagctcaaggtgaaggaaatcaagaatggcaggctagctatgttctccatgtttggtttctttgttcaagctattgtcactggaaaaggtcccctggaaaacctcttggaccatcttgacaaccctgttgctaacaatgcttgggtctatgccaccaagtttgtacctggatcataaactacctctctaggctatctatttgtggattgtgtgaatgtaccaagagtggaaagcttccatggattgttacttacagcttctgtacctgtagaactgtgcatcatttagagctaatgcaaatgttggctcattgccagcctttgatcaaaaaaaattgaagtggcaattctctttgaaggtttagcacgatggttaagtaactgtttgaatatgctgcactgggcttcagctcagaacttagagtggagttcgatgagcaatactttcactagttcgatgaacaatagtgaagcaatactttcactaggttcctcgtcacaaaaaaaaaaaaaaaaaaaaaaattagttctagtgctctccttttaacttataggaagtattagtatcaattcaccacctacagcaataaaaag

SEQ ID NO: 2380 - DNA, 1044 bp, Vaccinium corymbosum
cacaacattttcagtactgctctgtcaaaaaacctaacttctgagctttgggaaaaagcatggcatcaatgttcatggcagctacttccagtactagcactgcactcaggccaaccccttttctgggtcaaaccaggggagcaaatgctaaccctccaagatttattgttatggcctcgaggaatgatttgtggtacggaccagaccgagtgaagtacttgggacccttttcagctcagaccccatcgtacctgactggagaattccccggtgactatggatgggacactgctggtttatctgctgatcctgaggcttttgcccggaacagggctcttgaggtcatccacgggcgatgggcgatgctgggagcactgggctgcattaccccagaagttcttgagaaatgggtcaaagtggacttcaaagagccaatttggttcaaagccggagcgcaaatcttctcagaaggcggtctagactacttgggcaaccccaatcttgtccacgcccaaagcattctggcagtgctcggcttccaagtcgttctaatgggccttgttgagggattccgcattaacggacttccgggtgtaggagagggaaacaacctctacccaggcgggcagtacttcgacccattgggtcttgctgacgacccagtcaccttcgctgagcttaaggtgaaggaaatcaagaatggaagactagctatgttctccatgtttgggttctttgtccaggccatcgtcaccgggaaaggcccacttgagaacctcttggaccaccttgacaaccctgtggctaacaatgcatgggtttatgccaccaagtttgtgcctggatcataaactcttgttgcaactttaaatgaccttgtgtggtgtttgttggaaatgaggtggtgtagatttgtgtaaattgtttgtagtttccactttattcgatctgaaaattttcaaacggcttatgttgtgcaattatgaagtctgattcagaccatttggtactgctgtgcttctggtttggatatggaggaagtaa

SEQ ID NO: 2381 - DNA, 1036 bp, Catharanthus roseus
tagtggatccaaagaattcggcacgagggtaaattaatcacctacccgtaagatcaagatcaagaagaagaagaagaagaagaaagaatggcatcaatggcagctacagccaccagctccaccactgttgttagagcaactcctttcttgggccaaaccaaaactgctaaccctcttagagatgttgtttccatgggaaatcccaagttcaccatgggaaatgaactatggtatggacctgaccgagtgaaatacttgggacccttttcagctcaaactccatcctacttgacaggagagtttccaggtgattatggatgggatactgccggtttgtctgctgatcctgaggcctttgccaggaacagggctcttgaggtaatccatgggagatgggcaatgcttggagcacttggatgcataaccccagaagttcttgaaaagtgggttaaagtagacttcaaagaaccagtttggttcaaagcaggagcacaaatcttctcagaaggaggacttgactatttggggaacccaaaccttgttcatgcacaaagcattttagcagtcctaggtttccaagttgttctaatgggacttgttgaaggattcagaattaatggtcttcctggagttggagaaggaaataatctttacccaggtggacaatactttgatcctcttggattagctgatgatcctgttacttttgctgaacttaaggttaaggaaatcaagaatggaagattagccatgttttccatgtttggattctttgtccaagctattgtcactggcaaaggtcctcttgagaatcttcttgatcatctggataaccctgttgctaacaatgcctgggtttatgccacaaagtttgttcctggatcataaacttcactttaattcattcattcttgtaatctgtctgtgaatgaaatactttttcatcttctgctcattattaagcaaaaatgtcactttctttttaagaaagagctctgaagcttataaaactgaaatgggtaataagtaaaaaaaa

SEQ ID NO: 2382 - DNA, 1064 bp, Arachis hypogaea
acacctatatgattctctctctcgctacatatcatgttacacactacacattaaagcaattaagaaatcttgcaagaaatcatggcatcaacattgtctagcactgttgtgaagccaacacctttccttggacaaggaaggggaaccaacaacaacactctgagagatgttgtctccatgggaactgggaaatacaccatggggaatgaattgtggtatgggccagatagagtgaaatacttgggacccttttctgctcaaacaccttcatatttgactggagagttccctggagattatggttgggacactgctggtttatctgctgaccctgaagcttttgccaggaatagggctcttgaggtgatccatgggcgttgggctatgcttggagcattaggttgcatcaccccagaaattcttgagaagtgggtcagagttgacttcaaggagcctgtttggttcaaagctggggcccaaatcttctcagaaggtgggcttgactaccttggaaacccaaaccttgttcatgcacaaagcatccttgcagtcctgggcttccaagtagtcctaatgggccttgttgaagggttccgcattaatgggcttcctggtgttggagaagggaacaacctctatcctggtgggcagtactttgacccattgggccttgccgatgacccagttacttttgctgagctcaaggtcaaggagatcaagaatggaaggcttgccatgttttccatgtttgggttctttgttcaggccattgtaactggtaaaggcccattggagaaccttttggaccaccttgacaaccctgtggctaacaatgcttgggtttatgccaccaagtttgtgcctggttcttagaacaagataacaccttttctttttccttcttttctttaaccctcgcactttgcttttattgtgaataaagagacgatgatttatatgtaggttgttatcattaaagttgtggattagtagtgttagtgcacttattgtttttacttattaaggactactaaggcttttgtcaatcaaggggattttcatgg

SEQ ID NO: 2383 - DNA, 1073 bp, Vigna unguiculata
ggagctgaagaaaaaagtactcggaagccatggcagcaacattaatggcagcctcagcaagcaccggcactgtccttaaaccaacacctttccttggccaaagtagagcaaccaatgccaaccctcttagagattttgtctccatgggacatgggaaatacaccatgggaaatgaactgtggtatggaccagacagagtgaaatacttgggacccttttcagctcagactccttcatatttgacaggagaattcccaggggactatggatgggacactgctggattgtctgctgatcctgaagcatttgccaagaacagggctcttgaggtgatccatgggcgttgggccatgcttggagcactaggatgcatcactccagaagtgcttgagaagtgggtgagagtggatttcaaggagccagtttggttcaaagcaggagcacaaatattctcagaaggaggcctagactatctggggaaccctaaccttgtgcatgcacagagcattttggcagtgctagggttccaagttgtgctgatgggtcttgttgaagggtttcgcatcaatgggcttcctggtgtgggagagggcaatgatctgtaccctggtggccaatactttgaccctcttggacttgctgatgatcctgtggcttttgctgagcttaaggttaaggagataaagaatggaaggttggccatgttctccatgtttgggttctttgtgcaagccattgtcactgggaaaggacctcttgagaaccttttggatcaccttgacaaccctgtggctaacaatgcttgggtctatgccaccaagtttgtgcctggctcttagattgctttttcctttgtttggttttatatgaatgacatgatgtggaagtttccttgtagattagtacactttttatggttcattttttaacccttttgttcattcatttgaataaatgaatgagatgacacatcgatcttaaatcaacatagaaagtgattttttataatctgtaacaaacttggaattggaaaaaagaatgccaaagtgcatctgcatcagctagttttgaac

SEQ ID NO: 2384 - DNA, 1228 bp, Malus domestica
ataaaatgtggatagaaagatatgagttggagatgcatgaaaatcctttggagccttctcattggttgattcaaaccctcataatccccatcaatacttcccactcctgcattctgaaccacccatctgtgcataatattgcacacacagctaccccttctacacacttccaagcttcaacacaattccacggattacttcatcacaaaacaaatcaagtcaactgaattaagttgcgaaagcttggaaagtcatggcagcagctgctagctcgagcactcttctaagaacaaccccatttcttggccaaagccgaggaccaagcttcaacactcttaaggatgttgtgccaatgggaactggcaaatacaccatgggcaatgatttgtggtatggaccggacagagtgaagtatttgggacccttttctgctcagactccttcgtacctgaacggagaattccccggtgattacggatgggacaccgcagggttgtcagctgaccccgaggcctttgctaagaacagggctcttgaggtgatccatggccggtgggctatgcttggagcactaggctgcatcaccccagaagttctcgagaaatgggtgagagtggacttcaaagagccagtgtggttcaaagcaggagctcaaatcttctccgaaggcggcctcgactatttgggtaaccccaacttagtccatgctcagagcatcctagcggtgcttgggttccaagtcatcctcatgggtctcgttgaaggattccgcatcaatggtcttgatggtgtcggagagggcaacaacctctacccgggtgggcaatacttcgaccctctcggccttgccgatgaccccgtcaccttcgccgagctcaaggtgaaggaaatcaagaatgggaggctagccatgttctccatgtttgggttctttgtccaagccattgtgaccgggaagggtcccctagagaacctcttggaccaccttgacaaccctgtagccaacaatgcatgggtctatgccaccaagtttgtgcccggatcataaattaatctgcagttcctctaattagtaattgttaatcttgtttgagagaatgtaattgaatgggaaattacatgtcaatgttaatactcgccattttaattgatcagatttttcaaatttcactttgtgtatcaattctataacagtaaatccaatcttcttagttctttcatttcagaa

SEQ ID NO: 2385 - DNA, 1478 bp, Vitis vinifera
acaatccacataccataacagttgggatttcttagactaatgaatccaaaaaatgcttaaattttcacccaagaagttaatttttttttcagtcaattgaggaaagttatccgtgggtgatttttcatttttccaatctgtgggacaaaagataaaatgtggatagaaggatatgggtatgagatacatagaatccttaaaagccatctgattggttggttcaaacctcagaatccccaccacaatttcccactcttgcattcctaaccacccatctctgattcttggttcctccacattcacatatacactcggcttcccttgtacacactttctcttcagaaaaacacagctccaacacagaaaggaaaagggagaaaggaagtggaggcagcaatgttgatggcagcaacagcaagctccagcactgtcctcagaccaaccccatttctgggccaaaccaggggagcaaactctaaccctcttagagatgttgtccctatgggaactgggaaatacaccatggggaatgagctgtggtatggacctgacagagtgaagtatttgggacccttctcagctcagactccctcatacctgactggagaatttccaggagactatggatgggacaccgctggattgtctgctgatcctgaggcctttgccaggaacagggctcttgaggtgatccacgggcgttgggctatgcttggagcactgggctgcatcaccccagaagtccttgagaagtggcttggagtggacttcaaagaaccaatctggttcaaagctggagctcaaatcttctccgagggcggcctggactacttgggcaaccccaaccttgttcatgcccagagcattctggcagtcctcggcttccaagttgtcctcatgggtcttgttgagggcttccgcattaatggccttcctggagttggagatggcaacaacctgtaccctggtggacaatacttcgatcctcttggcctcgctgatgacccggtcacatttgctgagctcaaggtcaaggaaatcaagaatggacggctagccatgttctccatgtttggcttctttgtccaagctattgtgaccggaaaaggcccccttgagaacctcttggaccaccttgacaacccagttgctaataacgcatgggtctacgccaccaagtttgtgcctggatcttagactgctggtctttgcttcttcacctgttttgtgtaaactcattgagaacagaacattctgtgttagtagattcaatgtaatttataatttatgtttcagatggaacactgcattttccggtaaatgaaataactctcaaactcttgtaagtcctgctgtttcgacattcaggaccctcaggtgtctggaatgtggtgtgaactcctgcaagagagaacaataatgttgtcaggatctcataaattgaattcaaccagcatggagggtcatcgctattcaaa

SEQ ID NO: 2386 - DNA, 921 bp, Ipomoea nil
agttatttaacagaaaactagtcccaactctaagcttgagagagagaaaccaagaatggcatccatggcagctgctgctagctccaccactgttgtgagagccaccccattcttgggtcagaccaagaatgctaatcctcttagagatgctgttcccatgggacctgctaaatttaccatgggaaatgatttgtggtatgggcctgaccgtgttaagtacttgggacccttttctgctcaaactccttcatacttgactggagagttccctggtgattatggatgggacactgctggtttgtctgctgatcctgaggctttcgccaaaaacagggctcttgaggtgatccatggaaggtgggcaatgcttggagcactgggatgcataaccccagaagttcttgaaaaatggttgaatgtggacttcaaggagccagtgtggttcaaagcaggagcccagatcttctcagaaggagggctggactacttgggcaacccaaaccttgtccatgcacagagcatcttggcagtgctggggttccaagttgttctcatggggcttgttgaagggttcagaatcaatggcctccctggagttggagagggcaatgacctctaccctggtggccaatactttgatcctctcggcctagccgacgaccccgtcacctttgctgagctcaaggtcaaggaaatcaagaatggcagactagccatgttctccatgtttggattctttgtccaagccattgttactggcaaaggccctctcgagaacctcttggaccaccttgacaaccctgttgctaacaatgcctgggtttatgccaccaagtttgtccctggatcataaatttccctgcattcatctcttgttcatccaaaccccaatgtatgatgaaaaaaaaaacgaaaatttct

SEQ ID NO: 2387 - DNA, 1166 bp, Medicago truncatula
ttgaaaccacatgatttcaaccaccaatttccacatatttttccaaccacacatccctttgattttctttccctacataaactgttattctcagcctctctttccacacatttctagtatcagttatttgagtgaactaaggtttcaacttggaacaaaccatggcattgatggcagcaagctcagcagctgttgttaaacaaactcctttccttggtcaaaggaagggtgctgccaaccctcttagagatgttgtcgccatgggaacctcaagattcaccatgggaaatgaattgtggtatggaccagacagagtgaaatatttgggaccattttcagctcagactccttcatacttaactggagaattccctggtgattatggatgggacactgctggtttatctgctgatccagaagcatttgccaagaacagggctcttgaggtgatccatggaagatgggctatgctaggagcactaggatgcatcacaccagaagtacttgaaaaatgggtaagagttgacttcaaagaaccagtttggttcaaagcaggatcacaaatcttctcggaaggtggtcttgactatttagggaacccaaaccttgttcatgcacaaagcatcttagcagtactaggtttccaagttgttctaatgggtcttgttgaaggctttcgcatcaacggtcttcctggtgtcggagagggcaacaacctctaccctggtggccaatactttgaccctcttggtctagccgacgatccagttactttcgccgagcttaaagtgaaggaaatcaaaaatggaagattggctatgttttcaatgtttggtttctttgttcaagctattgttactggtaaaggacctttggagaatcttttggatcacattgataaccctgttgccaataatgcttgggtttatgccaccaagtttgtgcccggttcttaaacatcaatgttatctatgattgcctttgtgtggatgatgatcagacatggcatttatgtgtaaattatgatcttaattattattggattagtgtatctgtttttggttcttaaggactaatgttcattttaaagctggaagatctcacgttgatatgttttgttcaaactaaaaaagaattaatgttaatgcaatttgtttaaaccaact

SEQ ID NO: 2388 - DNA, 1073 bp, Cucumis melo
cccacttccactctctctcacacaatctccaacactactgcccattcctctgttctttctctctactctcaaccacagagcttcaagtacccatggcctccaccgccacctccgccaccctcctccgggccaccccttttctcggccagaccagaggctctcctcaaaaccccctcagagatttcgtcgccatgggaactggaaaatacaccatgggaaatgatttgtggtatggacccgacagagttaagtacttggggccgttttcagcccagactccatcgtacttgaacggtgagttccctggtgattatggatgggacactgctggcttgtccgccgatcccgaggccttcgctaaaaaccgagctcttgaggtaatccacgggaggtgggcgatgttgggtgcattgggttgcataacacccgaagtcttagaaaagtggcttaaagtggacttcaaggagccagtatggttcaaggcaggagcccaaatcttcacagaaggaggtctagactacctaggcaaccccaacttggtccacgcccaaagcattctagccgtgttggggttccaagtcgtcctcatgggtctagtagaagggttccgcatcaacggtctcgatggcgtcggcgagggcaacgacctctacccaggcggtcaatactttgacccactcggactggctgatgaccctgtcaccttcgcggagctcaaggtgaaggagatcaagaatggacgtcttgccatgttttctatgtttggattcttcgttcaagcgattgtgacaggaaagggtcctcttgagaaccttcttgaccaccttgataacccagtggctaacaatgcttgggtttatgccaccaagtttgcccctggctcataagtatatcacggtaattactgaaattgaacaagtttgtttgtttgttgtgtaaattgtttgtagttctctgggtgttctttttggtgtggatggatgtgattataattagatggctgagtattaaagtggatcaatggaaatcaattctcacttgatcaaatgacttcaatgttcttcatcatttaa

SEQ ID NO: 2389 - DNA, 936 bp, Olea europaea
attacagagaagttcacagctctaaacttgaaaaagaaatgtcatcaatggctgccactgccagttctagcactgttgttagggcaactccattcttgggccaaacgaaaaatgtcaaccctcttaaagatgttgtctctatgggaaatggaaaatacaccatgggtaatgaattatggtatggaccggaccgcgtcaagtacttggggccgttctcagctcaaactccatcgtacttgaccggagaattccccggtgattatggttgggacactgctggattatctgctgatcctgaggcatttgcaaggaacagggcccttgaggttattcacgggagatgggcaatgcttggagctctgggatgcatcaccccagaagttcttgagaaatgggttaaagtggatttcaaagagccagtgtggttcaaggctggagctcaaatcttctctgaaggtggactagactacttgggcaatccaaatcttgtacatgcacagagcattttggcagttcttggattccaagttgttctcatgggactcgttgaaggattcagaatcaacggtttagaaggtgtcggcgagggcaatgacctttaccccggtggccaatacttcgaccctcttggccttgctgatgaccctgtgacttttgctgagctcaaggtgaaggaaatcaagaatggaaggctagccatgttctccatgttcggattctttgttcaggctattgtcactggaaaaggccctctggagaatctgttggaccatctcgataaccctgttgctaacaatgcctgggtttatgccaccaagttcgtgccaggatcataaacccagtttcatttgttcgttctagtaccacaaaatgaaaagaatgcatgattggtgtaattttgtcctgaattgcacaaatgattggaaaaacggactc

SEQ ID NO: 2390 - DNA, 981 bp, Tragopogon dubius
ttgaagcttccatcaatggcgtccatggctgcaactactgctagctccaccaccgtgatccgatcctcttctttcctgggtcaaaccaaagggtccaatgccaacacccttagagtttctgtctccatggccaatggcggcaaatacaccatgggaaatgacttgtggtatggaccagaccgtgtaaagtacttgggacccttttccgctcaaacgccatcatacttgaccggagaattccccggcgactatggctgggacaccgccggtttgtcagctgatcccgaagcttttgctaaaaaccgagctcttgaagtaatccacggccgatgggcaatgctcggagcactgggatgcattacaccggaagttcttgaaaaatgggtgaaagtagacttcaaagaacccgtctggttcaaagccggagctcaaatcttctcggaaggtggactagactacctcggaaaccctaacctagtccatgctcaaagcatattagccgtactcggttttcaagtaatcttaatgggtttagtcgaaggttttcgtatcaatggacttgatggcgtcggagatggtaacaatctttatcccggcggtcagtattttgacccgttgggacttgctgatgatccggtgacatttgctgagttgaaagtgaaggaaatcaagaatggtagattagcgatgttttcgatgtttgggttttttgtgcaagcgattgtgacagggaaaggaccattggagaacctcttggaccatttggataaccctgtggctaacaatgcatgggtctatgccaccaagtttgtgcctggttcataaaatttgtggcttcttgtcttgtggatttttcttggaaactatgagtttaatgaagagaatgtgtaaattattactgtgaaatgaactaaagatgcaatccatgttgaacccattgattctaatgaaaagtgaaaatccctcaaatgttttgctaac

SEQ ID NO: 2391 - DNA, 1046 bp, Trigonella foenum-graecum
caaccaccaatttccacatgtgtttctaaccacaaatccctctgatttctttccctacatatgcagttttgagtgaactaaggtttcaactcaagaagaagaagcacttggaacaaaacatggcattgatggctgctacagcaagctcagcaactgttgttaaacaaactcctttccttggtcaaaggaagggtgctgccaatcctcttagagatgttgtcgccatgggaacttcaaaattcaccatgggaaatgaattgtggtacggaccagatagagtgaaatatttgggaccattttcagctcaaactccttcatacttaactggagaattccctggtgattatggatgggacactgctggtttatctgctgatccagaagcatttgccaagaacagggctcttgaggtgatccatggaagatgggctatgctaggagcactaggatgcattacaccagaagtacttgaaaaatgggtaagagttgacttcaaagaaccagtttggttcaaagcaggatcacaaatcttctcagaaggtggacttgactatttaggaaacccaaaccttgttcatgcacaaagcatcttagcagtactaggtttccaagttgttttgatgggacttgtcgaagggttccgcatcaacggtcttcccggtgtcggagagggcaataacctttaccctggtggccaatactttgatcctcttggtcttgccgatgatccagttactttcgccgaacttaaagtgaaggaaattaagaatggaagattggctatgttttcaatgtttggtttctttgttcaagctattgttactggtaaaggacctttggagaatcttttggatcacattgataaccctgttgctaataatgcttgggtttatgccaccaagtttgtccccggttcttaaacattaatgttatctatgattgcctgtgtgtggatgatgctgagacatggcatttatgtgtaaattatgatcttaattattattggattagtgtatctgtttttggttcttaaggactaaggttca

SEQ ID NO: 2392 - DNA, 1077 bp, Vaccinium corymbosum
aaaaaacctcacttctgagctttgggaaaaagcatggcatcaatgttcatggcagctacttctagcactagcactgcactcaggccaaccccttttctgggtcaaaccaggggagcaaatgctaaccctccaagatttattgttatggcctcgaggaatgatttgtggtacggaccagaccgagtgaagtacttgggacccttttcagctcagaccccatcgtacctgaccggagaattccccggtgactatggatgggacactgctggtttatctgctgatcctgaggcttttgcccggaacagggctcttgaggtcatccacgggcgatgggcgatgctgggagcactgggctgcattaccccagaagttcttgagaaatgggtcaaagtggacttcaaagagccaatttggttcaaagccggagcgcaaatcttctcagaaggcggcctagactacttgggcaaccccaatcttgtccacgcccaaagcattctggcagtgctcggcttccaagtcgttctaatgggccttgttgaggggttccgcattaacggacttccgggtgtaggagagggaaacaacctctacccaggcgggcagtacttcgacccgttgggtcttgctgacgacccagccacctttgctgagctcaaggtgaaggaaatcaagaatggaagactagctatgttctccatgtttgggttctttgtccaggccatcgtcaccggtaaaggcccacttgagaacctcttggaccaccttgacaaccctgtggctaacaatgcatgggtttatgccaccaagtttgtgcctggatcataaactcttgttgcaactttaaatgaccttgtgtggtgtttgttggaaatgaggtggtgtagatttgtgtaaattgtttgtagtttccactttattcgatccgaaaggtttcaaacggcttatgttgtgcaattatgaagtctgattcagaccatttggtactgctgtgcttctggtttggatatggaggaagtatgggcattttgaaactgactcggagagtttcccaaatgataaaatcaaataaaatcaaca

SEQ ID NO: 2393 - DNA, 1333 bp, Cannabis sativa
taatctctctcttttagtttccgcacataatatttactcacagcttctcctcttcttcatattggtacaaaattctcaagaagacaagttcaaaaactgtgaaccaaaacccaagaaatgctaatggcagccaccggtagctcaagcacattactaagacccaccccatttcttggtcaaaacagaggaccaagctccaatgccttgaaagatgttgtcccaatgggaactggcaaatacaccatgggaaatgatttgtggtatggaccagacagagtgaagtacttgggacccttttcagctcaaactccatcttacttgacaggagaattccctggtgattatggttgggacactgctggtttgtctgccgatcctgaggcctttgccaagaacagggctcttgaggtgatccacggtagatgggcaatgcttggagctttggggtgcataaccccagaagtattggagaaatgggtgaaagtggactttaaggagccagtttggttcaaggctggagcccaaatcttctcagaaggtggcttagattacttgggcaaccccaacttggtccatgcccaaagtatcctagcagtgctgggattccaagtgatcctaatgggcctcgttgaagggttccgtattaatgggcttgatggagttggagagggcaatgacttgtacccaggtggacaatactttgacccattgggcctagctgatgacccagttacctttgctgagctcaaggttaaggagatcaagaatggtagacttgctatgttctccatgtttgggttctttgttcaagctattgttactggaaagggaccacttgagaacttacttgaccaccttgacaaccctgttgctaacaatgcttgggtctatgccacaaagtttgttcctggatcgtagagtagtaattttcttctttaaaatgttttaataatattttgatgttatgacaagtgagatgaagtgaaatgaattgtagtattattgtaaagaaaatattctatgtagattaatattactatttgccgtgttcttggtctataattgtttgtagttttatcagtttgttcatgatatgatatccaacgtaacttggaaattattcttagttgtgtttttgtgattttctaatttctctttgtacttaggtaaataacgtaaaagtagtaattaatattttttggaagtttggttaaaatatataacccatcaacaaaattttgaaaaattcaaaataatttaaaatatagaaagtaagtgttcaaatagtctatttcacacgcatatgaaataaaatagtcacgtgtgtaataca

SEQ ID NO: 2394 - DNA, 1263 bp, Cannabis sativa
tcatctattcttgaccactaatctctctcttttagtttccgcacataatatttactcacaccagagcttctcctcttggtataaaattctcaagaagacaattcaaaaactgtgaaccaaaacccaagaaatgctaatggcagccaccggtagctcaagcacattactaagacccaccccatttcttggtcaaaacagaggaccaagctccaatgccttgaaagatgttgtcccaatgggaactggcaaatacaccatgggaaatgatttgtggtatggaccagacagagtgaagtacttgggacccttttcagctcaaactccatcttacttgacaggagaatttcctggtgattatggttgggacactgctggtttgtctgccgatcctgaggcctttgccaagaacagggctcttgaggtgatccacggtagatgggcaatgcttggagctttggggtgcataaccccagaagtattggagaaatgggtgaaagtggactttaaggagccagtttggttcaaggctggagcccaaatcttctcagaaggtggcttagattacttgggcaaccccaacttggtccatgcccaaagtatcctagcagtgctgggattccaagtgatcctaatgggcctcgttgaagggttccgtattaatgggcttgatggagttggagagggcaatgacttgtacccaggtggacaatactttgacccattgggcctagctgatgacccagttacctttgctgagctcaaggttaaggagatcaagaatggtagacttgctatgttctccatgtttgggttctttgttcaagctattgttactggaaagggaccacttgagaacttacttgaccaccttgacaaccctgttgctaacaatgcttgggtctatgccacaaagtttgttcctggatcgtagagtagtaattttcttctttaaaatgttttaataatattttgatgttatgacaagtgagatgaagtgaaatgaattgtagtattattgtaaagaaaatattttatgtagattaatattactatttgccgtgttcttggtctataattgtttgtagttttatcagtttgttcatgatatgatatccaacgtaacttggaaattatttttaggtgtttttgtgattttctaatttctctttgttcttaggtaaataacgtagaagtctaagtaattaatattttttggaagtttggttaaaatatatcaacccttcaacaaaattttgaaaaatt

SEQ ID NO: 2395 - DNA, 1100 bp, Phaseolus coccineus
ttttaccagcttctgttgaaccattcttgtagcctccttctatttaagcaagttaaaggtttcaagtttagctgaagaaaagcacttgaaagccatggcagcaacattaatggcagcctcagcaagcactggcactgtccttaaaccaacacctttccttggacaaagtaggggaaccaatgccaaccctcttagagatgttgtctccatgggacctgggaaatacaccatgggaaatgatttgtggtatgggccagatagagtgaaatacttgggacccttttcagctcagactccttcatatttgactggggaattcccaggggactatggatgggacactgctggtttgtctgctgaccctgaagcatttgccaagaacagggctcttgaggtgatccatgggcgttgggctatgcttggagcactaggatgcatcaccccagaagtgcttgagaggtgggtgaaagtggacttcaaggagccagtttggttcaaagcaggagctcaaatattctcagaaggtggcctagactatttggggaaccccaaccttgtgcatgcacagagcatcttggcagtgctaggcttccaagttgtgctgatgggtcttgttgaaggattccgcatcaatggccttcctggtgtaggagagggcaatgacctctaccctggtggccagtactttgaccctcttggccttgctgatgaccctgtcacttttgctgagctaaaggtcaaggagatcaagaatggaaggttggccatgttctccatgtttggcttctttgtccaagccattgtgactggcaaaggaccacttgagaaccttttggatcacatagacaaccctgtggctaataatgcttgggtctatgccaccaagtttgtccctggctcttaaattgctgttcctttgcttggtttgtatgaatgccatgatatggaattttccttgtagattaactatttctcagattagtggaccttttatgcttcactttccaaccgttgttcatccattcaaacaaatcaatgagaagacacatcaatcttaaagcaacaaaaaaagtgactatttacagtgtgtaaataaactt

SEQ ID NO: 2396 - DNA, 1044 bp, Phaseolus coccineus
gaaccattcttgtagcctccttctatttaagcaagttaaaggtttcaagtttagctgaagaaaagcacttgaaagccatggcagcaacattaatggcagcctcagcaagcactggcactgtccttaaaccaacacctttccttggacaaagtaggggaaccaatgccaaccctcttagagatgttgtctccatgggacctgggaaatacaccatgggaaatgatttgtggtatgggccagatagagtgaaatacttgggacccttttcagctcagactccttcatatttgactggggaattcccaggggactatggatgggacactgctggtttgtctgctgaccctgaagcatttgccaagaacagggctcttgaggtgatccatgggcgttgggctatgcttggagcactaggatgcatcaccccagaagtgcttgagaggtgggtgaaagtggacttcaaggagccagtttggttcaaagcaggagctcaaatattctcagaaggtggcctagactatttggggaaccccaaccttgtgcatgcacagagcatcttggcagtgctaggcttccaagttgtgctgatgggtcttgttgaaggattccgcatcaatggccttcctggtgtaggagagggcaatgacctctaccctggtggccagtactttgaccctcttggccttgctgatgaccctgtcacttttgctgagctaaaggtcaaggagatcaagaatggaaggttggccatgttctccatgtttggcttctttgtccaagccattgtgactggcaaaggaccacttgagaaccttttggatcacatagacaaccctgtggctaataatgcttgggtctatgccaccaagtttgtccctggctcttaaattgctgttcctttgcttggtttgtatgaatgccatgatatggaattttccttgtagattaactatttctcagattagtggaccttttatgcttcactttccaaccgttgttcatccattcaaacaaatcaatgagaagacacatcaatcttaaagc

SEQ ID NO: 2397 - DNA, 1146 bp, Ricinus communis
caccacttctctaatctgtttcagtcttaaccacacatatttctgattctcaattttttgccttataaacataaaagaaaaacacttccctttctacacaattccaggctgcatttattaaaccttcaggagacaaactcaaaagataaacaactgagttgcaactgaagaggcaatggcatcaactgtaatggcagctactgctagctcaagctctgtgcttaggccaaccccatttcttggccaaagagggtcaagtgctaaccctcttaaagatgttgtctccatgggaaatgggaaatatatcatgggaaatgagttatggtatggaccagatagagtgaagtacttaggacccttttcagctcagactccttcttacctgaatggagagtttccaggtgattatggatgggatactgctggtttatcagctgaccctgaagcctttgccagaaacagggctcttgaggtaatccatggaagatgggctatgcttggagcactaggctgcattaccccagaagttcttgagaaatgggttaaagttgacttcaaagaaccagtatggttcaaagccggagctcagatattctctgaaggtggtttggactacttgggcaaccccaaccttgtccatgcacaaagcattcttgcagttcttggattccaggttgtccttatgggacttgttgaaggattccgcatcaacggtcttcctggagttggagagggcaatgacctttaccctggtggccagtacttcgatcctcttggccttgccgatgatcctgttacttttgctgagctcaaggtgaaggaaatcaagaatggcaggctagccatgttctccatgtttggcttctttgttcaagctattgtaactggaaagggtcccttggaaaatctcttggaccaccttgacaaccctgttgccaacaatgcttgggtctatgccactaagttttcccctggatcataagttaaaaggttagagtggaaagcctgcctagatatcatggatcttgtactactaaattcaaaacatggctatgttgttaggatctaatgtaaattttcattcaatggcagtgcttctcttctttaccatgatatcatgattgctaatagacatagatactcatc

SEQ ID NO: 2398 - DNA, 1188 bp, Lotus japonicus
caccaattcccattcatgtgttactcaccacacattcctctgactctctttccctacatatgatgttatactcactcttcctttctacacatttctacaaactcttcttagttattatctttttttgagtacactaaggttttaagttaagagagcttgcaagccatggcagcaacattgatggcagccaccactgcaagctctggcactgtgattaaaccaagtcctttccttggccaaaccaagggttccaactccaacactcttagagatgttgtctctatgggaactgggaaatacaccatgggaaatgatttgtggtatggaccagacagggtgaaatacttgggacccttttcagctcagaccccttcatacttaactggagaattcccaggtgattatggatgggacactgctgggttatctgctgaccctgaagcatttgccaagaacagggctcttgaggtgatccatgggcgttgggccatgcttggagcactaggctgcatcaccccagaagtactagaaaagtgggttcgtgtggacttcaaagagccagtatggttcaaagcaggatcccaaattttctcagaaggaggccttgactacttaggcaaccccaacctcgtccacgcacaaagcatcctcgcagtgctaggcttccaagttcttctcatgggtcttgtcgaaggcttccgcatcaacggccttcccggagtcggagaaggcaacaacctctaccctggtggccagtactttgaccctctcggcctcgccgacgaccctgccactttcgctgagcttaaagtgaaggagatcaagaatggaaggttggccatgttctccatgtttggtttctttgttcaagccattgtcactgggaaaggacccttggagaaccttttggatcaccttgatgaccctgtggctaacaatgcctgggtctatgccactaagtttgtgcctgggtcttaaacactatgacttttctttctttaattccatccctgtgattgtcttttgggtgaactaatgatgtgtaaattatgatcataatgattgtcggattagtgtacttctgaattaaacctggaatgtcccatgttaatctgtgttgttccaaggcacagatgagaaaagtataacaatgtgaaagcagtgaagcgatttagaatagtttgagct

SEQ ID NO: 2399 - DNA, 893 bp, Centaurea maculosa
catcaatggcatccatggctgctgcaactgctagctcaaccactgttgtcaaagccaccccctttttgggtcaaaccagatcagcctctaatgtcaaccctcttagagattctgtctccatggtcaatggcaaattcaccatgagtaacgacttgtggtacggaccggaccgtgtcaagtacttgggacccttttcggctcaacaccatcgtacttgaccggcgaattcccgggtgactacggctgggacaccgctggtttgtccgccgaccccgaggctttcgctaagaaccgcgctctcgaggtgatccacgggcggtgggccatgctcggagccctaggatgcatcacccctgaagttctcgaaaaatgggtcaaggtcgatttcaaggagcccgtttggttcaaagccggggcccagatcttctccgaaggcggtctagactacttgggcaaccccaacctcgtacacgcccaaagcatcttagccgtcctcggtttccaagtcatccttatgggcctcgtcgaagggttccgcattaacgggctcgacggtgtgggagacgggaacaacctctacccgggaggtcagtatttcgacccgttgggccttgcggacgacccgttaacgtttgcggagttgaaggtgaaagaaatcaagaatgggaggctggcaatgttttcgatgtttgggttctttgtgcaagcaattgtaactggaaaaggaccattggagaaccttttggaccatttggataaccctgtggctcacaatgcttgggtctatgccaccaagtttgtacctggttcataagtcaattgttctttgtaaccttgaaaagaacatgtagattattattgttaattatatatttcatgaacccgaagccggg

SEQ ID NO: 2400 - DNA, 1123 bp, Citrullus lanatus
ttcaccactcatcttcctcgtttccccataatattcccccactttcccttctctatcacacaattgcaacagcagtggcccttcctcagtcctttctcacaaactcaaacacagagcttcaactagcaatggccgccacagccaccgccacctccgccaccctcctccgggctactccctttcttggccagaccagaggctcttcccagaactccctcagagatgtcgtcgccatgggaactggcaaatacaccatgggaaatgatctgtggtatggaccagacagagtgaagtacttggggccgttttcagctcagactccatcctacttgaacggtgaattccccggcgattatggatgggacactgctggcttgtccgccgatcccgaggctttcgccaagaacagagctctcgaggtgatccacgggaggtgggcgatgttgggagcattgggttgcataacacccgaagtgctagaaaaatggcttaaagtggacttcaaggagccagtgtggttcaaggcaggggcccaaatcttcacagaaggtggtctagactacctaggcaaccccaacctggtccacgcccagagcatcctagccgtcttggggttccaagtggtcctaatgggtcttgtcgaaggcttccgcatcaacggcctcgacggtgtcggcgagggcaacgacctctacccgggcggtcagtactttgaccctctcggactggccgatgacccagtcaccttcgcggagctgaaggtcaaggagatcaagaatggccgtcttgccatgttttccatgtttggcttctttgttcaggccattgtcactggaaagggccctcttgagaaccttcttgaccatcttgataaccctgtggctaacaatgcttgggtttatgctaccaagtttgcccctggctcataagtatcacattaatcatggaaattcaacaagtgatctgttgtgtaaattgtttgtagctttctgtttttttgggtgtgggttggtgtgattataattagatggttgagtattgaggtggatcaatggacattaattcccacttgatctaatggataatgttcttaatcttaattacatcatttgatttactttaa

SEQ ID NO: 2401 - DNA, 1061 bp, Amsonia hubrichtii
tccaaattgtagttgtcagaaagcaaacagacgccaactatataataagtaatcaatcgactgaaattcaagagaaaaaagaatggcgtcagtggcagctacggccagctccaacactgttgttagagcaaccccattcttgggccaaaccaaatgtgctaaccctcttagagacgttgtctccatgggaaatggcaagtacactatgggaaatgaactatggtatggacccgaccgtgtgaaatacttgggacccttttcagctcaaactccatcgtacttgaacggcgagtttcctggtgactatggatgggatactgctggtttgtctgctgatcctgaggcctttgccaggaacagggctcttgaggttatccacgggcgatgggctatgcttggagcactgggatgcatcaccccagaagttcttgagaagtgggttaaggtggacttcaaagaaccagtctggttcaaagctggagcacagatcttctctgaaggaggtcttgactacttgggtaacccaaacctcgtccatgcacagagcattttggcagtccttggtttccaggttgttctgatgggacttgttgaaggattcaggattaatggtcttcctggagttggagagggcaatgatttgtaccctggtggtcaatactttgatcctcttggcttagccgatgacccagttacctttgctgaacttaaggttaaggaaatcaagaatggaagactagccatgttctccatgtttggattctttgttcaagctattgtcactggcaaaggccctcttgagaatctcctggaccatcttgacaaccctgttgctaacaatgcctgggtttatgccaccaagtttgtccccggatcataaatttcagcttaatcaattgttataactgtgaatgaaaacctttcgtagaatatgtatcattgtagtgccaaggttgattatctagtgctgattttggctgtctttctctcaatctaacatgcctgctacggatatgcaagtaaattaggaaaataatataaataacatggatacgtaggtg

SEQ ID NO: 2402 - DNA, 1008 bp, Artemisia annua
agtctaaaccatcttccatcataccaacaagaatcaatatcacacttttctctaaacaactatcactagccacatatacaccaatggctgcaactgctagctccactgtggtacgagccaccccatttttgggccaaaccagaccatctagcatcaacccactaagagatgttgtctctatgcctagtgccaaatacaccatgggaaatgacttgtggtatggaccggaccgtgttaagtacttgggacccttttccgctcaaaccccttcatacttgactggtgaattccctggtgactatggttgggacacagccggtttatcggctgatcccgaggctttcgccaagaacagggctcttgaggttatccatggacgttgggcaatgcttggtgcactagggtgcatcacacccgaggttctcgagaaatgggttaaagtagatttcaaggagcccgtttggttcaaggctggagcccaaatcttctcagaaggcggtctagactacctagggaacccgaaccttgtccatgctcaaagcatattggcagtgctcgggttccaagtggtccttatgggccttgtggagggattccgtattaatgggcttgatggtgttggagatggaaacaacttgtatccgggtgggcaatactttgacccattgggacttgctgatgaccctgtaacctttgctgagttgaaggtgaaagagatcaagaatggaagacttgcgatgttttcgatgtttgggttttttgtacaagccatagtgacaggaaaaggaccattggagaacttgttggaccatctagacaaccctgtggctaacaatgcttgggtctatgccaccaaatttgtgcctggctcatagactttgtaacctttcctttgttcttgtaattgcaagtgtggggagaaaaccttgtagattattatctattaattctatataatatgacattcataaaaaaaaaaaaaaaaaaaaacaatgtcggatctagaat

SEQ ID NO: 2403 - DNA, 1106 bp, Manihot esculenta
aggctgcaattatctactttcaatggcttcaatggctagctccagtactatcctcaggccaactccatttcttggccaaaagggttcaactgctaatcctctcagagatggtgtcgccatgggaaatggcaaatacatcatggggaatgagttgtggtatggaccagacagagtgaagtacttgggacccttttcagctcagactccttcatacctgactggagaatttccaggtgactatggatgggacactgctggtttgtcagctgatcctgaggcttttgccaggaacagggctcttgaggtgattcatgggagatgggctatgcttggagcactaggctgcatcacaccagaagtacttgagaaatgggtaaaagtggacttcaaggaaccagtatggttcaaagctggagctcaaatcttctcagaaggtggcttagactacttgggaaacccaaacctagtccatgcacaaagcatcctagcagttcttggattccaagtggtcctaatgggacttgttgaaggattccgcatcaatggtctccctggagtgggagagggcaatgatctttaccccggcggcaagtactttgaccctctaggccttgcagatgatccagttacatttgcagagctgaaggtgaaggagatcaagaatggaaggctagccatgttctcaatgtttggtttctttgttcaagctattgtaactgggaagggtcccctggagaaccttttggaccaccttgacaacccagttgctaataatgcttgggtctatgccacaaagtttgtccctggatcataaattgatgatttgtaatggaaactctaccacctagggtatcaaaacttcctgtactatcagatttaaaaacttgagtgtcggttggagtccaatgtacattttaattttatggcgatgctcttcttctttaccatggttgtattgtttcttattaggtagcatagcaaagactatccatcaaaaagagaggctgatcatttttaaaggtgagttgagatgacaggagtttcttttcttcttattaaaattttagaagaatttaaattaatagaacaattagaatttgaatttc

SEQ ID NO: 2404 - DNA, 975 bp, Catharanthus roseus
aagatcaagatcaagaagaagaagaagaagaagaaagaatggcatcaatggcagctacagccaccagctccaccactgttgttagagcaactcctttcttgggccaaaccaaaactgctaacccttttagagatgttgtttccatgggaaatcccaagttcaccatgggaaatgaactatggtatggacctgaccgagtgaaatacttgggacccttttcagctcaaactccatcctacttgacaggagagtttccaggtgattatggatgggatactgccggtttgtctgctgatcctgaggcctttgccaggaacagggctcttgaggtaatccatgggagatgggcaatgcttggagcacttggatgcataaccccagaagttcttgaaaagtgggttaaagtagacttcaaagaaccagtttggttcaaagcaggagcacaaatcttctcagaaggaggacttgactatttggggaacccaaaccttgttcatgcacaaagcattttagcagtcctaggtttccaagttgttctaatgggacttgttgaaggattcagaattaatggtcttcctggagttggagaaggaaataatctttacccaggtggacaatactttgatcctcttggattagctgatgatcctgttacttttgctgaacttaaggttaaggaaatcaagaatggaagattagccatgttttccatgtttggattctttgtccaagctattgtcactggcaaaggtcctcttgagaatcttcttgatcatctggataaccctgttgctaacaatgcctgggtttatgccacaaagtttgttcctggatcataaacttcactttaattcattcattcttgtaatctgtctgtgaatgaaatactttttcatcttctgctcattattaagcaaaaatgtcactttctttttaagaaaagagctctgaaagcttaataaaaactgaaaatgg

SEQ ID NO: 2405 - DNA, 983 bp, Centaurea maculosa
  misc_feature (51)..(51): n is a, c, g, or t
  misc_feature (225)..(225): n is a, c, g, or t
  misc_feature (234)..(234): n is a, c, g, or t
  misc_feature (375)..(375): n is a, c, g, or t
  misc_feature (438)..(438): n is a, c, g, or t
  misc_feature (474)..(474): n is a, c, g, or t
  misc_feature (510)..(510): n is a, c, g, or t
  misc_feature (525)..(525): n is a, c, g, or t
  misc_feature (528)..(528): n is a, c, g, or t
  misc_feature (534)..(534): n is a, c, g, or t
  misc_feature (571)..(571): n is a, c, g, or t
  misc_feature (573)..(573): n is a, c, g, or t
  misc_feature (582)..(582): n is a, c, g, or t
  misc_feature (642)..(642): n is a, c, g, or t
  misc_feature (678)..(678): n is a, c, g, or t
  misc_feature (693)..(693): n is a, c, g, or t
  misc_feature (696)..(696): n is a, c, g, or t
  misc_feature (741)..(741): n is a, c, g, or t
  misc_feature (744)..(744): n is a, c, g, or t
  misc_feature (753)..(753): n is a, c, g, or t
gcgggggtgcccacttgtaatttcattcaaaccctttgagctttcctttanttctcctcatcaatggcatccatggctgctgcaactgctagctccaccactgttgtcaaagccaccccttttttgggtcaaaccagatcagcctctaatgtcaaccctcttagagattctgtctccatgctcaatggcaaattcaccatgagtaacgacttgtggtacggcccngaccgtgtnaagtacttgggacccttttcggctcagacaccatcgtacttgaccggcgaattcccgggtgactacggctgggacaccgctggtttgtccgccgaccccgaggctttcgctaagaaccgcgctctcgaggtgatccacggncggtgggccatgctcggagccctaggatgcatcacccctgaagttctcgaaaaatgggtcaangtcgatttcaaggagcccgtttggttcaaagccggngcccagatcttctccgaaggcggtctagactacttnggcaaccccaacctngtncacgcncaaagcatcttagccgtcctcggtttccaagtcatcntnatgggcctngtcgaagggttccgcattaacgggctcgacggtgtgggagacgggaacaacctctacccnggaggtcagtatttcgacccgttgggccttgcggangacccgttaacgttngcngagttgaaggtgaaagaaatcaagaatgggaggctggcaatgttntcnatgtttggnttctttgtgcaagcaattgtaactggaaaaggaccattggagaaccttttggaccatttggataaccctgtggctcacaatgcttgggtctatgccaccaagtttgtacctggttcataagtcaattgttctttgtaaccttagaaagaacatgtagattattattggtaattatatatgtcatgaacccgaagccgggattttcccaaagaaaaaaaaaagaaaagggc

SEQ ID NO: 2406 - DNA, 1022 bp, Cichorium intybus
gcggggatctaacatcacctgtatcttcctctctcgaaccatcagaagccacctccatcaatggccgcagctgctagctccactaccgtggtccgagccaccccattcttgggtcaaaccagaccatcaagtctcaaccctctaagagatgctgtctctatgcccagtgccaaattcaccatgggaaatgatttgtggtatggacctgaccgtgtcaaatacttgggacccttttcggctcagaccccatcgtacttaactggagaattccccggcgactacggttgggataccgccggcttgtccgctgatcccgaggccttcgccaagaacagagctcttgaggttatccatgggcgatgggccatgcttggtgcattcggttgcatcacacccgaggttcttgaaaagtgggtgaaagtggatttcaaggagccagtttggttcaaggccggagcccagattttctccgaaggtggtctggactacttagggaacccaaaccttgttcatgctcaaagcatactggcggttctcggattccaagtggtgttgatgggtcttgtggaggggttccgcattaacggtcttgaaggtgttggagaaggtaacaacttgtacccgggtggacaatattttgacccgttggggcttgcagatgacccggtgacatttgctgagttgaaggtgaaggagatcaagaatggaaggctggcaatgttttccatgtttgggtttttcgtgcaagcgattgttacagggaaaggtccattggagaacctgttggaccatttggacaaccctgtggctaacaatgcttgggtctatgccaccaagtttgtgcccggttcatagattatgtaacctttccaatgttcttgtaactacgagtgtggggagaaacatgtagagattattacaattaattctatacaatatggtgtgctttagacggaatcgttattaaatgtgaattattataattcttatgttattattgtgaatgaaaaacataatcatct

SEQ ID NO: 2407 - DNA, 950 bp, Flaveria ramosissima
atggggatcactaacaacaattgcatctttcacttaatttacaaccaccacaacaaaccaccatcaatggctgcagctgctaactccaccgtggtccaagccactccattcttgggtcaaaccagaccatctagcctcaaccccttaagagatatggtctctatgcccagtgcaaaatacaccatgggaaatgacttgtggtatggacctgaccgtgttaagtacttgggacccttttcggctcaaaccccatcatacttgactggtgaattccctggtgactacggttgggacactgctggtttgtccgctgatcccgaggcttttgccaagaatagggctcttgaggtgatccatggccgatgggccatgctaggagcactcgggtgcatcacacccgaggtccttgaaaagtgggtgaaagtggatttcaaggagcctgtttggttcaaggccggagcccagatattctccgaaggcggtttggactaccttgggaacccgaaccttgtccatgctcagagcatattggcagttcttgggttccaggtggtcctaatgggccttgttgaggggttccgtattaacgggcttgaaggggttggagatggtaacaatttgtatccgggtgggcaatactttgacccgttgggccttgcggacgacccggtgaccttcgccgagttaaaggtgaaagagatcaagaacgggagattggctatgttttcgatgttcgggttctttgtgcaagcaatagttacaggcaaaggcccgctggagaacctgttggaccatttggacaaccctgtggctaacaatgcttgggtctatgccaccaagtttgtgcctggctcttagactttttaccatcttgtaaccgcaagtttgggaagaaaaatgtgtagattattataattagttctatataatatggtgtttattagatggtc

SEQ ID NO: 2408 - DNA, 1046 bp, Panax ginseng
ttggtaacccgggaaattcggccattacggccggggactgcacttgtagtcactctttccaaaaccagatctcaaagagagaaatactagctaaaacttctaaaaacatggcaatggcaacaactgcaagctccagcactgttgttagagcaaccccatttttgggacaaaccaaagcctcaaatgccaaccctcttcgagatgttgtctcaatgggcaccggcaaatttaccatgggaaatgatttatggtacggaccagaccgtgtcaagtacttgggaccattttcagcccagactccatcctacttgaatggagaatttcccggtgattatggttgggatactgctggtttatctgctgatcctgaagcctttgccaagaacagagctctcgaggtgatccatgggcgatgggcaatgcttggagcactgggctccatcaccccagaagtcctggagaaatgggtaaaagtggacttcaaggagccagtttggttcaaagccggagcccaaatcttcacagaaggcggcctagactatttgggcaaccccaatcttgtccatgctcagagcattttggcagtactgggcttccaagtggttctaatggggcttgttgagggctttcgcatcaacggccttcccggggtcggagagggcaacgacctctacccaggaggccaatatttcgacccactgggccttgctgatgatccagatacctttgctgagctcaaggtgaaagaaatcaagaatggaagactggccatgttctctatgtttggtttcttcgtccaagcgatagtcaccggcaaagggcctcttgagaacctcttggaccaccttgacaaccctgttgctaacaatgcatgggtctatgccaccaagtttgttcccggatcataacttaataattccccaatcttattcaatctgtgtgatggaggtgaaacgttttgtaattaattatagtaatataattataattaatgtgtttcttaatttgactcaaaaaaacaaagaaaaagagattataaaacatgt

SEQ ID NO: 2409 - DNA, 987 bp, Lactuca sativa
ggggcagtcgatctcattgaagctcccatcaatggcatccatggctgcaactgcttctagctcctcaactgtggtccgagccacccctttcttgggtcaaaccaaaggatccaatgccaacacccttagagattctgtctccatggtcaatggcaaattcaccatgggaaatgacttgtggtatggaccagaccgtgtgaagtacttgggcccattttcggctcaaacaccatcctacctgaccggtgaattcccaggcgactatggttgggatacagctggtttgtctgctgatcccgaggcattcgctaaaaaccgggctcttgaggtgatccacgggcgatgggcaatgctcggagcactgggctccatcacgcccgaagtccttgcaaaatgggtcaaagtggatttcaaggagcccgtttggttcaaagccggatcccaaatcttctcagaaggtgggctagactacttgggcaaccctaacctggtccacgcacaaagcatactagcagtactcggttttcaagtggtcctaatgggcctagtcgaagggttccgtatcaacgggctcgatggtgttggagatggtaacaacttgtacccgggtggtcagtattttgacccgttgggacttgctgacgacccggttacctttgccgagttgaaagtgaaggaaatcaagaatggaagactagcaatgttttcaatgtttgggttttttgttcaagcaattgtaacagggaaaggaccattggagaaccttttggaccatttggatgaccctgtggctaacaatgcatgggtctatgccaccaagttcgcccctggttcataagtttttgtggctccttgagttttcttgtaaacttatcagtttgatgaagaaaatatgtatattatcgttgtttatgttgagatttgttgacacacatgaaatgagtgttttgtcacaaaacatgattgttctatactaattaaatgcgt

SEQ ID NO: 2410 - DNA, 993 bp, Nicotiana tabacum
atccagatttctccaacagtatatttttattaattaactgtgaatttcaagactagattaagagaaaatggcatcaatggcagcaacagcaagctccaccacagttgttagagcaaccccatttttgggccaaaccaagaatgctaaccctcttagagatgttgttcccatgggctctgccaaattcaccatgggtaatgacttatggtatggacccgaccgtgtcaagtacttgggacccttttcagctcaaactccttcgtacttgactggtgaattccctggtgattacggatgggacactgctggtttatccgctgatcctgaggcttttgccaagaacagagctcttgaggttatccatggtagatgggcaatgcttggagcactaggttgcatcaccccagaagttcttgaaaaatgggtgaaagtggacttcaaagaaccagtatggttcaaagcaggagctcaaatcttcagcgaagggggacttgactacttaggcaaccctaaccttgtgcatgctcagagtattctagctgtgctaggttttcaagttgtgctcatgggacttgttgaaggttttagaattaatggacttcctggagtcggagaaggcaacaacttataccctggtggtcaatattttgacccacttggcctagctgatgacccgacaacttttgccgagctcaaggtgaaggagatcaagaacggaagattggctatgttctccatgttcggattctttgttcaagctattgtcaccggaaaaggccctcttgagaacctattggatcaccttgacaaccctgttgctaacaatgcttgggtttatgctacaaagtttgttcctggagcttaagatgattatgtcttatgtttcaattctagtgttttgtgtaactgtatcttcagaaaatgcaaatatgttgtagatgaaattatttttagtttaattgttatacattaatggtcgaatagtttttcaca

SEQ ID NO: 2411 - DNA, 1151 bp, Nicotiana tabacum
  misc_feature (1131)..(1131): n is a, c, g, or t
gctctcatttcccatttctctctcttttctctcaacccttccaacccatcgatcagagaaaacttgaacgaatcggtacaaattcacaataccttcaccaaatcatccttccatcccccaatcatccaaatttctccagcagtatattttaattaatcaactgtgaatttcaagactagattaagagaaaatggcatcaatggcagcaacagcaagctccaccacagttgttagagcaaccccatttttgggtcaaaccaagaatgctaaccctcttagagatgttgttcccatgggctctgccaaatttaccatgggaaatgatttatggtatggaccagatcgtgtcaagtacttaggacccttttctgctcaaactccttcatacttgaccggagaattccctggtgattatggatgggacactgctggtttatctgctgatcctgaagcttttgccaagaacagagctcttgaggttatccatgggagatgggcaatgcttggtgcactaggttgcatcaccccagaagttcttgaaaaatgggtgaaagtagacttcaaagaaccagtatggttcaaagcaggagctcaaatcttcagcgaaggaggacttgactacttaggcaaccctaaccttgtgcatgctcagagtattctagctgtgctaggtttccaagttgtactcatgggacttgttgaaggttttagaattaatggacttcctggagttggagaaggcaacaatttataccctggtggtcaatattttgacccacttggcctagccgatgacccgacaacttttgccgagctcaaggtgaaggagatcaagaatggaaggttggcaatgttctctatgttcggattctttgttcaagctattgtcactggcaaaggacctcttgagaacttgttggaccaccttgataaccctgttgctaacaatgcttgggtttatgccacaaaatttgttcctggagcttaagatgattatgtcttagtatgtctcaattctagtgttttgtgtaactgtatcttcagaaatgcaaatatgttgtagatgaaattatttttactttaattgttatacattgatggacgaatcgtttttcacactatcagcttatntatgagttaaataacatggc

SEQ ID NO: 2412 - DNA, 1054 bp, Musa acuminata
ccctcctctgcttacataccttcctcggcatccattcctctccatccacctctcaccaccagaaactgagacacagttcaagacacccacaccacagccgcagagatggcagcaaccctgactgcagcttcttctcgcgccaccacagtggtcgctccgtccccattcctcggccaaacccgggcgtcgagcgccaaccctctcagagatgctgttcccatgggcaaaggaaggatcaccatgggaaacgagctgtggtatggaccagaccgcgtcaagtacttgggccccttctcggcgcagacaccgtcgtacctcaagggagagttccccggtgactacggctgggataccgccggcctttccgccgaccccgaagcctttgccaggaacagagctctcgaggtgatccatgggaggtgggcaatgctgggggcgttcggctgcatcaccccggaggtgctggagaagtgggtgaaggtggacttcaaggagccggtgtggttcaaggcaggcgcgcagatcttctccgacggcgggctggactacctcggcaaccccaacctggtgcacgcccagagcatactggccgtgctgggttgccaggtcgtcctcatgggcctggtcgagggcttccgcatcaacgggcttcccggagttggggagggcaacgatctgtaccccggtggcacttacttcgatcccctgggcctcgccgacgaccccgccacgttcgcggagctgaaggtgaaggagatcaagaacgggaggctggcgatgttctccatgtttgggttcttcgtgcaggccatcgtgacagggaaggggcctctggagaacctcttggatcatctcgacaaccccgtcgctaacaatgcttgggtttacgccaccaagttcgtgccaggctcttaattccccctcatcatctcttgcttcactgtgtccatgatttggggaagaacatgattgctgcgcgtgttcgttcttgctgtatctacgatgtgctccttaatcctaatttaagctgctggtataaacattctcgtgatgc

SEQ ID NO: 2413 - DNA, 1007 bp, Musa acuminata
ggggacctctcaccaccagaaactgagacacagttcaagacacccacagccgcagagatggcagcaaccctgactgcagcttcttctcgcgccaccacagtggtcgctccgtccccattcctcggccaaacccgggcgtcgagcgccaaccctctcagagatgctgttcccatgggcaaaggaaggatcaccatgggaaacgagctgtggtatggaccagaccgcgtcaagtacttgggccccttctcggcgcagacaccgtcgtacctcaagggagagttccccggtgactacggctgggataccgccggcctttccgccgaccccgaagcctttgccaggaacagagctctcgaggtgatccatgggaggtgggcaatgctgggggcgttcggctgcatcaccccggaggtgctggagaagtggttgaaggtggacttcaaggagccggtgtggttcaaggcaggcgcgcagatcttctccgacggcgggctggactacctcggcaaccccaacctggtgcacgcccagagcatactggccgtgctgggttgccaggtcgtcctcatgggcctggtcgagggcttccgcatcaacgggcttcccggagttggggaaggcaacgatctgtaccccggtggcacctacttcgatcccctgggcctcgccgacgaccccgtcacgttcgcggagctgaaggtgaaagaaatcaaaaacgggaggctggcaatgttctccatgtttgggttcttcgtgcaggccatcgtgacagggaaggggcctctggagaacctcttggatcatctcgacaaccccgtcgctaacaatgcttgggtttacgccaccaagttcgtgccaggctcttaattccccctcaccatctcttgcttcactgtgtccatgatttggggaagaacatgattgctgcgcgtgttcgttcttgctgtatctacgatgtgctccttaatcctaatttaagctgccggtataaacattctcgtgatgcc

SEQ ID NO: 2414 - DNA, 1074 bp, Citrus sinensis
  misc_feature (14)..(14): n is a, c, g, or t
ctcatttcattccncgttataacaacaaacgcccttcatctctctttctgtattgtcttcagacacatattaacatcacagttccaaccgacacaacatccataataacaactctcaggacaatggcatcaataatggcggctgctactgctagctctagcacttctcttagggcaaccccatttcttggccagagtaggacaactgctaacgctctaaaagatgttgttccgatggggaatgccaagtacacaatgggaaatgaactgtggtatgggccagacagggtgaagtacttgggacccttttcagcacagactccatcatacttgactggagagtttccaggtgactatggatgggacactgctggtttgtctgctgatcccgaggcctttgccaggaacagggctcttgaggtgatccatggcaggtgggctatgcttggagcactaggctgcatcacccctgaagttctcgagaaatggcttagagtagacttcaaggaaccggtttggttcaaagctggagctcagattttctcagaaggtggccttgactacttgggaaaccccaaccttgttcatgctcaaagcattctggctgtcctgggattccaggttgtcctcatggggctcgttgagggtttccgtatcaatggcctccctggtgtcggagaaggaaacgacctctaccctggtggccaatattttgatccccttggccttgctgatgatcctgttacgtttgctgaactcaaggtgaaggaaatcaagaatggcaggctagctatgttttccatgtttggtttctttgtccaagctattgtgacaggcaaaggtcccctggagaacctcctggaccaccttgagaaccctgttgccaacaatgcttgggtctatgctaccaagtttgtacctggatcataaactgattatgattactgttaattcttgttcatgtgcaatgtagattatgaatattctgcctttgagatccaatgttacttgtgtcaatgttgaatcaaaaagaaaaaaaaaaaaaaaaaaaaaaaaaaaaaaaatttaaaaaaaa

SEQ ID NO: 2415 - DNA, 1076 bp, Citrus clementina
ctcatgcattctcctccacaccacccgtctcttgtttctcatttcattcccgttataacaacaaacgcccttcatctctctttctgtattgtcttcagacacatattaacatcacagttccaaccgacacaacatccataataccaactctcaggacaatggcatcaataatggcggctgctactgctagctctagcacttctcttagggcaaccccatttcttggccagagtaggacaactgctaacgctctaaaagatgttgttccgatggggaatgccaagtacacaatgggaaatgaactgtggtatgggccagacagggtgaagtacttgggacccttttcagcacagactccatcatacttgactggagagtttccaggtgactatggatgggacactgctggtttgtctgctgatcccgaggcctttgccaggaacagggctcttgaggtgatccatggcaggtgggctatgcttggagcactaggctgcatcacccctgaagttctcgagaaatggcttagagtagacttcaaggaaccggtttggttcaaagctggagctcagattttctcagaaggtggccttgactacttgggaaaccccaaccttgttcatgctcaaagcattctggctgtcctgggattccaggttgtcctcatggggctcgttgagggtttccgtatcaatggcctccctggtgtcggagaaggaaacgacctctaccctggtggccaatattttgatccccttggccttgctgatgatcctgttacgtttgctgaactcaaggtgaaggaaatcaagaatggcaggctagctatgttttccatgtttggtttctttgtccaagctattgtgacaggcaaaggtcccctggagaacctcctggaccaccttgagaaccctgttgccaacaatgcttgggtctatgctaccaagtttgtacctggatcataaactgattatgattactgttaattcttgttcatgtgcaatgtagattatgaatattctgcctttgagatccaatgttacttgtgtcaatgttgaatcatatcccattagaac

SEQ ID NO: 2416 - DNA, 1076 bp, Citrus sinensis
ctcatgcattctcctccacaccacccgtctcttgtttctcatttcattcccgttataacaacaaacgcccttcatctctctttctgtattgtcttcagacacatattaacatcacagttccaaccgacacaacatccataataacaactctcaggacaatggcatcaataatggcggctgctactgctagctctagcacttctcttagggcaaccccatttcttggccagagtaggacaactgctaacgctctaaaagatgttgttccgatggggaatgccaagtacacaatgggaaatgaactgtggtatgggccagacagggtgaagtacttgggacccttttcagcacagactccatcatacttgactggagagtttccaggtgactatggatgggacactgctggtttgtctgctgatcccgaggcctttgccaggaacagggctcttgaggtgatccatggcaggtgggctatgcttggagcactaggctgcatcacccctgaagttctcgagaaatggcttagagtagacttcaaggaaccggtttggttcaaagctggagctcagattttctcagaaggtggccttgactacttgggaaaccccaaccttgttcatgctcaaagcattctggctgtcctgggattccaggttgtcctcatggggctcgttgagggtttccgtatcaatggcctccctggtgtcggagaaggaaacgacctctaccctggtggccaatattttgatccccttggccttgctgatgatcctgttacgtttgctgaactcaaggtgaaggaaatcaagaatggcaggctagctatgttttccatgtttggtttctttgtccaagctattgtgacaggcaaaggtcccttggagaacctcctggaccaccttgagaaccctgttgccaacaatgcttgggtctatgctaccaagtttgtacctggatcataaactgattatgattactgttaattcttgttcatgtgcaatgtagattatgaatattctgcctttgagatccaatgttacttgtgtcaatgttgaatcatatcccattagaac

SEQ ID NO: 2417 - DNA, 1300 bp, Cajanus cajan
gttgagcgaaagatacaatgtggataggaagatctgagttgaagatactaaaaatcttttgaaggcttcccattgtttggtccaaactacacggtccccaccacaaacatcccactcttgtgttcctaaccactcatatccctcagattttctttccctacatatgatgctacatgcacacaccctcttcctagtttctaccagcttctgttgaaccgttcttgtaagtcttctatttaagtaaattgaaggtttcaagtttcagctgaagtgaagtacttggagccatggcagccacagcaagcactggcactgtccttaaaccaacacctttccttggcctaagtaggggaattaatgccaaccctcttagagatgttgtctccatgggaactggcaaatacaccatgggaaatgaactgtggtatggaccagatagagtgaaatacttgggacccttttcagctcagaccccttcatacttgactggagaattcccaggggactatggatgggacactgctgggttgtctgctgatcctgaagcatttgccaagaacagggctcttgaggtgatccatgggcgttgggctatgcttggagcactaggttgcatcaccccagaagtgcttgagaagtgggtaagagtggacttcaaggagccagtttggttcaaagcaggagctcagatattctcagagggtggccttgactatttggggaaccccaaccttgtacatgcacaaagcatcttggcagtcctaggcttccaagtggttctcatgggactagttgaagggttcagaatcaatggccttccaggggttggagagggcaatgatctctaccctggtggtcagtactttgatcctcttggccttgctgatgatcctgtcacctttgctgagctcaaggtcaaggaaatcaagaatggaaggttggccatgttctccatgtttggattctttgtccaagccattgtgactgggaaaggacctcttgagaaccttttggaccaccttgacaaccctgtggccaacaatgcttgggtctatgccaccaagtttgtgcctgggtcttgaatttggcttttcttggcctggtttgtgttaatgagtaccatgatatggagtggaagtttccttgtagattaattactatcacaatgtttttcagattagtggactggactttttaaggttcattttaaaactcttgttgatttattaaacagatgagttggaagacacagcaatgttaaattaaggaagaaagtgacttgacttatattatgtaacta

SEQ ID NO: 2418 - DNA, 1372 bp, Cajanus cajan
gttgagcaaaagatacaatgtggataggaagatctgagttgaagatactaaaaatcttttgaaggcttcccattgtttggtccaaactacacggtccccaccacaaacatcccactcttgtgttcctaaccactcatatccctcagattttctttccctacatatgatgctacatgcacacaccctcttcctagtttctaccagcttctgttgaaccgttcttgtaagtcttctatttaagtaaattgaaggtttcaagtttcagctgaagtgaagtacttggagccatggcagccacagcaagcactggcactgtccttaaaccaacacctttccttggcctaagtaggggaattaatgccaaccctcttagagatgttgtctccatgggaactggcaaatacaccatgggaaatgaactgtggtatggaccagatagagtgaaatacttgggacccttttcagctcagaccccttcatacttgactggagaattcccaggggactatggatgggacactgctgggttgtctgctgatcctgaagcatttgccaagaacagggctcttgaggtgatccatgggcgttgggctatgcttggagcactaggttgcatcaccccagaagtgcttgagaagtgggtaagagtggacttcaaggagccagtttggttcaaagcaggagctcagatattctcagagggtggccttgactatttggggaaccccaaccttgtacatgcacaaagcatcttggcagtcctaggcttccaagtggttctcatgggactagttgaagggttcagaatcaatggccttccaggggttggagagggcaatgatctctaccctggtggtcagtactttgatcctcttggccttgctgatgatcctgtcacctttgctgagctcaaggtcaaggaaatcaagaatggaaggttggccatgttctccatgtttggattctttgtccaagccattgtgactgggaaaggacctcttgagaaccttttggaccaccttgacaaccctgtggccaacaatgcttgggtctatgccaccaagtttgtgcctgggtcttgaatttggcttttcttggcctggtttgtgttaatgagtaccatgatatggagtggaagtttccttgtagattaattactatcacaatgtttttcagattagtggactggactttttaaggttcattttaaaactgttgatttattaaacagatgaattggaagacacagcaatgttaaattaaggaagaaagtgacttgacttatattatgtaactaggataattaaaaaatggactatcaattcaatttttctgtaccctatagatttagagttgttatttaatagtatga

SEQ ID NO: 2419 - DNA, 1095 bp, Gossypium raimondii
aaatcttcacttccattttcatacatttggcaactcaaaatcaatccccattgacaaacaatggcttccatgcttagctctggaattgttcttaggccaaccccatttcttggccaaaccaaaaatgctaaccctcttagagatgttgtctctttgggcactcccaaatatgcaatgggaaatgaactatggtatggaccagacagagtgaagtacttgggaccattttcagctcagactccatcttacttgactggagaattccctggtgactatggttgggacactgctggtttgtcagccgaccctgaggcctttgccaggaatagggctcttgaggtcatccatggaagatgggcaatgttgggagcactaggctgtatcacaccagaagtacttgagaaatggcttagggttgatttcaaggaaccggtatggttcaaggcaggagctcaaattttctcagaaggtggcttggattacttaggcaaccctaacctagtccatgctcaaagcatccttgccgttctcggattccaagtcgtcctaatgggactcgtcgaaggattccgcatcaatggcttccctggtgttggtgaaggcaatgatctttaccctggtggacaatactttgaccctcttggtcttgctgatgaccctgttacatttgctgaacttaaggttaaagaaatcaagaatggtaggctagccatgttttcaatgtttggtttctttgttcaagccattgttactggtaaaggtcccttggagaacctattggaccaccttgataaccctgttgcaaacaatgcttgggtctatgctactaagtttgtgcctgggtcttaaatgaaaatagccaaaaggtcaaaacttgtataatttgctttatgtggattagaaattgagatatgtgtatttatgtgattgtagattttgaacaactttgacaaatcaaattatgtatcattaagaattgaatttaactcattgataaataagtattggtgttagacactaaatagagataaagatatgacacatcaacaatcttctaaatacaaccaaaatgtttaaaaaaaaaaaaatctaaac

SEQ ID NO: 2420 - DNA, 1215 bp, Gossypium raimondii
cagcgttttaattggctgatctcattttcattaccagcctattctttctcttctttctttcttcgtctctacatatttgtatataaaacattcacttccttttctctgcattttcctatccagctaaaatcaactgaatatatatatatatatatatattttaaaaagggttgcccccttctaactctgaaaggcaatggcttcaatgcttagctcaggaaccgtccttaggccaaccccatttcttggccaaaacagaaatgctaaccctctcagagatgttgtctccgtgggcactgccaaatacacaatgggaaatgaactgtggtatggaccagacagagtgaagtacttgggacccttttcagctcagattccatcctacttgaacggcgagttccctggtgactacggatgggacactgccggtttgtcagctgaccctgaggcctttgctaggaacagggctcttgaggtaatccatggaagatgggcaatgctgggagcactaggctgcatcaccccagaagtccttgagaaatggcttagagttgacttcaaggaaccagtatggttcaaggcaggagctcaaattttctcagaaggtggcttggactacctaggcaaccccaaccttgttcatgctcaaagcattctcgctgtcctcgggttccaggttgtcctcatgggactagtcgaaggattccgcatcaatggtctccccggagtcggggaaggcaatgacctttaccctggtggccaatactttgaccctcttggtcttgctgatgaccctgtcacatttgctgaacttaaggttaaggaaatcaagaatggcaggctagccatgttctctatgtttggtttcttcgttcaagccattgtcacaggcaaaggtccactggaaaatctcttggaccaccttgacaaccctgttgccaacaatgcttgggtctatgctaccaagtttgtgcctggatcgtaaattaacagccctggatcgaacttgttccattatttgcttgtatctatcctctatgtacctgtagatttcgcatcactctgaaattttaaacctgtatcactaagaagtcaatgaaattcatgatcaagttcggtgtagggttccgtgatggctgggatttccattcatatgagaatgattaaccaaattttaattctgtcaaatgcttgacaaagatgagagagatagca

SEQ ID NO: 2421 - DNA, 1021 bp, Plantago ovata
ctccaacaacaagaagttaaacgaacccgagaactcgacgataccactgatgatcagtcaaacaacaacaatagaatcctatataccacacaagaaaaggttagccacttgagttcagtgcaaaggaatggcatcaatggctgcaactgctagctcaaccactgttgtcagggcaacccctttcttgggccaaaccaagaatgccaatccccttagagattttgtaccaatgggaaagggcaaatactccatgggttctgatttgtggtacggaccagaccgtgtaaagtacttgggaccattctcagctcagaccccatcttatctcactggagaattccccggtgactacggttgggacacagccggcttgtctgctgatcccgaggcgttcgccaagaacagggctcttgaggttatccatggaagatgggctatgcttggagctctaggttgcatcaccccagaagttcttgagaagtgggtgagcgtagacttcaaggagcccgtctggttcaaggccggtgcccaaatcttctctgaaggtgggctagactacttgggcaacccaaaccttgtgcacgcacaaagcattcttgcggttcttggattccaagtcgtgctcatgggacttgtcgaagggttcagaataaacggccttgatggagttggcgagggcaacgacctctaccccggtggccagtactttgacccattgggcttagcagaagaccctgtgacatttgctgagctgaaggtgaaagagatcaagaacggccggcttgctatgttctccatgtttggattcttcgtccaggcaatcgtcaccggaaagggaccattggagaacctgttggatcaccttgacaaccctgttgccaacaatgcctgggtatacgccacaaagtttgtccctggatcataatgtgtttactgtaatgaatgagagtgcatagtctgtagattaatatatgtacttgctcaaactgatgtatccactgaatgtttataatatattaat

SEQ ID NO: 2422 - DNA, 1127 bp, Papaver somniferum
acaaaatacatgtatatatagttctctctgcactgcaacttatcatccatcacagctttaaaacacaacttcaaaccaagtgctaagaactaccttaagagttcaggaaaaaatacagtgcttgaagaagaaaaatggtgtcaactttgatggcagctaactccactactgttcttagaacctccccatttttgggtcagaacagagtctctagtcctaattcccttagagatgtcgttgcgatgggtaatggaaaatataccatggcaggaaacgatttgtggtatggaccagacagagtcaagtacttgggtccattctctgctcaaactccatcatacctaaaaggagaattccctggtgattatggatgggataccgctggattatctgctgatccagaggcctttgctaagaacagggctcttgaggtaattcacggaagatgggctatgttgggagcactcggatgcataaccccagaagtactagagaaatgggttaaggtcgattttaaggaacccgtatggttcaaagctggttcacaaatcttctcagaaggcggtcttgactacttgggaaacccaaaccttgtccatgcccagagtatcttggctgttctaggtttccaagtcctacttatgggtcttgttgaaggtttccgcattaacggattagacggagttggtgagggaaacaacttgtaccctggtggaacctacttcgacccattgggacttgccgatgaccctgttacctttgctgaattgaaagtgaaggaaattaagaacggacgtcttgctatgttctctatgttcggtttctttgttcaagccattgttaccggaaaaggtcctcttgagaacctctttgatcaccttgacaaccccgttgctaacaatgcttgggtttacgcaaccaagtttgttcccggagcttagatagatgtcaaatttttcattattgctgtgatcccatttagctgtgattaaaatgaaatgaatggggaatgtgtgtaaattatgattgtaattaggaatttaagattgagaattcacgaatttgtaccaaagagatttttatgaatggattacatttcttctcattttatataaaaaaaaaaaaaa

SEQ ID NO: 2423 - DNA, 981 bp, Acacia harpophylla
gggcccttcccttataatagtaatttcttcttctgcctcaaccaccaaggtctcaactttagtactacccatggcagcatccactttcatggcggccacagcaagctctagcactgttcttaaaccttcccctttcctgggtcaaaccagagcatccaactccaactctctcatagatcttgtccctctcggaaaagccaaatataccatgggaaatgagttgtggtatggaccagaccgagtgaaatacttgggtcccttttcagctcagaccccttcatacctcaccggggaattccccggagattatggctgggacactgctggtttatctgctgaccctgaagcctttgctaggaacagggctcttgaggtgattcatgggcgatgggcgatgcttggagcactaggttgcatcacaccagaagttctagaaaaatgggtgagagtggacttcaaggagccagtatggttcaaagcaggagcccagattttctcagaaggaggccttgattacttaggcaatcccaacctggttcacgcacagagcattctcgccgtccttggttttcaagttgtgctcatgggtctggttgaaggcttccgcatcaacggccttcccggagtcggagaaggcaacgacctctaccctggcggccagtacttcgaccctctcggccttgctgacgaccctgtcaccttcgctgaactcaaggttaaggaaatcaagaatggaaggttggccatgttctccatgtttggattttttgttcaagccattgtgactggaaaaggaccgttggagaatctgttggaccaccttgataaccctgtggctaataatgcttgggtctatgccaccaagttcgtgcctggctcttaaatgtgtgtgtttaaggttatgaatggaaggacgctaatattgttgtaagatgtgtagtttatttcatgaacgtaatatagttcagattcttagtgtac

SEQ ID NO: 2424 - DNA, 971 bp, Ambrosia trifida
aacaacaattgcatcttccttgtttcaaccaccaaagagatcctccatcaatggctgccactgctagctcgaccactgtggtccaagccacccccttcttgggtcaaaccagaccatctagcctcaaccctttgagagatatggtctctatgcccagtgccaaatacaccatgggaaatgatttgtggtacggaccggaccgtgttaagtacttgggacccttttctgctcagactccatcatacttgactggtgaattccctggtgactacggttgggacaccgccggtttgtccgcagatcccgaggcttttgccaagaatcgggctcttgaggttatccatggacgatgggccatgcttggtgccctcgggtgcatcacacccgaggtgcttgaaaagtgggtgaaagtggatttcaaggaaccagtttggttcaaggctggcgcccagattttctctgaaggcggcctggactaccttgggaacccgaaccttgtccatgctcagagcatattggcagttctcgggttccaggtagtcttaatgggccttgttgaggggttccgtatcaacgggcttgaaggggttggagatggtaacaatttgtacccgggtgggcaatactttgacccgttgggccttgcggatgatccggtaacttttgctgagttgaaggtgaaagagatcaagaacgggagactggctatgttttctatgtttgggttctttgtgcaagcaatagtgacaggcaaaggcccattagagaaccttttggatcatttggacaaccctgtggctaacaatgcatgggtctacgccaccaagtttgtgcctggctcttagacttttaagcctttgcgttgttattgtaacctcgagtttgtggtgaaaatatgtagattattataaattagttctatatatattatggtatttataagatggtcttgtttatttgttaaaaaagaa

SEQ ID NO: 2425 - DNA, 864 bp, Ambrosia trifida
aagcttccattaatggcatccatggctgctaactcatccactgttgtcagagccacccctttcttgggtcaaaccagagcttcaaatgtcaactcccttagagattctgtttccatggtcaatggcaagttcaccatgggaaatgacttgtggtatggaccggaccgagtgaagtacttgggacctttttcggcccaaacaccatcatacctaactggtgaattcccgggtgactatggatgggacactgctggtttatctgctgatcccgaggcttttgccaagaaccgggctcttgaggtgatccatgggagatgggcaatgttaggagcattcgggtgcatcacacccgaagtcctcgaaaaatggctaaaagtggattttaaggagcccgtttggttcaaagccggagcccaaatcttctccgaaggcgggctagactatttaggcaacccaaacctagtccacgcccaaagcatattagcggttctcggtttccaagtggtcctaatgggcttggttgaaggcttccgtattaatgggcttgagggtgtcggagatggtaacaacctctacccggggggccaatactttgacccgttgggccttgcggacgacccgattacttttgctgagttgaaggtgaaggaaatcaagaatggaagactagcaatgttttcaatgttgggttttttgtacaagcaattgtgacagggaaaggcccattggagaaccttttggaccatttggacaaccctgtggctaacaatgcttgggtctatgccaccaagtttgtgcctggttcataaacattgtggcttttgaactgttcttgtaaacattggatgaaacaattaaataaaa

SEQ ID NO: 2426 - DNA, 1041 bp, Ambrosia trifida
taacacaattgcatcttccttgtttccacaccaagagatcctccatcaatggctgccactgctagctccaccactgtggtccaagccacccccttcttgggtcaaactagaccatctagcctcaaccccttgagagatatggtctctatgtccagtgccaaatacaccatgggaaatgatttgtggtatggaccagaccgtgttaagtacttgggacccttttcggctcagactccatcgtacttgaccggtgaattccctggtgactacggttgggacaccgccggtttgtcagcggatcccgaggcttttgccaagaaccgggctcttgaggttatccatggacgatgggccatgcttggtgccctcgggtgcatcacacccgaggtgcttgaaaagtgggtgaaagtggatttcaaggaaccagtttggttcaaggctggcgcccagattttctctgaaggcggcctagactaccttgggaacccgaaccttgtccatgctcagagcatattggcagttctcgggttccaggtagtcctaatgggccttgttgaggggttccgtatcaacgggcttgaaggggttggagatggtaacaatttgtacccgggtgggcaatactttgacccgctgggccttgcggatgatccggtaacctttgctgagttgaaggtgaaagagataaagaacgggagactggctatgttttctatgtttgggttctttgtgcaagcaatagttacaggcaaaggcccattggagaaccttttggaccatttggacaaccctgtagctaacaatgcatgggtctacgccaccaagtttgtgcctggctcttagacttttaattaagccttttagcgtttgttgttgtaaccttaaaatttgtagtgaaatatgtatattattaataaaattgttactatatattatgacaatttaataaaaaagtaaaaagtaccgtaacttagtacgtaactacttacgacgtttagattacccacgtcgtacttagggacccgtcgttccgttctacgg

SEQ ID NO: 2427 - DNA, 961 bp, Ambrosia trifida
cagtctccagacgaagcggccgacgtatctaacgacacgagtaacgtcgggaagtactctttctaagttaattttaagtacttccattcatggcatccatggctgctaactcatccactgttgtcagagccacccctttcttgggtcaaacaagaacctcaaatgtcaactcccttagagattctgtttccatggtcaatggcaagttcaccatgggaaatgacttgtggtatggaccggaccgagtgaagtacttgggacctttttcggcccaaacaccatcatacctaactggtgaattcccgggtgactatggatgggacactgctggtttatctgctgatcctgaggcttttgccaagaaccgggctcttgaggtgatccatgggagatgggcaatgttaggagcattcgggtgcatcacacccgaagtcctcgaaaaatggctaaaagtagatttcaaggagcccgtttggttcaaagccggagcccaaatcttctccgaaggcgggctagactatttaggcaacccaaacctagtccacgcccaaagcatattagcggttctcggtttccaagtggtcctaatgggcttggttgaagggttccgtattaacgggcttgagggtgtcggagatggcaacaacctctacccgggaggccaatactttgacccgttgggccttgcggacgacccgattacttttgctgagttgaaggtgaaggaaatcaagaatggaagactagcaatgttttcaatgtttgggttttttgtacaagcaattgtgacaggaaaaggcccattggagaaccttttggaccatttggacaacccggtggctaacaatgcttgggtctatgccaccaagtttgtgcctggttcataaacattgtggctattggactgttcttgtaaacattggatgaaacaaattaaataaaatattaattgtttagtagt

SEQ ID NO: 2428 - DNA, 819 bp, Arnica chamissonis
atcaatggcatccatggctgctaactccaccacagttgtcagagccacccctttcttgggtcagaccaaagcctccaatgtcaactcccttagagattctgtctccatggtcaacggcaagttcaccatgggaaacgacttgtggtatggaccggaccgagttaagtacttgggacccttttcggcccagacgccatcatacttgaccggtgaattccctggtgactatggctgggacactgctggtttatctgccgatcctgaggcttttgccaagaaccgggctcttgaggtaatccacggaagatgggcgatgctaggagcattcgggtgcatcaccccggaagtcctagaaaaatgggtgaaagtggatttcaaggagcccgtttggttcaaagccggatcccaaatcttctctgaaggcgggctagactatttgggcaacccaaacctagtccacgcccaaagcatattagcggtactcggttttcaagtggtcctcatgggcttggttgaagggttccgtattaatgggcttgagggtgttggagacggtaacaacctctacccgggtggtcaatactttgaccccttggggcttgcggatgacccgactacttttgcggagttgaaggtgaaggaaatcaagaatgggagactagcaatgttttcaatgtttgggttttttgtgcaagcaattgtgacaggaaaaggaccgttggagaaccttttagaccatttggacaaccctgtggctaacaatgcatgggtctatgccaccaagtttgtgcctggttcataaatcttgtggctttgtaa

SEQ ID NO: 2429 - DNA, 825 bp, Arnica chamissonis
atcaatggcatccatggctgctaactccaccacagttgtcagagccacccctttcttgggtcagaccaaagcctccaatgtcaactcccttagagattctgtctccatgatcaacggcaagttcaccatgggaaacgacttgtggtatggaccggaccgagttaagtacttgggacccttttcggcccagacgccatcatacttgaccggtgaattccctggtgactatggctgggacactgctggtttatctgccgatcctgaggcttttgccaagaaccgggctcttgaggtaatccacggaagatgggcgatgctaggagcattcgggtgcatcaccccggaagtcctagaaaaatgggtgaaagtggattttaaggagcccgtttggttcaaagccggatcccaaatcttctctgaaggcgggctagactatttgggcaacccaaacctagtccacgcccaaagcatattagcggtactcggttttcaagtggtcctcatgggcttggttgaagggttccgtattaatgggcttgagggtgtcggagacggtaacaacctctacccgggtggtcaatattttgacccgttggggcttgcagatgacccgactacttttgcggagttgaaggtgaaggaaatcaagaatgggaggctagcaatgttttcaatgtttgggttttttgtgcaagcaattgtgacagggaaaggaccgttggagaaccttttggaccatttagacaaccctgtggctaacaatgcatgggtctatgccaccaagtttgtgcctggttcgtaagttttgtggctttgtaattgttc

SEQ ID NO: 2430 - DNA, 917 bp, Gossypium hirsutum
caatggcttccatgcttagctctggaactgttcttaggccaaccccatttcttggccaaacaaaaatgctaaccctcttagagatgttgtctctttgggcactcccaaatatgcaatgggaaatgaactatggtatggaccagacagagtgaagtacttgggaccattttcagctcagactccatcttacttgactggagaattccctggagactatggttgggacactgctggtttgtcagccgaccctgaggcctttgccaggaatagggctcttgaggtcatccatggaagatgggcaatgttgggagcactaggctgcatcacaccagaagtacttgagaaatggcttagggttgatttcaaggaaccagtatggttcaaggcaggagctcaaattttctcagaaggtggcttggattacttaggcaaccctaacctagtccatgctcaaagcatcctcgccgttctcggattccaagtcgtcctaatgggactcgtcgaaggattccgcatcaatggcctccctggtgttggtgaaggcaatgatctttaccctggtggacagtactttgaccctcttggccttgctgatgaccccgttacatttgctgaacttaaggttaaagaaatcaagaatggtaggctagccatgttttcaatgtttggtttctttgttcaagccattgttaccggtaaaggtcccttggagaacctattggaccaccttgataaccctgttgcaaacaatgcttgggtctatgctactaagtttgtgcctgggtcttaaatgaaaatagccaaaaggtcaaaacttgtataatttgctttgtgtggattagaaattgagatatgtgtatttatgtgattgtaggttttgaacaactttgacaaatcaaattatgtgccattaagaa

SEQ ID NO: 2431 - DNA, 968 bp, Ipomoea batatas
gggctccagcagttatttaacagaaaactagtctcccaactctaagcttgagagaatccaagaatggcatccatggcagctgctgctagctccaccactgttgtcagagccaccccattcttgggtcagaccaagaatgctaatgctcttagagatgctgttcccatgggacctgctaaatttaccatgggaaatgatttgtggtatgggcctgaccgtgttaagtacttgggacccttttctgctcaaactccttcatacttgactggggagttccctggtgattatggatgggacactgctggtttgtctgctgatcctgaggcttttgccaaaaacagggctcttgaggtgatccatggaaggtgggcaatgcttggagcactgggatgcataaccccagaagttcttgaaaaatggttgaatgtggacttcaaggagccagtgtggttcaaagcaggagctcagatcttctcagaaggaggcctggactacttgggcaacccaaaccttgttcatgcccagagcatcttagcagtgctgggcttccaagttgtcctcatggggcttgttgaaggcttcagaatcaatggcctccctggagttggagagggcaatgacctctaccctggtggccaatactttgatcccctcggcctagccgacgacccgaccacctttgctgagctcaaggtgaaggaaatcaagaatggcagactagccatgttctccatgtttggtttctttgtccaagccattgttactggcaaaggccctctggagaacctcttggaccaccttgacaaccctgtggctaacaatgcctgggtttacgccaccaagtttgtccccggatcataaatttcggtctccctggattcatctgtgttgttcatccaaacccctaatgtatgattgaaaaaaaatgaaaattttctgtagattatatataatttatgagagtttgg

SEQ ID NO: 2432 - DNA, 935 bp, Phalaenopsis aphrodite
cataaatcaaggaggtgaattcagccagactgatggcagcaaccatcatcaggccaactccattcctcggtcaggctcggccagcttctgccgccgccaatcctctcaaagatggcctgcaaatggctgactggaagttcaaaatgggcaatgatctgtggtatgggcctgacagagtgaaatacttgggacctttctcggctcagacaccatcgtacctaaccggagaattccctggtgattacggctgggacactgctgggctctcggctgaccctgaggcatttgccaaaaatcgcgctcttgaggtaatccatgggcgatgggcaatgcttggtgctctaggatgcataaccccagaggttctggagaagtggttgagagtggatttcaaggaacctgtttggttcaaagctggctcccaaatcttcagcgaaggaggactcgactatcttggaaatcccaaccttgtccatgcacagagcattcttgctgtgcttggcgtccaggtaatcctcatgggactggttgagggctaccgcatcaatggcttggatggagttggagaaggcaacaatctctacccaggtggtacctactttgatcctctcggccttgctgacgatcctccgacatttgcagagctgaaggtgaaggagatcaagaatggccggcttgcaatgttctccatgtttggtttcttcgtccaggccattgtcacaggtaaagggccattggagaacctcttagaccatctggatgacccagtggctaacaatgcatgggcatatgccaccaaatttgtgcctggttcttaagtagcttggaattttcaggagctctcgtggattgttattcccaagctttggagattgaaattgtaatgttattacttcatttccttttgtttggcttttaaattgaagcttatgaag

SEQ ID NO: 2433 - DNA, 1510 bp, Lippia dulcis
acagacaaaaatctcatagaaatggcatcaatggctagctccacaacccttgtgaaagcaaccccattcttgggccaaaccaagaatcccaatcctcttagagatgttgtctcaatgggcaatgccaaatacaccatgagcaatgacttgtggtacggaccggaccgtgttaagtacttgggacccttctcggctcagactccttcctacctcaacggagaattccccggtgactacggatgggacacggccggtttgtccgccgatcccgaggccttcgccaagaacagggctctcgaggttattcatggaagatgggccatgcttggagctctcggatgcatcacaccggaggttcttgaaagatgggtgggtgtgaacttcaaggagccagtgtggttcaaggccggtgcacaaatcttttccgagggtgggctagactatttaggcaaccccaatctggtccatgctcaaagcattctagcagttcttggattccaggttgtactcatgggactcgtggagggattcagaatcaacggccttgacggagttggagagggcaacgacctctaccccggtggccagtacttcgacccactcggcctggccgacgacccagtcacatttgccgagctgaaggtcaaggagatcaagaacggaaggttggccatgttctccatgttcggattcttcgtgcaagcaatcgtcaccggaaagggacctctcgagaaccttttggatcatctcgacaaccctgttgctaacaatgcctgggtctacgccaccaaatttgccccaggatcataatcgagcatataatgtatagatataatgtgttgtacattatgtatttgagtgcatcaatgttctgttccattcaatgatttccacatatgttgttcatcggctaaagaagaaaggaaacattaattacatagctaacacggcggatactatacacgaatagaagagagagacttagacttaatgcaacaacaaaattgatatatacagattcatgggcgcttcatctcttacttttcctcccccaccatttcattctgtgtttctcagcttcgcttctcccctgcttgtacacttttgcctttgcttccttcaacctcgccttgtaatccttcttccacgcttcgaacctgtctctcagcctccggaattcctctaccgcatgtacaggcgacactgacttgacctccacaactgcatcattgaaagcacggcttctgtcctcaaactcctgggtgaggtggctcacagggttcaggcttaagttcgtgtctcgacaaggcaactcatcaatgccattgttggcgtatctgactggggagctaccacccggcgtctgagttctagatgtgtcctcggattcataaaattgaggtgactgcgctccgtcgagccttcttgctggctttatagcattttcagcaataagactcttcttggctgcagccaagctcatttgtagagatgttatctgcttttgccg

SEQ ID NO: 2434 - DNA, 1125 bp, Helianthus annuus
ggatttggatggatataagagtcgaagatattagaaatctttggaagctctcttattggttcttcccatatttccaacttcagccatacacgtgtcacttctcacctcttctataaacttccccatcatcaccaacagacaacaacacttgcatcttcctcttttcaagtttcaaccaccaaagaaatcctccatcaatggctgccgctgctagctccaccaccgtggtccaagccacacccttcttgggtcaaactagaccatctagcctcaaccccttaagagatatggtctctatgcctagtgccaaatacaccatgggaaatgacttgtggtatggacctgaccgtgtgaagtacttgggacccttctcggctcagaccccatcttacttgacgggtgaattcccgggtgactatggttgggacacagcaggtttgtcagctgatcccgaggcttttgccaagaatcgggctcttgaggtcatccatggacgatgggccatgcttggtgccctggggtgcatcacacccgaggtgcttgaaaagtgggtgaaagtggatttcaaggagccagtttggttcaaggccggcgcccagattttctctgaaggtggtctggactaccttgggaacccgaaccttgtccatgctcagagcatattggcagttctcgggttccaggtagtcctgatgggccttgttgaggggttccgtattaacgggcttgagggggttggagatggtaacaatctgtatccaggtgggcaatattttgacccgttgggactagcggatgacccggtgaccttcgcagagttgaaggtgaaagagatcaagaatggaagattggctatgttttccatgtttgggttctttgtgcaagcaatagtgacaggcaaaggcccattggagaaccttttggaccatttggacaaccctgtggctaacaatgcatgggtctacgccacaaagtttgtgcctggctcttagacttattagcctttgcattgttgttgtaacctcaagtttgtggtaaaaattgtgtagattattataagttagttatatatattatggtgtttatttggtcaatttcatgaattgaaataataaaaaataaaaa

(The sequence listing continues in the following parts.)

What is claimed is:

1. A method of reducing time to flowering of a plant under non-stress conditions, comprising:
   (a) expressing within the plant an exogenous polynucleotide comprising a nucleic acid sequence encoding the polypeptide set forth in SEQ ID NO: 314, and
   (b) selecting plants expressing said exogenous polynucleotide for a decreased time to flowering under non-stress conditions as compared to control plants of the same species under the same growth conditions,
   thereby reducing the time to flowering of the plant under the non-stress conditions.

2. A method of reducing time to flowering of a plant under non-stress conditions, comprising:
   (a) expressing within the plant an exogenous polynucleotide comprising a nucleic acid sequence encoding a polypeptide selected from the group consisting of SEQ ID NOs: 314, 8963, 8964, 8965, 8966, and 8967, and
   (b) selecting plants expressing said exogenous polynucleotide for a decreased time to flowering under non-stress conditions as compared to control plants of the same species under the same growth conditions,
   thereby reducing the time to flowering of the plant under the non-stress conditions.

3. The method of claim 1, wherein said nucleic acid sequence encoding said polypeptide is set forth in SEQ ID NO: 215, 95 or a codon optimized sequence thereof.

4. The method of claim 2, wherein said nucleic acid sequence encoding said polypeptide is selected from the group consisting of SEQ ID NOs: 215, 95 and 5144-5149.

5. The method of claim 1, wherein said plant is wheat.

6. The method of claim 1, wherein said nucleic acid sequence encoding said polypeptide is set forth in SEQ ID NO: 215 or 95.

* * * * *